United States Patent
Sreenivasulu et al.

(10) Patent No.: US 12,433,215 B2
(45) Date of Patent: Oct. 7, 2025

(54) METHODS OF ENHANCING GRAIN YIELD, PLANTS AND PRODUCTS GENERATED THEREBY

(71) Applicant: International Rice Research Institute, Laguna (PH)

(72) Inventors: Nese Sreenivasulu, Laguna (PH); Erstelle A. Pasion, Laguna (PH); Ajay Kohli, Laguna (PH)

(73) Assignee: International Rice Research Institute, Los Baños (PH)

( * ) Notice: Subject to any disclaimer, the term of this patent is extended or adjusted under 35 U.S.C. 154(b) by 0 days.

(21) Appl. No.: 17/557,130

(22) Filed: Dec. 21, 2021

(65) Prior Publication Data

US 2022/0167576 A1    Jun. 2, 2022

Related U.S. Application Data

(63) Continuation of application No. PCT/IB2020/055840, filed on Jun. 21, 2020.

(60) Provisional application No. 62/926,585, filed on Oct. 28, 2019, provisional application No. 62/864,548, filed on Jun. 21, 2019.

(51) Int. Cl.
*A01H 1/00*     (2006.01)
*A01H 1/04*     (2006.01)
*A01H 6/46*     (2018.01)

(52) U.S. Cl.
CPC .............. *A01H 1/12* (2021.01); *A01H 1/045* (2021.01); *A01H 1/102* (2021.01); *A01H 6/4636* (2018.05)

(58) Field of Classification Search
None
See application file for complete search history.

(56) References Cited

U.S. PATENT DOCUMENTS

| | | | |
|---|---|---|---|
| 2014/0033366 A1 | 1/2014 | Frankard et al. | |
| 2014/0130203 A1 | 5/2014 | La Rosa et al. | |
| 2016/0251675 A1 | 9/2016 | Henry et al. | |
| 2018/0245095 A1 | 8/2018 | Abad et al. | |

FOREIGN PATENT DOCUMENTS

WO    WO 2020/255099    12/2020

OTHER PUBLICATIONS

Rekha et al (Apr. 20, 2018, J. Plant Biochem. Biotechnol. 27:463-472).*
Rekha et al (Apr. 20, 2018, J. Plant Biochem. Biotechnol. 27:463-472), inlcuding supplementary Table 1.*
International Preliminary Report on Patentability Dated Dec. 30, 2021 From the International Bureau of WIPO Re. Application No. PCT/IB2020/055840. (8 Pages).
International Search Report and the Written Opinion Dated Sep. 9, 2020 From the International Searching Authority Re. Application No. PCT/IB2020/055840. (11 Pages).
Adriani et al. "Rice Panicle Plasticity in Near Isogenic Lines Carrying A QTL for Larger Panicle Is Genotype and Environment Dependent", Rice, 9(28): 1-15, Published Online Jun. 2, 2016.
Das et al. "Grain Density and Its Impact on Grain Filling Characteristic of Rice: Mechanistic Testing of the Concept in Genetically Related Cultivars", Scientific Reports, 8(4149): 1-11, Published Online Mar. 7, 2018.
Madhubabu et al. "Evaluation of Grain Yield, Quality and Nutrients Content in Four Rice (*Oryza sativa* L.) Genotypes", Current Journal of Applied Science and Technology, 22(1/Art 34673): 1-12, Published Online Jun. 28, 2017.
Matsue et al. "Differences in Amylose Content, Amylographic Characteristics and Storage Proteins of Grains on Primary and Secondary Rachis Branches in Rice", Japanese Journal of Crop Science, 64(3): 601-606, Sep. 5, 1995.
Matsue et al. "Differences in Protein Content, Amylose Content and Palability in Relation to Location of Grains Within Rice Panicle", Japanese Journal of Crop Science, 63(2): 271-277, Jun. 5, 1994.
Wang et al. "Impact of Cultivar Variation in Grain Density of Rice Panicle on Grain Weight and Quality", Journal of the Science of Food and Agriculture, 88(5): 897-903, Published Online Jan. 16, 2008.
Wu et al. "Three Novel Alleles of Floury ENDOSPERM2 (FLO2) Confer Dull Grains With Low Amylose Content in Rice", Plant Science, 233: 44-52, Available Online Dec. 31, 2014.
Yano et al. "GWAS With Principal Component Analysis Identifies A Gene Comprehensively Controlling Rice Architecture", Proc. Natl. Acad. Sci. USA, PNAS, 116(42): 21262-21267, Oct. 15, 2019.
Zhou et al. "GNS4, A Novel Allele of DWARF11, Regulates Grain Number and Grain Sixe in A High-Yield Rice Variety", Rice, 10(34): 1-11, Published Online Jul. 20, 2017.
Supplementary European Search Report and the European Search Opinion Dated Jun. 26, 2023 From the European Patent Office Re. Application No. 20826989.4. (8 Pages).
Terao et al. "A Gene Controlling the Number of Primary Rachis Branches Also Controls the Vascular Bundle Formation and Hence is Responsible to Increase the Harvest Index and Grain Yield in Rice", Theoretical and Applied Genctics, 120:875-893, Nov. 22, 2009.
Communication Pursuant to Article 94(3) EPC Dated Jan. 23, 2025 From the European Patent Office Re. Application No. 20826989.4 (4 Pages).
Examination Report Dated May 8, 2025 From the Intellectual Property Officof the Philippines Bureau of Patents, Re. Application No. 1/2022/500001. (5 Pages).

* cited by examiner

*Primary Examiner* — Anne Kubelik

(57) ABSTRACT

A method of enhancing grain yield of a Gramineae plant is provided. The method comprises:
(a) crossing a recipient plant with a donor plant comprising a sequence variation in a TPR allele, said sequence variation imparting enhanced grain yield; and
(b) selecting a progeny plant of said crossing comprising said sequence variation by identifying said variation, said progeny plant being characterized by an improved grain yield relative to said recipient plant. Also provided are plants and processed products resultant of the method.

7 Claims, 40 Drawing Sheets
(36 of 40 Drawing Sheet(s) Filed in Color)

Specification includes a Sequence Listing.

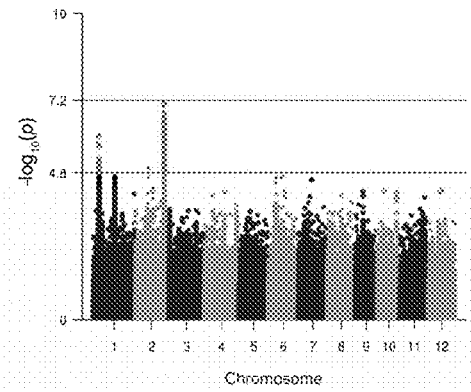
FIG. 2A
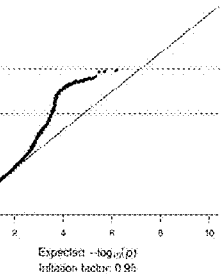
FIG. 2B
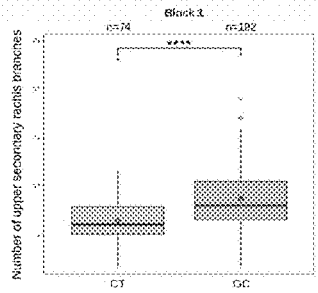
FIG. 2D
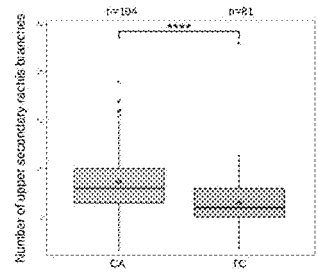
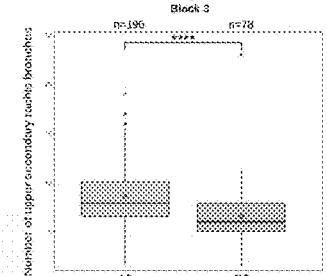
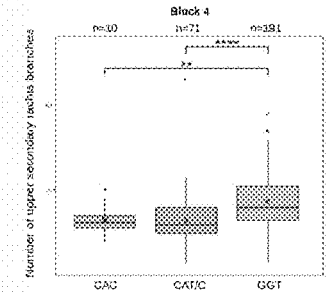
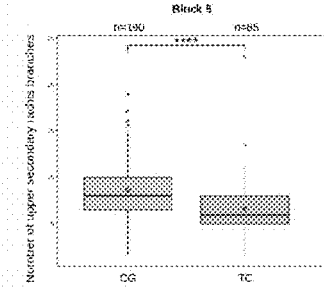
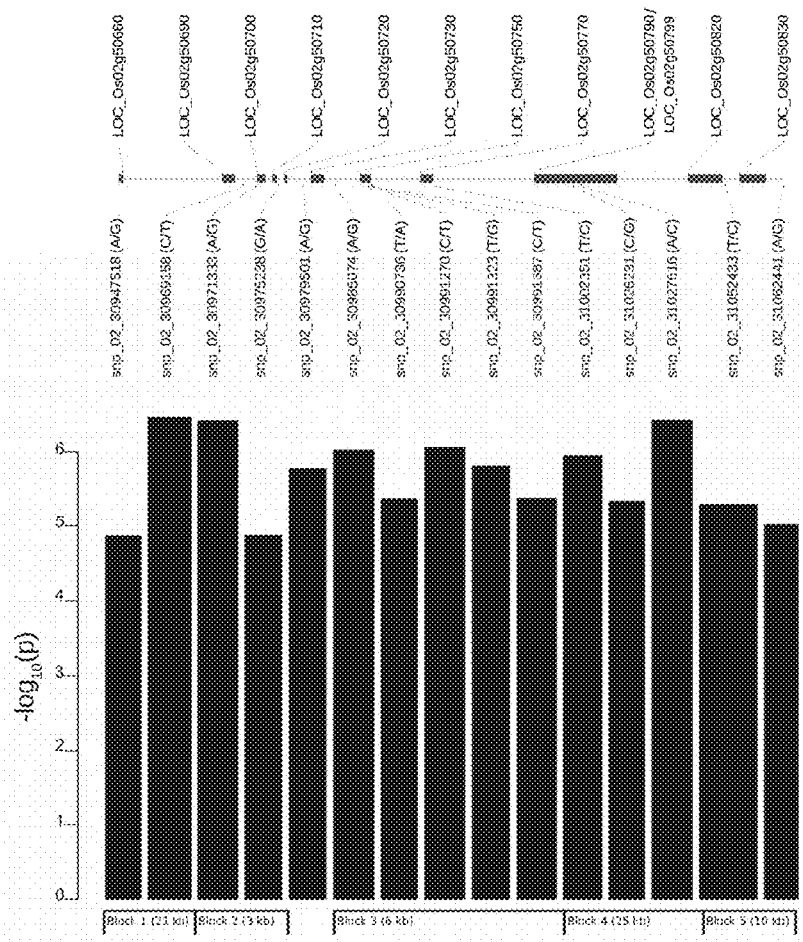
FIG. 2C

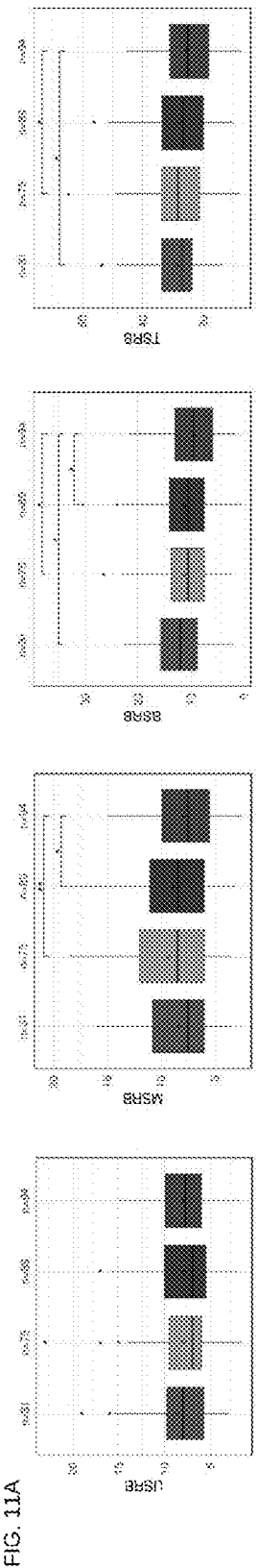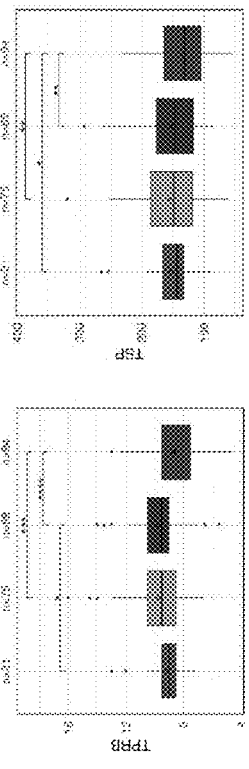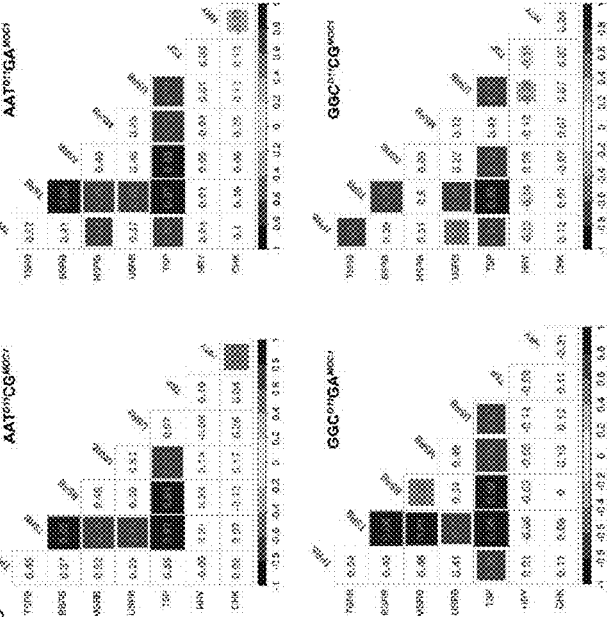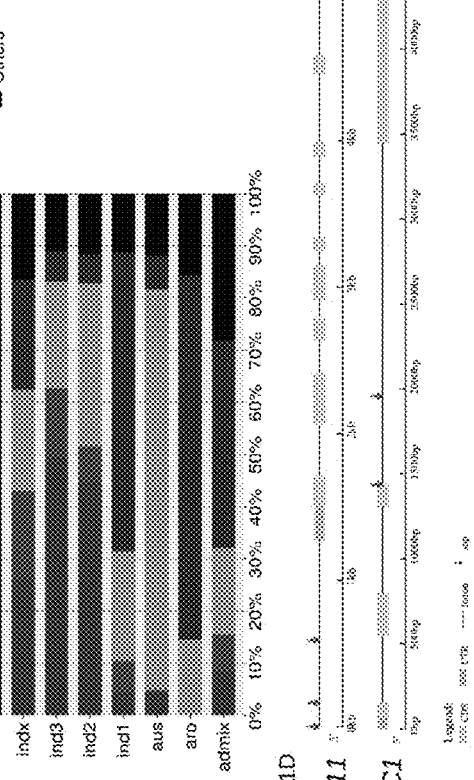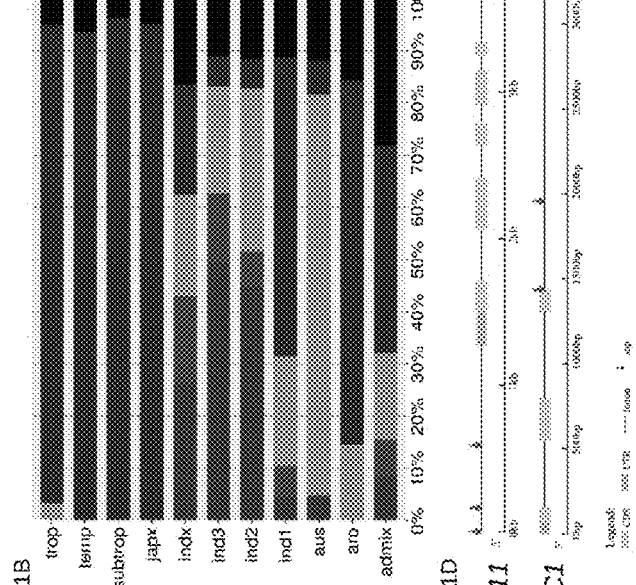
FIG. 11A
FIG. 11B
FIG. 11C
FIG. 11D

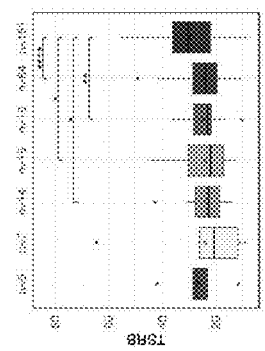
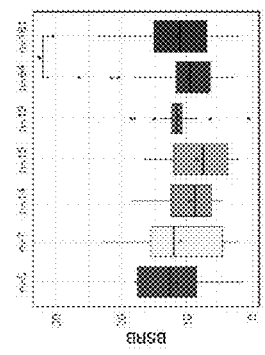
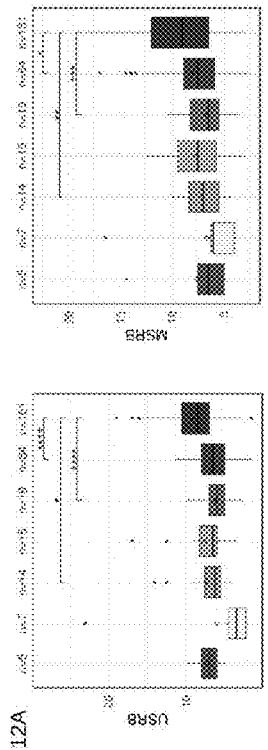
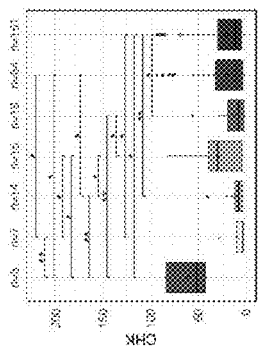
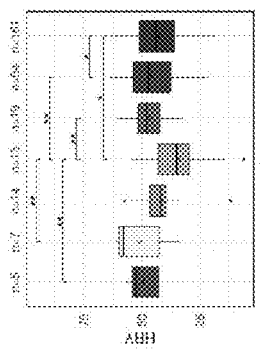
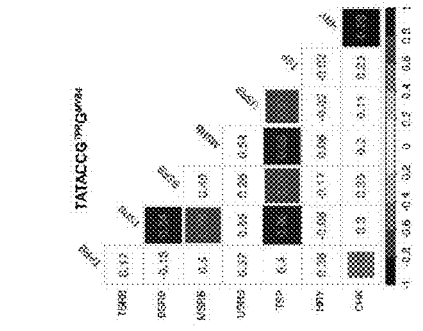
FIG. 12A
FIG. 12B
FIG. 12C
FIG. 12D Legend: TPR/MLP1/MLP2

```
AT1G79280   MPLFMPDEELARLSSDAASVVAERADEYIRKIYAELDSVRAKADAASITAEQTCSLLEQK  60
OsTPR       MPLFMSEEELRLLGGDVA-AVAERADAAIRELRQQVDTVRAEADAAAIAAEQTCALLEQR  59
            *****,:***  *,,*,* ,******  **;:  ;;*:***:****;*;****;****;

AT1G79280   YLSLSQDFSSLESQNAKLQSDFDDRLAELAQSQAQKHQLHLQSIEKDGEVERMSTEMSEL  120
OsTPR       YDTLSAEADRFRAELAELAAASERRAADLASSQSEIHQLRIQAIAKDGEIERLKVEISEV  119
            * ;**  ;  , ,,;;  *;*  ;  * *;**,**;;, ****;;*;;*  ****;:**;

AT1G79280   HKSKRQLMELLEQKDAEISEKNSTIKSYLDKIVKLTDTSSEKEARLAEATAELARSQAMC  180
OsTPR       HKSKQSLELIEQRDAEIREKDGIIQNYLDKIVNLADSSASKGARIQEVEAKFTHLQATC  179
            ****  * ;*;,**;**** **;, *; ******;*;*;*;, * **;  *; *;;:;; ** *

AT1G79280   SRLSQEKELTERHAKWLDEELTAKVDSYAELRRRHSDLESEMSAKLVDVEKNYIECSSSL  240
OsTPR       NRITQEKDLLEKHNLWLDEELKEKVKNLAELRKSNMDEEARMSAKVAELERETSESSSSL  239
            .*;;***;* *;;*  ******, **,, ****;  ; * *;,,**** ;;;;*;;  *,****

AT1G79280   NWHKERLRELETKIGSLQEDLSSCKDAATTTEEQYTAELFTANKLVDLYKESSEEWSRKA  300
OsTPR       RRSKERVSELEQRVSYMEKELCSTKDAAAANEQRLAAELSTVMKLAELHKESSEEWSKKA  299
            . ***; ***  ;;, ;;;;;*,* ****;;,*;; ;*** *, ** ;*;*********;**

AT1G79280   GELEGVIKALEARLSQVESSYKERLDKEVSTKQLLEKENGDLKQKLEKCEAEIEKTRKTD  360
OsTPR       GELEGVIKALETHLTQVEDEYKEKLEKETSAKRDLEMEATYLKQKLEKCESDLENTRKSS  359
            ***********;;*,****,,***;** *,*;;* **  *   ***********;;;*;***;;

AT1G79280   ELNLIPFSNFT--------RRVDNSGTSNMIEESQAVISKVPAGVSGTALAASLLRDGWSL  413
OsTPR       ELSFTPLVAADPCDLAGSPMKEMAFSDPANQNDLMIVPKVPTGVSGTALAASLLRDGWSL  419
            **,; *;         : ;   ;;,    ;;,,***;******************

AT1G79280   AKIYEKYQEAVDAMRHEQLGRKEAEMILQRVLSELEEKAGFIQEERGEYERVVEAYCLVN  473
OsTPR       AKIYEKYQEATDALRHERFGRRHAEAVLERVLHEIEEKAELILDERAEHRRMVEAYALMD  479
            **********;**;;***;;**;;**; *;****  *; ****; ;****;*, ;; ;**,*;;

AT1G79280   QKLQDSVSEQSNMEKFIMELKADLRRRERENTLLQKDISDLQKQVT---------------  519
OsTPR       QKLQQALLEHDNFENTIRNLKSELKRRERDHSIAQKEIDDLQKQIKLSIYLTFAPTQACI  539
            ****;;; *; *;*; * ;**;;;*;*** **;*;*****;;

AT1G79280   ----------------------------ILLKECRDVQLRCGAARDDDEDDYPLLSDVEMEMES  555
OsTPR       LGVCTSKNYYDINGNHCGAVLKIAVLLKECQDIQLRCGSSLPNVGDGALSTSTSTGVPEV  599
                                         ;*****;*;*****;;    ;  *,   *    *

AT1G79280   EADKIISEHLLKFKDINGLVEQNVKLRNLVRSLSEQIESRETELKETFEVDLKNKTDEAS  615
OsTPR       ENN---IHEHMTFNDINGLVQQNVQLRNQVHLLSADLDKRDMELRESFQIELKKITDDAA  656
            *  :      ,. ;;.;******;****;*; ** *;  ** ;;;,*; **;*;**;  **;*;

AT1G79280   AKVATVLKRAEEQGQMIESLHTSVAMYKRLYEEEQKLHSSDSRSSDLSPAVVPGRKNFLH  675
OsTPR       SRVEKVMKKSEEQAIMIESLHRSVAMYRKLCEEQQKSRSNVEHIPKN--LEDDGRKDLMV  714
            ;;*  ,*;*;;***, ****** *****;;** **;**  ;*,  ;,  ,,      ***;;;

AT1G79280   LLEDSEEATKRAQEKAFERIRILEEDFAKARSEVIAIRSERDKLAMEANFAREKLEGIMK  735
OsTPR       LFEGSQEVSRKAYEQVSERAKSLDEELTKLRTELLSLRSERDKAVLEAEFARERLNGFTA  774
            *;*.*;*.;;;;* *; ** ; *;*;;;* *;*;;;;******  ;**;*****;* ;*;

AT1G79280   ESERKREEMNSVLARNIEFSQLIIDHQRKLRESSESLHAAEEISRKLSMEVSVLKQEKEL  795
OsTPR       ELEHQRKEANSISLRNAELMHLVVDYEKRLRENSESMKAVEENSRKLLMEMSILKNEKEI  834
            *  *;;;;* **;  **;   **  *; ;****.***,***  .** **;**,;;;;**;*;
```

FIG. 15

```
AT1G79280    LSNAEKRASDEVSALSQRVYRLQATLDTVQSTEEVREETRAAERRKQEEHIKQLQREWAE  855
OsTPR        LAKSEKKALEEVHDLTTRVHRLQATIDTIHATEEVQENARSIERRNQEEYIKRLERDWAE  894
             *:;:**;*  :**    *;: **;*****;**;;;****;*;:*: ***;***;**;*;***

AT1G79280    AKKELQEERSNARDFTSDRNQTLNNAVMQVEEMGKELANALKAVSVAESRASVAEARLSD  915
OsTPR        VKKELQEQRDHVRVLTLDKKNAFDGCLKQVEDMRKELQNSWKAATDAESRAAVAEAKCSD  954
             ,******:*.::* ;*  *;::::;,; ***;* *** *; **,:: *****;****; **

AT1G79280    LEKKIRSSDPKTLDMDSGGIVSLSDKEAALVIILDVVHKIQAGFRIGSAMSIELRTAKEE  975
OsTPR        LETKLKSRKE---------------------------------------NDELFQLKEE  974
             **.*;;*  .                                        . **  ***

AT1G79280    IEKLRGEVESSKSHMLQYKSIAQVNETALKQMESAHENFRLEAEKRQRSLEAELVSLRER  1035
OsTPR        LEKYKEEAQANKSYMLQYKEIANSNESALKQMESALQDFKTESETIKKSLEDEITKLRTK  1034
             :**  :  *,;:.**;***** **; **;********   ;;*;  *;*.  ::;*** *:,,**  :

AT1G79280    VSELENDCIQKSEQLATAAAGKEDALLSASAEIASLREENLVKKSQIEAMNIQMSTLKND  1095
OsTPR        ISELEKCYIMKCEEAASAIEAKEKDTTSLMKEISVLRNEVSEKVIQIEKLETELASSKRA  1094
             ;****;  * *,*; *;*  .**,   *   **; **;*    *  *** ::  :::: *.,

AT1G79280    LETEHEKWRVAQRNYERQVILLSETIQELTKTSQALAALQEEASELRKLADARGIENSEL  1155
OsTPR        LDEQYKRWRSAQDNYERQVILQSETIQELTSASKELSSLQQEIIVLRQTVETQKAENDGL  1154
             *;: :;:;;:** ** ********* ******.;*;  *;;**;* **;  .::;   **. *

AT1G79280    NAKWSEEKLMLEQQKNLAEKKYHELNEQNKLLHSRLEAKHLNSAEKNSRSGTISSGSTDS  1215
OsTPR        RTLGEQEKIELVKGKDEALQKYNELNDQNKILHNQLEALHIRLAEKERNIAGLSSQRIDS  1214
             ,:   ,:**:  *  : *; :   *;**;***;**  ,;**** *;; , ;  ;** **

AT1G79280    DHLEDSGLQRVVHYLRRRTKEIAETEISLMRQEKLRLQSQLESALKMAESARGSLTAERAS  1275
OsTPR        HGEDD--LHSVIGYLRRSKEILESALKSTKEAQDLLRSQTDSAR------TSMLKDEEFK  1266
             . ;*   *;  *;  ;***;:****.*   *;  ;: ::  *;** :**            , *., *,.

AT1G79280    TRASLLTDDGIKSLQLQVSEMNLLRESNMQLREENKHNFEKCQEMREVAQKARMESENFE  1335
OsTPR        SLQFQLVFFCIKNALPQVRELNLLRESNIQLREENKHNFEECQKFHDEAQKAKMEAERLH  1326
             ;   *    **,  ** *;;******** ;**********;**:;;;  ****;**:*.,,

AT1G79280    NLLKTKQTELDLCMKEMEKLRMETDLHKKRVDELRETYRNIDIADYNRLKDEVRQLEEKL  1395
OsTPR        NLLLEKQVDAEICKKEIEMQKTEIANLNQKISELVENSRGVDLSTYETMKDELQNIKATL  1386
             ***    **; ;;;* **;*  ;  *   ::::;** *; *;:*; *;   ;****;;;;   .*

AT1G79280    KAKDAHAEDCKKVLLEKQNKISLLEKELTNCKKDLSEREKRLDDAQQAQATMQSEFNKQK  1455
OsTPR        RENSAELERTKKLLSEKDSVIRNLEEKLAGCQSELDAREKKLNDVEAS----------LK  1436
             ; ;.* . *  **;* **;. *  **;;*;;.*;;;* ***:*;*;,;   :             *

AT1G79280    QELEKNKKIHYTLNMTKRKYEKEKDELSKQNQSLAKQLEEAKEEAGKRTTTDAVVEQSVK  1515
OsTPR        SEIDRHRKININIKRKLDASAKEKEELTKEKQSLSKQLEDLKSS--KTTTENSNEQAIK  1494
             .*::::;;**; ,;::    *** ;**;**;*;;***;****** *;..  ;***;  **;;;*

AT1G79280    EREEKEKRIQILDKYVHQLKDEVRKKTEDLKKKDEELTKERSERKSVEKEVGDSLTKIKK  1575
OsTPR        E---KDFRIQTLEKVLEKERDDNKKEKAFRRRNEKVFTTAIQNMNQERKQVEESIEKHRQ  1551
             *   *; *** *;*  ;;: ;*;  :*;,    ;;;;;  ;*. .; ;. ;,  .*;; *;;  * :;

AT1G79280    EKTKVDEELAKLERYQTALTHLSEELEKLKHADGNLPEGTSAVQVLSGSILNDQAAAYVS  1635
OsTPR        AVKEVIEHYTGISSQIPSGSSAIDEQLRSYFLAIKAVEE--------SPSPFQDGAASQTP  1603
             .:* *;.: :,.   :: : ;.*:*.. * : *       * *  ::* **: ..

AT1G79280    AVEYFERVARSIASNSQVSTKP---TDMVTEPSSGIPAAEPSTMTRVPSSTPLIKSPVAT  1692
OsTPR        SVESADVDASAATAGRQVATPPRPAQVKVVEERAVSTLPKPSTEVRRPGGRRPLVRPSLE  1663
             ;** ;  * :;;. **;* *      *,*  ;     .  :.;***  .* *..  :   *
```

FIG. 15 Continued I

```
AT1G79280   TQQLPKVASDNKEKRLISQKPSTEFRRPSGRRIVRPQLVKPEESPKVDVDMPEAEGTGDE 1752
OsTPR       RVEEPQADIDTTVVEGSTEKGGLLMERETPGGVSALQPS----SRKRLIPSPQTRDDASQ 1719
             :*:. *..  . ::* .:.*  :   *    * *  : *::.. .:

AT1G79280   GKQPAAHEPESQVTTSVRPVQTLVRKRQADSLVSEPQQDSLTQGETSSEIAPPASKKAKG 1812
OsTPR       GETTDANPP-------------LKKPKEGSSQCTSELKTEQSPHEDVMAPVPVLPSTELD 1766
            *:  .*: *             * : ::..*  :.   : .: *    .*  .,  ..

AT1G79280   SESHPDTSEGENLAKEPAIDELMDATTTTDGDNEETEAENAEEKTEEYVEAQQDNEADEP 1872
OsTPR       EQQPGEEMDTDQSSLPVEEVEETREDDLGDKDDMETHIDASMDIQGQDAETGIDNDATT- 1825
            .:.   :   : ::: :     *        * *:.**.  : :    : .*: **:*

AT1G79280   VEESPTETETIPTEEESRDQTEEENQEPLTDMESDKEEGELDLDTLEDLEEGTDVASMMR 1932
OsTPR       VEDVPVKSEAVMESLEEDLKTEDGKEEGQFTATTDVED-EREEGELPDEPEQPDSTPPVL 1884
            **: *.::*:*:  . *.  :**: ::*     :* *: * . * *   *.* :. :

AT1G79280   SPEKEEVQPETLATPTQSPSRMETAMEEAETTIETPVEDDKTDEGGDAAEEAADIPNNAN 1992
OsTPR       DVGEQAGDSFRAASPAGPTEKSDVDMPEETGEGDGTMESDQSPVPQSGGADAS--PSQMA 1942
            .   ::  .:   *:*: ,,,:  .  * *         :  ,:*.*::    ,,, :*:  *.:

AT1G79280   DQQEAPETDIKPETSAATTSPVSTAPTTSSTLASAITSSGAPETEDPKRAPSPGGGSSTI 2052
OsTPR       DASPSPAREPSPNPVQAGAPPEQQNPTPPNPVQAGASSE---QQNPATAAEGVETRSTRT 1999
            *  .  :*   : *:.  *  :*.  **,....: :.  :*.       : :..  *.   *:

AT1G79280   VTLADRAQMKRRERIANIVVSRAPNPATRGARGRTVNLRGGGRLLPRGGRAPRGGRGQSP 2112
OsTPR       INLTERARQNRQARILRSATQQN----ARGRGNQSLTYRKDGGRGTRG----RGGRGQS- 2050
            :.*::**:. :*: **  . ,.::   :** ,:::, *,*  .** *******

AT1G79280   SPP 2115
OsTPR       --- 
```

FIG. 15 Continued

| | | |
|---|---|---|
| 10274 | MPLFMSEEELRLLGGDVAAVAERADAAIRELRQQVDTVRAEADAAAIAAEQTCALLEQRY | 60 |
| 10385 | MPLFMSEEELRLLGGDVAAVAERADAAIRELRQQVDTVRAEADAAAIAAEQTCALLEQRY | 60 |
| 9184 | MPLFMSEEELRLLGGDVAAVAERADAAIRELRQQVDTVRAEADAAAIAAEQTCALLEQRY | 60 |
| 8405 | MPLFMSEEELRLLGGDVAAVAERADAAIRELRQQVDTVRAEADAAAIAAEQTCALLEQRY | 60 |
| 8536 | MPLFMSEEELRLLGGDVAAVAERADAAIRELRQQVDTVRAEADAAAIAAEQTCALLEQRY | 60 |
| 8733 | MPLFMSEEELRLLGGDVAAVAERADAAIRELRQQVDTVRAEADAAAIAAEQTCALLEQRY | 60 |
| 9605 | MPLFMSEEELRLLGGDVAAVAERADAAIRELRQQVDTVRAEADAAAIAAEQTCALLEQRY | 60 |
| 9832 | MPLFMSEEELRLLGGDVAAVAERADAAIRELRQQVDTVRAEADAAAIAAEQTCALLEQRY | 60 |
| | ************************************************************ | |
| 10274 | DTLSAEADRFRAELAELAAASERRAADLASSQSEIHQLRIQAIAKDGEIERLKVEISEVH | 120 |
| 10385 | DTLSAEADRFRAELAELAAASERRAADLASSQSEIHQLRIQAIAKDGEIERLKVEISEVH | 120 |
| 9184 | DTLSAEADRFRAELAELAAASERRAADLASSQSEIHQLRIQAIAKDGEIERLKVEISEVH | 120 |
| 8405 | DTLSAEADRFRAELAELAAASERRAADLASSQSEIHQLRIQAIAKDGEIERLKVEISEVH | 120 |
| 8536 | DTLSAEADRFRAELAELAAASERRAADLASSQSEIHQLRIQAIAKDGEIERLKVEISEVH | 120 |
| 8733 | DTLSAEADRFRAELAELAAASERRAADLASSQSEIHQLRIQAIAKDGEIERLKVEISEVH | 120 |
| 9605 | DTLSAEADRFRAELAELAAASERRAADLASSQSEIHQLRIQAIAKDGEIERLKVEISEVH | 120 |
| 9832 | DTLSAEADRFRAELAELAAASERRAADLASSQSEIHQLRIQAIAKDGEIERLKVEISEVH | 120 |
| | ************************************************************ | |
| 10274 | KSKSQSLELIEQRDAEIREKDGIIQNYHDKIVNLADSSASKGARIQEVEAKFTHLQATCN | 180 |
| 10385 | KSKSQSLELIEQRDAEIREKDGIIQNYHDKIVNLADSSASKGARIQEVEAKFTHLQATCN | 180 |
| 9184 | KSKSQSLELIEQRDAEIREKDGIIQNYHDKIVNLADSSASKGARIQEVEAKFTHLQATCN | 180 |
| 8405 | KSKSQSLELIEQRDAEIREKDGIIQNYHDKIVNLADSSASKGARIQEVEAKFTHLQATCN | 180 |
| 8536 | KSKSQSLELIEQRDAEIREKDGIIQNYHDKIVNLADSSASKGARIQEVEAKFTHLQATCN | 180 |
| 8733 | KSKSQSLELIEQRDAEIREKDGIIQNYHDKIVNLADSSASKGARIQEVEAKFTHLQATCN | 180 |
| 9605 | KSKSQSLELIEQRDAEIREKDGIIQNYHDKIVNLADSSASKGARIQEVEAKFTHLQATCN | 180 |
| 9832 | KSKSQSLELIEQRDAEIREKDGIIQNYHDKIVNLADSSASKGARIQEVEAKFTHLQATCN | 180 |
| | ************************************************************ | |
| 10274 | RITQEKDLLEKHNLWLDEELKEKVKNLAELRKSNMDEEARMSAKVAELERETSESSSSLR | 240 |
| 10385 | RITQEKDLLEKHNLWLDEELKEKVKNLAELRKSNMDEEARMSAKVAELERETSESSSSLR | 240 |
| 9184 | RITQEKDLLEKHNLWLDEELKEKVKNLAELRKSNMDEEARMSAKVAELERETSESSSSLR | 240 |
| 8405 | RITQEKDLLEKHNLWLDEELKEKVKNLAELRKSNMDEEARMSAKVAELERETSESSSSLR | 240 |
| 8536 | RITQEKDLLEKHNLWLDEELKEKVKNLAELRKSNMDEEARMSAKVAELERETSESSSSLR | 240 |
| 8733 | RITQEKDLLEKHNLWLDEELKEKVKNLAELRKSNMDEEARMSAKVAELERETSESSSSLR | 240 |
| 9605 | RITQEKDLLEKHNLWLDEELKEKVKNLAELRKSNMDEEARMSAKVAELERETSESSSSLR | 240 |
| 9832 | RITQEKDLLEKHNLWLDEELKEKVKNLAELRKSNMDEEARMSAKVAELERETSESSSSLR | 240 |
| | ************************************************************ | |
| 10274 | RSKERVSELEQRVSYMEKELCSTKDAAAANEQRLAAELSTVMKLAELHKESSEEWSKKAG | 300 |
| 10385 | RSKERVSELEQRVSYMEKELCSTKDAAAANEQRLAAELSTVMKLAELHKESSEEWSKKAG | 300 |
| 9184 | RSKERVSELEQRVSYMEKELCSTKDAAAANEQRLAAELSTVMKLAELHKESSEEWSKKAG | 300 |
| 8405 | RSKERVSELEQRVSYMEKELCSTKDAAAANEQRLAAELSTVMKLAELHKESSEEWSKKAG | 300 |
| 8536 | RSKERVSELEQRVSYMEKELCSTKDAAAANEQRLAAELSTVMKLAELHKESSEEWSKKAG | 300 |
| 8733 | RSKERVSELEQRVSYMEKELCSTKDAAAANEQRLAAELSTVMKLAELHKESSEEWSKKAG | 300 |
| 9605 | RSKERVSELEQRVSYMEKELCSTKDAAAANEQRLAAELSTVMKLAELHKESSEEWSKKAG | 300 |
| 9832 | RSKKRVSELEQRVSYMEKELCSTKDAAAANEQRLAAELSTVMKLAELHKESSEEWSKKAG | 300 |
| | *.****************************************************** | |
| 10274 | ELEGVIKALETHLTQVEDEYKEKLEKETSAKRDLEMEATYLKQKLEKCESDLENTRKSSE | 360 |
| 10385 | ELEGVIKALETHLTQVEDEYKEKLEKETSAKRDLEMEATYLKQKLEKCESDLENTRKSSE | 360 |
| 9184 | ELEGVIKALETHLTQVEDEYKEKLEKETSAKRDLEMEATYLKQKLEKCESDLENTRKSSE | 360 |
| 8405 | ELEGVIKALETHLTQVEDEYKEKLEKETSAKRDLEMEATYLKQKLEKCESDLENTRKSSE | 360 |
| 8536 | ELEGVIKALETHLTQVEDEYKEKLEKETSAKRDLEMEATYLKQKLEKCESDLENTRKSSE | 360 |
| 8733 | ELEGVIKALETHLTQVEDEYKEKLEKETSAKRDLEMEATYLKQKLEKCESDLENTRKSSE | 360 |
| 9605 | ELEGVIKALETHLTQVEDEYKEKLEKETSAKRDLEMEATYLKQKLEKCESDLENTRKSSE | 360 |
| 9832 | ELEGVIKALETHLTQVEDEYKEKLEKETSAKRDLEMEATYLKQKLEKCESDLENTRKSSE | 360 |
| | ************************************************************ | |

FIG. 16

```
10274    LSFTPLVAADPCDLAGSPMKEMAFSDPANQNDLMIVPKVPTGVSGTALAASLLRDGWSLA    420
10385    LSFTPLVAADPCDLAGSPMKEMAFSDPANQNDLMIVPKVPTGVSGTALAASLLRDGWSLA    420
9184     LSFTPLVAADPCDLAGSPMKEMAFSDPANQNDLMIVPKVPTGVSGTALAASLLRDGWSLA    420
8405     LSFTPLVAADPCDLAGSPMKEMAFSDPANQNDLMIVPKVPTGVSGTALAASLLRDGWSLA    420
8536     LSFTPLVAADPCDLAGSPMKEMAFSDPANQNDLMIVPKVPTGVSGTALAASLLRDGWSLA    420
8733     LSFTPLVAADPCDLAGSPMKEMAFSDPANQNDLMIVPKVPTGVSGTALAASLLRDGWSLA    420
9605     LSFTPLVAADPCDLAGSPMKEMAFSDPANQNDLMIVPKVPTGVSGTALAASLLRDGWSLA    420
9832     LSFTPLVAADPCDLAGSPMKEMAFSDPANQNDLMIVPKVPTGVSGTALAASLLRDGWSLA    420
         ************************************************************

10274    KIYEKYQEATDALRHERFGRRHAEAVLERVLHEIEEKAELILDERAEHRRMVEAYALMDQ    480
10385    KIYEKYQEATDALRHERFGRRHAEAVLERVLHEIEEKAELILDERAEHRRMVEAYALMDQ    480
9184     KIYEKYQEATDALRHERFGRRHAEAVLERVLHEIEEKAELILDERAEHRRMVEAYALMDQ    480
8405     KIYEKYQEATDALRHERFGRRHAEAVLERVLHEIEEKAELILDERAEHRRMVEAYALMDQ    480
8536     KIYEKYQEATDALRHERFGRRHAEAVLERVLHEIEEKAELILDERAEHRRMVEAYALMDQ    480
8733     KIYEKYQEATDALRHERFGRRHAEAVLERVLHEIEEKAELILDERAEHRRMVEAYALMDQ    480
9605     KIYEKYQEATDALRHERFGRRHAEAVLERVLHEIEEKAELILDERAEHRRMVEAYALMDQ    480
9832     KIYEKYQEATDALRHERFGRRHAEAVLERVLHEIEEKAELILDERAEHRRMVEAYALMDQ    480
         ************************************************************

10274    KLQQALLEHDNFENTIRNLKSELKRRERDHSIAQKEIDDLQKQIKLSIYLTFAPTQACIL    540
10385    KLQQALLEHDNFENTIRNLKSELKRRERDHSIAQKEIDDLQKQIKLSIYLTFAPTQACIL    540
9184     KLQQALLEHDNFENTIRNLKSELKRRERDHSIAQKEIDDLQKQIKLSIYLTFAPTQACIL    540
8405     KLQQALLEHDNFENTIRNLKSELKRRERDHSIAQKEIDDLQKQIKLSIYLTFAPTQACIL    540
8536     KLQQALLEHDNFENTIRNLKSELKRRERDHSIAQKEIDDLQKQIKLSIYLTFAPTQACIL    540
8733     KLQQALLEHDNFENTIRNLKSELKRRERDHSIAQKEIDDLQKQIKLSIYLTFAPTQACIL    540
9605     KLQQALLEHDNFENTIRNLKSELKRRERDHSIAQKEIDDLQKQIKLSIYLTFAPTQACIL    540
9832     KLQQALLEHDNFENTIRNLKSELKRRERDHSIAQKEIDDLQKQIKLSIYLTFAPTQACIL    540
         ************************************************************

10274    GVCTSKNYYDINGNHCGAVLKIAVLLKECQDIQLRCGSSLPNVGDGALSTSTSTGVPEVE    600
10385    GVCTSKNYYDINGNHCGAVLKIAVLLKECQDIQLRCGSSLPNVGDGALSTSTSTGVPEVE    600
9184     GVCTSKNYYDINGNHCGAVLKIAVLLKECQDIQLRCGSSLPNVGDGALSTSTSTGVPEVE    600
8405     GVCTSKNYYDINGNHCGAVLKIAVLLKECQDIQLRCGSSLPNVGDGALSTSTSTGVPEVE    600
8536     GVCTSKNYYDINGNHCGAVLKIAVLLKECQDIQLRCGSILPNVGDGALSTSTSTGVPEVE    600
8733     GVCTSKNYYDINGNHCGAVLKIAVLLKECQDIQLRCGSILPNVGDGALSTSTSTGVPEVE    600
9605     GVCTSKNYYDINGNHCGAVLKIAVLLKECQDIQLRCGSILPNVGDGALSTSTSTGVPEVE    600
9832     GVCTSKNYYDINGNHCGAVLKIAVLLKECQDIQLRCGSILPNVGDGALSTSTSTGVPEVE    600
         ************************************** *********************

10274    NNIHEHMTFNDINGLVQQNVQLRNQVHLLSADLDKRDMELRESFQIELKKITDDAASRVE    660
10385    NNIHEHMTFNDINGLVQQNVQLRNQVHLLSADLDKRDMELRESFQIELKKITDDAASRVE    660
9184     NNIHEHMTFNDINGLVQQNVQLRNQVHLLSADLDKRDMELRESFQIELKKITDDAASRVE    660
8405     NNIHEHMTFNDINGLVQQNVQLRNQVHLLSADLDKRDMELRESFQIELKKITDDAASRVE    660
8536     NNIHEHMTFNDINGLVQQNVQLRNQVHLLSADLDKRDMELRESFQIELKKITDDAASRVE    660
8733     NNIHEHMTFNDINGLVQQNVQLRNQVHLLSADLDKRDMELRESFQIELKKITDDAASRVE    660
9605     NNIHEHMTFNDINGLVQQNVQLRNQVHLLSADLDKRDMELRESFQIELKKITDDAASRVE    660
9832     NNIHEHMTFNDINGLVQQNVQLRNQVHLLSADLDKRDMELRESFQIELKKITDDAASRVE    660
         ************************************************************ snp_02_31026954(G>C):Glu>Gln
10274    KVMKKSEEQAIMIESLHRSVAMYRKLCQEQQKSRSNVEHIPKNLEDDGRKDLMVLFEGSQ    720
10385    KVMKKSEEQAIMIESLHRSVAMYRKLCQEQQKSRSNVEHIPKNLEDDGRKDLMVLFEGSQ    720
9184     KVMKKSEEQAIMIESLHRSVAMYRKLCQEQQKSRSNVEHIPKNLEDDGRKDLMVLFEGSQ    720
8405     KVMKKSEEQAIMIESLHRSVAMYRKLCQEQQKSRSNVEHIPKNLEDDGRKDLMVLFEGSQ    720
8536     KVMKKSEEQAIMIESLHRSVAMYRKLCEEQQKSRSNVEHIPKNLEDDGRKDLMVLFEGSQ    720
8733     KVMKKSEEQAIMIESLHRSVAMYRKLCEEQQKSRSNVEHIPKNLEDDGRKDLMVLFEGSQ    720
9605     KVMKKSEEQAIMIESLHRSVAMYRKLCEEQQKSRSNVEHIPKNLEDDGRKDLMVLFEGSQ    720
9832     KVMKKSEEQAIMIESLHRSVAMYRKLCEEQQKSRSNVEHIPKNLEDDGRKDLMVLFEGSQ    720
         **************************:*********************************
```

FIG. 16 Continued 1

```
                                                                           snp_02_31024549(G>A):Glu>Lys
10274    EVSRKAYEQVSERAKSLDEELTKLRTELLSLRSERDKAVLEAEFARERLNGFTAELEHQR 780
10385    EVSRKAYEQVSERAKSLDEELTKLRTELLSLRSERDKAVLEAEFARERLNGFTAELEHQR 780
9184     EVSRKAYEQVSERAKSLDEELTKLRTELLSLRSERDKAVLEAEFARERLNGFTAELEHQR 780
8405     EVSRKAYEQVSERAKSLDEELTKLRTELLSLRSERDKAVLEAEFARERLNGFTAELEHQR 780
8536     EVSRKAYEQVSERAKSLDEELTKLRTELLSLRSERDKAVLEAEFARERLNGFTAELEHQR 780
8733     EVSRKAYEQVSERAKSLDEELTKLRTELLSLRSERDKAVLEAEFARERLNGFTAELEHQR 780
9605     EVSRKAYEQVSERAKSLDEELTKLRTELLSLRSERDKAVLEAEFARERLNGFTAELEHQR 780
9832     EVSRKAYEQVSERAKSLDEELTKLRTELLSLRSERDKAVLEAEFARERLNGFTAELEHQR 780
         ************************************************************

10274    KEANSISLRNAELMHLVVDYEKRLRENSESMKAVEENSRKLLMEMSILKNEKEILAKSEK 840
10385    KEANSISLRNAELMHLVVDYEKRLRENSESMKAVEENSRKLLMEMSILKNEKEILAKSEK 840
9184     KEANSISLRNAELMHLVVDYEKRLRENSESMKAVEENSRKLLMEMSILKNEKEILAKSEK 840
8405     KEANSISLRNAELMHLVVDYEKRLRENSESMKAVEENSRKLLMEMSILKNEKEILAKSEK 840
8536     KEANSISLRNAELMHLVVDYEKRLRENSESMKAVEENSRKLLMKMSILKNEKEILAKSEK 840
8733     KEANSISLRNAELMHLVVDYEKRLRENSESMKAVEENSRKLLMKMSILKNEKEILAKSEK 840
9605     KEANSISLRNAELMHLVVDYEKRLRENSESMKAVEENSRKLLMKMSILKNEKEILAKSEK 840
9832     KEANSISLRNAELMHLVVDYEKRLRENSESMKAVEENSRKLLMKMSILKNEKEILAKSEK 840
         *******************************************.****************

10274    KALEEVHDLTTRVHRLQATIDTIHATEEVQENARSIERRNQEEYIKRLERDWAEVKKELQ 900
10385    KALEEVHDLTTRVHRLQATIDTIHATEEVQENARSIERRNQEEYIKRLERDWAEVKKELQ 900
9184     KALEEVHDLTTRVHRLQATIDTIHATEEVQENARSIERRNQEEYIKRLERDWAEVKKELQ 900
8405     KALEEVHDLTTRVHRLQATIDTIHATEEVQENARSIERRNQEEYIKRLERDWAEVKKELQ 900
8536     KALEEVHDLTTRVHRLQATIDTIHATEEVQENARSIERRNQEEYIKRLERDWAEVKKELQ 900
8733     KALEEVHDLTTRVHRLQATIDTIHATEEVQENARSIERRNQEEYIKRLERDWAEVKKELQ 900
9605     KALEEVHDLTTRVHRLQATIDTIHATEEVQENARSIERRNQEEYIKRLERDWAEVKKELQ 900
9832     KALEEVHDLTTRVHRLQATIDTIHATEEVQENARSIERRNQEEYIKRLERDWAEVKKELQ 900
         ************************************************************ snp_02_31023080(T>A):Leu>Met
10274    EQRDHVRVLTLDKKNAFDGCLKQVEDMRKELQNSWKAATDAESRAAVAEAKCSDMETKLK 960
10385    EQRDHVRVLTLDKKNAFDGCLKQVEDMRKELQNSWKAATDAESRAAVAEAKCSDMETKLK 960
9184     EQRDHVRVLTLDKKNAFDGCLKQVEDMRKELQNSWKAATDAESRAAVAEAKCSDMETKLK 960
8405     EQRDHVRVLTLDKKNAFDGCLKQVEDMRKELQNSWKAATDAESRAAVAEAKCSDMETKLK 960
8536     EQRDHVRVLTLDKKNAFDGCLKQVEDMRKELQNSWKAATDAESRAAVAEAKCSDLETKLK 960
8733     EQRDHVRVLTLDKKNAFDGCLKQVEDMRKELQNSWKAATDAESRAAVAEAKCSDLETKLK 960
9605     EQRDHVRVLTLDKKNAFDGCLKQVEDMRKELQNSWKAATDAESRAAVAEAKCSDLETKLK 960
9832     EQRDHVRVLTLDKKNAFDGCLKQVEDMRKELQNSWKAATDAESRAAVAEAKCSDLETKLK 960
         *****************************************************.*****

10274    SRKENDELFQLKEELEKYKEEAQANKSYMLQYKEIANSNESALKQMESALQDFKTESETI 1020
10385    SRKENDELFQLKEELEKYKEEAQANKSYMLQYKEIANSNESALKQMESALQDFKTESETI 1020
9184     SRKENDELFQLKEELEKYKEEAQANKSYMLQYKEIANSNESALKQMESALQDFKTESETI 1020
8405     SRKENDELFQLKEELEKYKEEAQANKSYMLQYKEIANSNESALKQMESALQDFKTESETI 1020
8536     SRKENDELFQLKEELEKYKEEAQANKSYMLQYKEIANSNESALKQMESALQDFKTESETI 1020
8733     SRKENDELFQLKEELEKYKEEAQANKSYMLQYKEIANSNESALKQMESALQDFKTESETI 1020
9605     SRKENDELFQLKEELEKYKEEAQANKSYMLQYKEIANSNESALKQMESALQDFKTESETI 1020
9832     SRKENDELFQLKEELEKYKEEAQANKSYMLQYKEIANSNESALKQMESALQDFKTESETI 1020
         ************************************************************

10274    KKSLEDEITKLRTKISELEKCYIMKCEEAASAIEAKEKDTTSLMKEISVLRNEVSEKVIQ 1080
10385    KKSLEDEITKLRTKISELEKCYIMKCEEAASAIEAKEKDTTSLMKEISVLRNEVSEKVIQ 1080
9184     KKSLEDEITKLRTKISELEKCYIMKCEEAASAIEAKEKDTTSLMKEISVLRNEVSEKVIQ 1080
8405     KKSLEDEITKLRTKISELEKCYIMKCEEAASAIEAKEKDTTSLMKEISVLRNEVSEKVIQ 1080
8536     KKSLEDEITKLRTKISELEKCYIMKCEEAASAIEAKEKDTTSLMKEISVLRNEVSEKVIQ 1080
8733     KKSLEDEITKLRTKISELEKCYIMKCEEAASAIEAKEKDTTSLMKEISVLRNEVSEKVIQ 1080
9605     KKSLEDEITKLRTKISELEKCYIMKCEEAASAIEAKEKDTTSLMKEISVLRNEVSEKVIQ 1080
9832     KKSLEDEITKLRTKISELEKCYIMKCEEAASAIEAKEKDTTSLMKEISVLRNEVSEKVIQ 1080
         ************************************************************
```

FIG. 16 Continued 2

```
10274    IEKLETELASSKRALDEQYKRWRSAQDNYERQVILQSETIQELTSASKELSSLQQEIIVL 1140
10385    IEKLETELASSKRALDEQYKRWRSAQDNYERQVILQSETIQELTSASKELSSLQQEIIVL 1140
9184     IEKLETELASSKRALDEQYKRWRSAQDNYERQVILQSETIQELTSASKELSSLQQEIIVL 1140
8405     IEKLETELASSKRALDEQYKRWRSAQDNYERQVILQSETIQELTSASKELSSLQQEIIVL 1140
8536     IEKLETELASSKRALDEQYKRWRSAQDNYERQVILQSETIQELTSASKELSSLQQEIIVL 1140
8733     IEKLETELASSKRALDEQYKRWRSAQDNYERQVILQSETIQELTSASKELSSLQQEIIVL 1140
9605     IEKLETELASSKRALDEQYKRWRSAQDNYERQVILQSETIQELTSASKELSSLQQEIIVL 1140
9832     IEKLETELASSKRALDEQYKRWRSAQDNYERQVILQSETIQELTSASKELSSLQQEIIVL 1140
         ************************************************************ snp_02_31019010(A>C):Gln>His
10274    RQTVETQKAENDGLRTLGEQEKIELVKGKDEALQKYNELNDQNKILHNQLEALHIRLAEK 1200
10385    RQTVETQKAENDGLRTLGEQEKIELVKGKDEALQKYNELNDQNKILHNQLEALHIRLAEK 1200
9184     RQTVETQKAENDGLRTLGEQEKIELVKGKDEALQKYNELNDQNKILHNQLEALHIRLAEK 1200
8405     RQTVETQKAENDGLRTLGEQEKIELVKGKDEALQKYNELNDQNKILHNQLEALHIRLAEK 1200
8536     RQTVETQKAENDGLRTLGEHEKIELVKGKDEALQKYNELNDQNKILHNQLEALHIRLAEK 1200
8733     RQTVETQKAENDGLRTLGEHEKIELVKGKDEALQKYNELNDQNKILHNQLEALHIRLAEK 1200
9605     RQTVETQKAENDGLRTLGEHEKIELVKGKDEALQKYNELNDQNKILHNQLEALHIRLAEK 1200
9832     RQTVETQKAENDGLRTLGEHEKIELVKGKDEALQKYNELNDQNKILHNQLEALHIRLAEK 1200
         *******************:****************************************

10274    ERNIAGLSSQRIDSHGEDDLHSVIGYLRRSKEILESALKSTKEAQDLLRSQTDSARTSML 1260
10385    ERNIAGLSSQRIDSHGEDDLHSVIGYLRRSKEILESALKSTKEAQDLLRSQTDSARTSML 1260
9184     ERNIAGLSSQRIDSHGEDDLHSVIGYLRRSKEILESALKSTKEAQDLLRSQTDSARTSML 1260
8405     ERNIAGLSSQRIDSHGEDDLHSVIGYLRRSKEILESALKSTKEAQDLLRSQTDSARTSML 1260
8536     ERNIAGLSSQRIDSHGEDDLHSVIGYLRRSKEILESALKSTKEAQDLLRSQTDSARTSML 1260
8733     ERNIAGLSSQRIDSHGEDDLHSVIGYLRRSKEILESALKSTKEAQDLLRSQTDSARTSML 1260
9605     ERNIAGLSSQRIDSHGEDDLHSVIGYLRRSKEILESALKSTKEAQDLLRSQTDSARTSML 1260
9832     ERNIAGLSSQRIDSHGEDDLHSVIGYLRRSKEILESALKSTKEAQDLLRSQTDSARTSML 1260
         ************************************************************

10274    KDEEFKSLQFQVRELNLLRESNIQLREENKHNFEECQKFHDEAQKAKMEAERLHNLLLEK 1320
10385    KDEEFKSLQFQVRELNLLRESNIQLREENKHNFEECQKFHDEAQKAKMEAERLHNLLLEK 1320
9184     KDEEFKSLQFQVRELNLLRESNIQLREENKHNFEECQKFHDEAQKAKMEAERLHNLLLEK 1320
8405     KDEEFKSLQFQVRELNLLRESNIQLREENKHNFEECQKFHDEAQKAKMEAERLHNLLLEK 1320
8536     KDEEFKSLQFQVRELNLLRESNIQLREENKHNFEECQKFHDEAQKAKMEAERLHNLLLEK 1320
8733     KDEEFKSLQFQVRELNLLRESNIQLREENKHNFEECQKFHDEAQKAKMEAERLHNLLLEK 1320
9605     KDEEFKSLQFQVRELNLLRESNIQLREENKHNFEECQKFHDEAQKAKMEAERLHNLLLEK 1320
9832     KDEEFKSLQFQVRELNLLRESNIQLREENKHNFEECQKFHDEAQKAKMEAERLHNLLLEK 1320
         ************************************************************

10274    QVDAEICKKEIEMQKTEIANLNQKISELVENSRGVDLSTYETMKDELQNIKATLRENSAE 1380
10385    QVDAEICKKEIEMQKTEIANLNQKISELVENSRGVDLSTYETMKDELQNIKATLRENSAE 1380
9184     QVDAEICKKEIEMQKTEIANLNQKISELVENSRGVDLSTYETMKDELQNIKATLRENSAE 1380
8405     QVDAEICKKEIEMQKTEIANLNQKISELVENSRGVDLSTYETMKDELQNIKATLRENSAE 1380
8536     QVDAEICKKEIEMQKTEIANLNQKISELVENSRGVDLSTYETMKDELQNIKATLRENSAE 1380
8733     QVDAEICKKEIEMQKTEIANLNQKISELVENSRGVDLSTYETMKDELQNIKATLRENSAE 1380
9605     QVDAEICKKEIEMQKTEIANLNQKISELVENSRGVDLSTYETMKDELQNIKATLRENSAE 1380
9832     QVDAEICKKEIEMQKTEIANLNQKISELVENSRGVDLSTYETMKDELQNIKATLRENSAE 1380
         ************************************************************ snp_02_31013745(T>C):Val>Ala
10274    LERTKKLLSEKDSVIRNLEEKLAGCLSELDAREKKLNDVEASLKSEIDRHRKININIKRK 1440
10385    LERTKKLLSEKDSVIRNLEEKLAGCLSELDAREKKLNDVEASLKSEIDRHRKININIKRK 1440
9184     LERTKKLLSEKDSVIRNLEEKLAGCLSELDAREKKLNDVEASLKSEIDRHRKININIKRK 1440
8405     LERTKKLLSEKDSVIRNLEEKLAGCLSELDAREKKLNDVEASLKSEIDRHRKININIKRK 1440
8536     LERTKKLLSEKDSVIRNLEEKLAGCLSELDAREKKLNDAEASLKSEIDRHRKININIKRK 1440
8733     LERTKKLLSEKDSVIRNLEEKLAGCLSELDAREKKLNDAEASLKSEIDRHRKININIKRK 1440
9605     LERTKKLLSEKDSVIRNLEEKLAGCLSELDAREKKLNDAEASLKSEIDRHRKININIKRK 1440
9832     LERTKKLLSEKDSVIRNLEEKLAGCLSELDAREKKLNDAEASLKSEIDRHRKININIKRK 1440
         *************************************,**********************
```

FIG. 16 Continued 3

```
10274    LDASAKEKEELTKEKQSLSKQLEDLKSSQKTTTENSNEQAIKEKDFRIQTLEKVLEKERD 1500
10385    LDASAKEKEELTKEKQSLSKQLEDLKSSQKTTTENSNEQAIKEKDFRIQTLEKVLEKERD 1500
9184     LDASAKEKEELTKEKQSLSKQLEDLKSSQKTTTENSNEQAIKEKDFRIQTLEKVLEKERD 1500
8405     LDASAKEKEELTKEKQSLSKQLEDLKSSQKTTTENSNEQAIKEKDFRIQTLEKVLEKERD 1500
8536     LDASAKEKEELTKEKQSLSKQLEDLKSSQKTTTENSNEQAIKEKDFRIQTLEKVLEKERD 1500
8733     LDASAKEKEELTKEKQSLSKQLEDLKSSQKTTTENSNEQAIKEKDFRIQTLEKVLEKERD 1500
9605     LDASAKEKEELTKEKQSLSKQLEDLKSSQKTTTENSNEQAIKEKDFRIQTLEKVLEKERD 1500
9832     LDASAKEKEELTKEKQSLSKQLEDLKSSQKTTTENSNEQAIKEKDFRIQTLEKVLEKERD 1500
         ************************************************************

10274    DNKKEKAFRRRNEKVFTTAIQNMNQERKQVEESIEKHRQAVKEVIEHYTGISSQIPSGSA 1560
10385    DNKKEKAFRRRNEKVFTTAIQNMNQERKQVEESIEKHRQAVKEVIEHYTGISSQIPSGSA 1560
9184     DNKKEKAFRRRNEKVFTTAIQNMNQERKQVEESIEKHRQAVKEVIEHYTGISSQIPSGSA 1560
8405     DNKKEKAFRRRNEKVFTTAIQNMNQERKQVEESIEKHRQAVKEVIEHYTGISSQIPSGSA 1560
8536     DNKKEKAFRRRNEKVFTTAIQNMNQERKQVEESIEKHRQAVKEVIEHYTGISSQIPSGSA 1560
8733     DNKKEKAFRRRNEKVFTTAIQNMNQERKQVEESIEKHRQAVKEVIEHYTGISSQIPSGSA 1560
9605     DNKKEKAFRRRNEKVFTTAIQNMNQERKQVEESIEKHRQAVKEVIEHYTGISSQIPSGSA 1560
9832     DNKKEKAFRRRNEKVFTTAIQNMNQERKQVEESIEKHRQAVKEVIEHYTGISSQIPSGSA 1560
         ************************************************************

10274    IDEQLRSYFLAIKAVEESPSPFQDGAASQTPSVESADVDASAATAGRQVATPPRPAQVKV 1620
10385    IDEQLRSYFLAIKAVEESPSPFQDGAASQTPSVESADVDASAATAGRQVATPPRPAQVKV 1620
9184     IDEQLRSYFLAIKAVEESPSPFQDGAASQTPSVESADVDASAATAGRQVATPPRPAQVKV 1620
8405     IDEQLRSYFLAIKAVEESPSPFQDGAASQTPSVESADVDASAATAGRQVATPPRPAQVKV 1620
8536     IDEQLRSYFLAIKAVEESPSPFQDGAASQTPSVESADVDASAATAGRQVATPPRPAQVKV 1620
8733     IDEQLRSYFLAIKAVEESPSPFQDGAASQTPSVESADVDASAATAGRQVATPPRPAQVKV 1620
9605     IDEQLRSYFLAIKAVEESPSPFQDGAASQTPSVESADVDASAATAGRQVATPPRPAQVKV 1620
9832     IDEQLRSYFLAIKAVEESPSPFQDGAASQTPSVESADVDASAATAGRQVATPPRPAQVKV 1620
         ************************************************************

10274    VEERAVSTLPKPSTEVRRPGGRRPLVRPSLERVEEPQADIDTTVVEGSTEKGGLLMERET 1680
10385    VEERAVSTLPKPSTEVRRPGGRRPLVRPSLERVEEPQADIDTTVVEGSTEKGGLLMERET 1680
9184     VEERAVSTLPKPSTEVRRPGGRRPLVRPSLERVEEPQADIDTTVVEGSTEKGGLLMERET 1680
8405     VEERAVSTLPKPSTEVRRPGGRRPLVRPSLERVEEPQADIDTTVVEGSTEKGGLLMERET 1680
8536     VEERAVSTLPKPSTEVRRPGGRRPLVRPSLERVEEPQADIDTTVVEGSTEKGGLLMERET 1680
8733     VEERAVSTLPKPSTEVRRPGGRRPLVRPSLERVEEPQADIDTTVVEGSTEKGGLLMERET 1680
9605     VEERAVSTLPKPSTEVRRPGGRRPLVRPSLERVEEPQADIDTTVVEGSTEKGGLLMERET 1680
9832     VEERAVSTLPKPSTEVRRPGGRRPLVRPSLERVEEPQADIDTTVVEGSTEKGGLLMERET 1680
         ************************************************************

10274    PGGVSALQPSSRKRLIPSPQMRDDASQGETTDANPPLKKPKEGSSQGTSELKTEQSPHED 1740
10385    PGGVSALQPSSRKRLIPSPQMRDDASQGETTDANPPLKKPKEGSSQGTSELKTEQSPHED 1740
9184     PGGVSALQPSSRKRLIPSPQMRDDASQGETTDANPPLKKPKEGSSQGTSELKTEQSPHED 1740
8405     PGGVSALQPSSRKRLIPSPQMRDDASQGETTDANPPLKKPKEGSSQGTSELKTEQSPHED 1740
8536     PGGVSALQPSSRKRLIPSPQMRDDASQGETTDANPPLKKPKEGSSQGTSELKTEQSPHED 1740
8733     PGGVSALQPSSRKRLIPSPQMRDDASQGETTDANPPLKKPKEGSSQGTSELKTEQSPHED 1740
9605     PGGVSALQPSSRKRLIPSPQMRDDASQGETTDANPPLKKPKEGSSQGTSELKTEQSPHED 1740
9832     PGGVSALQPSSRKRLIPSPQMRDDASQGETTDANPPLKKPKEGSSQGTSELKTEQSPHED 1740
         ************************************************************ snp_02_31010249(A>T):Met>Leu
10274    VMAPVPVLPSTELDEQQPGEEMDTDQSSLPVEEVEETREDDLGDKDDMETHMDASMDIQG 1800
10385    VMAPVPVLPSTELDEQQPGEEMDTDQSSLPVEEVEETREDDLGDKDDMETHMDASMDIQG 1800
9184     VMAPVPVLPSTELDEQQPGEEMDTDQSSLPVEEVEETREDDLGDKDDMETHMDASMDIQG 1800
8405     VMAPVPVLPSTELDEQQPGEEMDTDQSSLPVEEVEETREDDLGDKDDMETHMDASMDIQG 1800
8536     VMAPVPVLPSTELDEQQPGEEMDTDQSSLPVEEVEETREDDLGDKDDMETHMDASLDIQG 1800
8733     VMAPVPVLPSTELDEQQPGEEMDTDQSSLPVEEVEETREDDLGDKDDMETHMDASLDIQG 1800
9605     VMAPVPVLPSTELDEQQPGEEMDTDQSSLPVEEVEETREDDLGDKDDMETHMDASLDIQG 1800
9832     VMAPVPVLPSTELDEQQPGEEMDTDQSSLPVEEVEETREDDLGDKDDMETHMDASLDIQG 1800
         *********************************************************:****
```

FIG. 16 Continued 4

```
10274       QDAETGIDNDATTVEDVPVKSEAVMESLEEDLKTEDGKEEGQFTATTDVEDEREEGELPD  1860
10385       QDAETGIDNDATTVEDVPVKSEAVMESLEEDLKTEDGKEEGQFTATTDVEDEREEGELPD  1860
9184        QDAETGIDNDATTVEDVPVKSEAVMESLEEDLKTEDGKEEGQFTATTDVEDEREEGELPD  1860
8405        QDAETGIDNDATTVEDVPVKSEAVMESLEEDLKTEDGKEEGQFTATTDVEDEREEGELPD  1860
8536        QDAETGIDNDATTVEDVPVKSEAVMESLEEDLKTEDGKEEGQFTATTDVEDEREEGELPD  1860
8733        QDAETGIDNDATTVEDVPVKSEAVMESLEEDLKTEDGKEEGQFTATTDVEDEREEGELPD  1860
9605        QDAETGIDNDATTVEDVPVKSEAVMESLEEDLKTEDGKEEGQFTATTDVEDEREEGELPD  1860
9832        QDAETGIDNDATTVEDVPVKSEAVMESLEEDLKTEDGKEEGQFTATTDVEDEREEGELPD  1860
            ************************************************************

10274       EPEQPDSTPPVLDVGEQAGDSFRAASPAGPTEKSDVDMPEETGEGDGTMESDQSPVPQSG  1920
10385       EPEQPDSTPPVLDVGEQAGDSFRAASPAGPTEKSDVDMPEETGEGDGTMESDQSPVPQSG  1920
9184        EPEQPDSTPPVLDVGEQAGDSFRAASPAGPTEKSDVDMPEETGEGDGTMESDQSPVPQSG  1920
8405        EPEQPDSTPPVLDVGEQAGDSFRAASPAGPTEKSDVDMPEETGEGDGTMESDQSPVPQSG  1920
8536        EPEQPDSTPPVLDVGEQAGDSFRAASPAGPTEKSDVDMPEETGEGDGTMESDQSPVPQSG  1920
8733        EPEQPDSTPPVLDVGEQAGDSFRAASPAGPTEKSDVDMPEETGEGDGTMESDQSPVPQSG  1920
9605        EPEQPDSTPPVLDVGEQAGDSFRAASPAGPTEKSDVDMPEETGEGDGTMESDQSPVPQSG  1920
9832        EPEQPDSTPPVLDVGEQAGDSFRAASPAGPTEKSDVDMPEETGEGDGTMESDQSPVPQSG  1920
            ************************************************************

10274       GADASPSQMADASPSPAREPSPNPVQAGAPPEQQNPTPPNPVQAGASSEQQNPATAAEGV  1980
10385       GADASPSQMADASPSPAREPSPNPVQAGAPPEQQNPTPPNPVQAGASSEQQNPATAAEGV  1980
9184        GADASPSQMADASPSPAREPSPNPVQAGAPPEQQNPTPPNPVQAGASSEQQNPATAAEGV  1980
8405        GADASPSQMADASPSPAREPSPNPVQAGAPPEQQNPTPPNPVQAGASSEQQNPATAAEGV  1980
8536        GADASPSQMADASPSPAREPSPNPVQAGAPPEQQNPTPPNPVQAGASSEQQNPATAAEGV  1980
8733        GADASPSQMADASPSPAREPSPNPVQAGAPPEQQNPTPPNPVQAGASSEQQNPATAAEGV  1980
9605        GADASPSQMADASPSPAREPSPNPVQAGAPPEQQNPTPPNPVQAGASSEQQNPATAAEGV  1980
9832        GADASPSQMADASPSPAREPSPNPVQAGAPPEQQNPTPPNPVQAGASSEQQNPATAAEGV  1980
            ************************************************************

10274       ETRSTRTINLTERARQNRQARILRSATQQNARGRGNQSLTYRKDGGRGTRGRGGRGQS    2038
10385       ETRSTRTINLTERARQNRQARILRSATQQNARGRGNQSLTYRKDGGRGTRGRGGRGQS    2038
9184        ETRSTRTINLTERARQNRQARILRSATQQNARGRGNQSLTYRKDGGRGTRGRGGRGQS    2038
8405        ETRSTRTINLTERARQNRQARILRSATQQNARGRGNQSLTYRKDGGRGTRGRGGRGQS    2038
8536        ETRSTRTINLTERARQNRQARILRSATQQNARGRGNQSLTYRKDGGRGTRGRGGRGQS    2038
8733        ETRSTRTINLTERARQNRQARILRSATQQNARGRGNQSLTYRKDGGRGTRGRGGRGQS    2038
9605        ETRSTRTINLTERARQNRQARILRSATQQNARGRGNQSLTYRKDGGRGTRGRGGRGQS    2038
9832        ETRSTRTINLTERARQNRQARILRSATQQNARGRGNQSLTYRKDGGRGTRGRGGRGQS    2038
            *********************************************************

Legend:
Amino acid substitution
TPR domain

Samples:
10274 : IRIS_313-10274  (LUSRB)
10385 : IRIS_313-10385  (LUSRB)
9184  : IRIS_313-9184   (LUSRB)
8405  : IRIS_313-8405   (LUSRB)
8536  : IRIS_313-8536   (HUSRB)
8733  : IRIS_313-8733   (HUSRB)
9605  : IRIS_313-9605   (HUSRB)
9832  : IRIS_313-9832   (HUSRB)
```

FIG. 16 Continued 5

>OsTPR
ATGCCTGAAAAAGGGGTAAAATTGTGGTTTCCTCAAGATTGGATGTGGGTGTAGGGATG
GTGCACGAATGTAGACAGATGTGAGATTTGTGATTGCTTCCAGCACTGCTTTGAAATATC
TATGTATTGTATCTGGACTATGCTGAAACCAATCTTGAAGTGTTTCATTGGTTGCATTTT
TTGCCACTGTATATAAGAATATAGCAATATGCTCTTCTACTGAAACATATAGTGCCAGTT
AGGTACTCTTTCTCACGTAACTTATTGACTAGTGCATGAAAAATGTCGACCTCCATACGG
AAGTTTCTTTTGCATAATCTTTCATGTCCTGTTAAAATCTCATGTACACGGCAACCCCCT
GTAAGTTTTGACGTGTGCATTGGTCTCCTAATACAAGATGATTGTGATGAATCTCCTAAA
GTAGGCAGAACAAAATGAATGAACTCATCATCACTTTCTGATATACGTCGGTAGCTTGGA
TTCATGGTGTGCAGATGTTACCAAACTGATGCTGTAAACTCAAATAGAAGAGAGCTAAAA
ATCAAGACTTTTGCTGAGGAAAAAACAATTTTGGTGCACCAGATGAACAAGTAGTACCTT
GTTGTTACACGAGCAAGTAACGTCCAGCTATGGTGGCTAGACGATGAGTAAAGCTTCTGG
AAAAATTATGCAGATAGTGAAGAGAAGAGCAAAGGATCAGCAAGCTTCTTCCACAGTTGA
TGAGCAAATAGAAGAACAGGGGAAAATGGTGCACAAGGCTAACGAGGGCTATTTATGCA
CTTCAAAGCTAACGGCTAGTTGAGGGCCGATGTCAGTTGATGCAAACTTAAAAAAATATA
TTTCAAACGGCAGATTTCCTACACTTCTCCTGCGGTATATCCGAATGCACACTTTTTTTA
AATTCCTGACGTTTAGCTTCCCATAGGATTGGACTCCACAGCTATCCCTATTCCTTCATT
TTTCCTAATCCTATGAGTGAAAAAATCCTTTAAAACGAGTAAGCCCTTACTGTGACGATC
AGTATTTATCGGGAACGGGGTCTTTCCTTTTCTTTTGGAGGCTTTAACTTCTTCCAGCAT
           snp_2_31035009
TTTGACCGTTCCGTACCAACTACCAAGTGAGCTTCTGATGGTTTTGTCTAAGAAAACCAT
GATTTGGCGATGGCAGCCTTTATTGAAAGACATACCAAGCGCTGGGTGGTCACATCTCAG
GGCTTGTTTGGTAGAACTCTAACTTATAAATTTAGCTTCAAGAGTTGGGTCTGGAGTGAA
GTTGTGGAGCTGTCTAAACCCAGCTTTACCTTTCTAGTTCATTTTATGAGAGAACACTAG
CTCCGCTCCCATTTCAGGTGGAGCTGAAACGGTTTGGTTGAGCTCCAGCTCCGGGAGAGG
TGGAGTTGGAGCTGGAGCTGTGACAAACAGGCCCTCAGTTCCTAGATTTGCATTGACGCT
CCAACGGGAATATTCGTGCACAAGTAATCGAGTTTTGTATATTTACCGACGAATGGAATA
CGCATATTTTTTTTCTTTACTTGAACTCCCGTGCAGTGCACTGGAGATGACATCATTAG
AGCATCACCAAGAGATTACATATAACCTCTAAAAATTTGTTTTTTTTCATAAACTCAAA
ATAGGAAACAAAATAAGTAATATCTTAAAGAAAAACCTAAATTTTATTAAAAAAAATATA
AAAGTGAGACCTTATTAAACTACCAAAAGAATTTCCATTTTACTTCGTCAGCGCACACTA
TCTCCTGGCGCTCCCCTGAAGCCGCGCCAGGAGAGGAGGAAGGTGGGAGCAGCTAGATTG
GAAGTGGGCAAGGAAGCCGCTTTCTCCCGTATATCAACAGAGCAAATATTTCGGGAAAGA
GAACTCCAAAAATCATGCAACTGAGTAAGGGACTCGTTTGAGTGCTTTCTTTCACTAAAA
TCCCTCAAAATTGATTTTGAGATGAAATAGGGATAAAATAGAAGGACTGTTGGTGATGCT
TATTTATTCTCCTGTTTTATAGGGTTTTAACGAATTGAGATCAAATACAGTAGCTATTAG
GACTGCACACAATCTGAGCCCTCTATGTCTAAATCTAACGGCCAAAAAGGATTTGGCACA
GTACAATTAGAACAGTACCCTTCCACAGTAAAATGCTACAGTGTTTTCTACAGTCTCAGA
TGTATCTCGGACGTCCATTTTAATCATGCGATGCTAGTGTGACTGCTTATCTTGCATCA
CACTAGCTACTGCACCTGAATCGGGTCCGGTTTAAACATGTGAAACTCGGAAACGGCTTT
TTAGACGAAGACAGCCCACAAACTCATAGGCCTACACGCCACAGCCCGAGAAACAGAAGC
CCAGCAATCCGGCCCAAACAAGTCACTCAGCAGTCAGCAGGTCTCACAGGCCCACCAGAT
AGTCCATGGGCCTTGGGCCGAGCCTATCCGACCGCCTTCACGCGTCCTTCCTTCCGACCT
ATATTTCTGCCTCGCCCTCCTCTCGCCCCTTCCCCTTCGCGTTTGCGTTTCCTCCGCCTC
CTCACTCCAATTCCATTCGCCTTCCGCCACCACCACCCTTGGCTCCTCCCCTCCCCGCGG
GGCGCGCGACAAACCCTAGAACCTTCAGAGGCTAGAGCGGTAGAGCCATCCGCGAGGGC
                                   CDS Start
CCCGGGCGGGCTAGGGGCGCCGCCTACCCGACCCCGCACGCGGCGGCGATGCCGCTCTTC
ATGTCGGAGGAGGAGCTGCGGCTCTTGGGCGGTGACGTGGCCGCCGTCGCCGAGCGGGCC
GACGCCGCCATCCGCGAGCTCCGGCAGCAGGTGGACACCGTCCGTGCCGAGGCCGACGCG
GCGGCCATCGCGGCGGAGCAGACGTGCGCCCTCCTCGAGCAGCGCTACGACACTCTCTCC
GCCGAGGCCGATCGCTTCCGGGCCGAGCTAGCCGAGCTCGCGGCTGCCTCCGAGCGCCGC

FIG. 17

```
GCCGCCGATCTCGCCTCTTCCCAGTCCGAGATACACCAGCTCCGCATCCAAGCCGTACGA
ACCCTAGTTTTTATTTGGGTTCAGCTCAGTTTTTCGGCTTAGCTGAGGTCACACTGATCA
CTCTGTGCTGCTGATGGGGTTTGCAGATTGCGAAGGATGGCGAGATTGAACGGCTGAAAG
TAGAAATCTCGGAGGTGCACAAGTCCAAGTCGCAGTCACTGGAACTAATTGAGCAGAGGG
ATGCAGAGATAAGGGAGAAGGATGGCATCATCCAGAACTACCTCGATAAAATAGTAAGCC
ATCCTGACCATTTTGTACTCCCACTTCTAGTGATGCACAGCATCCAGCAAAATTGGAACT
CCATATCTAAGGTGATGTGCGAATATAGGATCATATGGATAAGTTGTTATCCAGTGCAAT
GCCTAGGTTGCTACTGTCGACAAACAGAGGACGGGGGTTTTATGATGTTCTAAGACTTGA
AGTAGCTTTCCTTTTAACCCTAGTCAGAGGGTAGGTCAGTTGCTTGATAGGTTTTACAAC
AGAAATTTTGTGGCTTCAATAGGCCACAAAATTTGTTTTCCTCATTTTGCATGTTACTTG
GCAGAAGTTGAGTTGCATGTGTATGAGACACAACTGCATTTTGTATGAGTTGTTACCCGA
ACGTCAGACATGATTTTAACTCGATTTACCTGTAGTTTTACGTCTGTCTCCATACTTTTT
TATTTTACATGTAGTAGCAAGTTGAATTTTTATTTTATTTATGCATCAGAGGTCATCCTT
ATCGGATACTTCAAATGAAAAATACACATTTAAATTATTTTCGTAATATCAGTTACTGG
CATTCTATTTCAGTTCTTTGGGCATTGCTTAGTTGATATGCCGTTTCAATAAATAAAACG
TACCATATGAATTATAATGACTTTGCAATTTTAAATAAGTTGTTGCTTTGTTGTAGTGTT
CTGATCGTATAACTTTACATGCTACTTTTTTTTTGTGCCTATCATGAACATTCATATCAG
TCTAGACTGTTTAAGATACTCAATTGTGTATCGTACCTTACATGTTATGTATCATTCCTT
GCATGTTGCGATCAACTTTTGAGTGTCGGACTTATTGTATGTAAGATATCTGCGATACTG
TTAGATCTCATTGCCTAGTTTGGAGTATTGGAGATTTCCCCGATTCGATGTAGGAATATT
CATTTATTTCCGTAAAATTCATTTGTTCCAATTGGACCCATACTTTTTCTTAAAATTTAC
TCTGTAGTTTTTCTGTTGGATAATTTTGACCTTATTAATGTGTCACTATTGAACCTTCTG
TATAATCAAGGAATTCATGTGATTTGGTATGCTTATATTCAATATCATTTATTAGCAAT
CGCAAGCGCTAGGCCTTATTCACTCTAGTTGGTAAGTCCTTTAGTTTTTCGCATTTTTGA
GATATCTATGCCCTTTCATCCTGGGAACTGGGAAGATTTTGTTTTGCATTTGTTGCATA
AATTAACTGTAGTTGTTGAATCGGTCTTCCTGTCAGGTAAATCTGGCAGACTCTTCTGCT
AGTAAAGGGGCAAGGATACAAGAAGTTGAAGCTAAGTTTACTCATCTGCAGGCCACATGT
AACCGAATTACGCAGGTATGCTATAAACAATTTGGTGTTATTTTGCTGCGTAAGATTGTA
GTATAAGGTGATGCAAAGTCTTTCTTGAGTTGTAGACTACTACCTAATCTGTTATCCATG
GAGTTTTACTTTAATTGTACCTATTCCATATGTTTGCACAGAGCAACCGTTGGTTCTTAT
TTAGTACTTTCCTGTTTAGGAGAAAGATCTGCTTGAAAAGCATAATCTCTGGCTTGACGA
GGAACTTAAAGAAAAAGTGAAGAACTTAGCTGAACTAAGGAAATCAAACATGGATGAGGA
GGCTAGGATGTCAGCAAAGGTTGCCGAGGTGAGTCCTATTCCAACCTTGACATGTGACAT
AATGCAAGCAGAAAGCAAAACCTGATTATGTTGGTTTCAGCTTGAAAGAGAGACTTCTGA
ATCATCCAGTTCCTTGAGGCGAAGCAAAGAACGGGTTTCTGAATTGGAGCAAAGGGTATC
ATATATGGAAAAGGTAAATTGTCAGATTTGTTAGCTTTTGTATTATTGCCATCATCTAAT
TTTTGCTTTGCTTTGCTTTTATGATCTAAAGGAGTTGTGCTCAACAAAGGATGCTGCAGC
TGCTAATGAACAACGCCTGGCTGCAGAGCTTTCAACTGTATGGTTTACCTTTATTCCCAT
TAACCCCCCCTTGTTTATTTCACCCTTACTGCTCCCACTCCCTGCTTGTTTAAATTTTAG
AAAGGAAATGGAAGAAAATGTGTGCTGAGCTATTTGTACTAGACCAGCAGATCAGTCCAT
CGTTATTGTATATGCACACGGCACACCACAACTTAACCCATCTAGTGTATCTAGGATATT
TCTTTTTTTTAATGGAATGCACTGATGTTCCTCTCTATAAGCCAAGTCGATGACGCTTT
TAATTATTGCCTTTTGTTCTGTTTCCCTTAAAAGGTCATGAAACTTGCTGAACTTCACAA
AGAAAGTTCTGAGGAATGGTCAAAAAAAGCGGGGGAACTTGAAGGTGTTATTAAAGCATT
GGAGGTAATGCCTTTACTTGTATTTAATTTTGCCCCGCTCATGAACATGAAAATCTAATT
ATTCTTATTATTTTTTCGGTGTAAACCAGACACATTTGACCCAGGTTGAAGATGAATAC
AAGGAAAAGCTTGAGAAGGAGACTTCAGCCAAGAGGGACCTTGAAATGGTATATTGATTA
TTATTTTGGATGGTTTCTTATTGAAAAATCAGTTTGATATTGTGAGTTTCTTAGTTGAT
CTTTTGGCTTTCATGCTATTCAGGAAGCTACCTACTTAAAGCAAAAGCTTGAAAAGTGTG
AATCTGATCTGGAGAATACAAGGAAATCTAGTGAATTGAGCTTCACTCCATTGGTTGCAG
CAGACCCTTGTGATCTAGCAGGCTCACCGATGAAAGAAATGTATTATTTCTGAAACTTTA
TACTTTTAGTCTAGCGAGATATCTAAAGCAGGCGCTATTAGCATAGCTAAGTAACACTTT
CTAGAGAGCATTGTTCAAGGCTTTTTGATATTAATTGTGTTTTGCTCATTAAAGCTTATC
TTATTGAATGATGTTAACTTCTGTTTGTGCTGTACCGTTGTAAACATGATATTATCTTTG
TCCCAACACCAATAGTTCCCAAACATTTTGTAGTCATTCCTTATTGTGTTGATAAGTCAC
TGATCATATCTAGCTGGTGCTAGGGAAAACCATGATATGCAATGTTTTACAAATCATAAC
AGAAACACAGGAAGGAGTATGATCCAATTATTAAACAAGACCTTAATTTTCATCTATTTT
```

FIG. 17 Continued

```
GAATTCTTTTTGTTTCCTATTTGGCAGGGCATTTTCTGATCCAGCAAATCAGAATGATC
TAATGATTGTACCAAAAGTACCTACTGGTGTTTCTGGAACTGCATTAGCTGCTTCTCTTC
TTCGTGATGGTTGGAGTGTATGTCCAATCTCCTCTATACTGTTTAATCTGTGCATTTACG
TTTCAAATATTACCTGATTACCTTCACTGTGTCAGCTCGCTAAGATCTATGAGAAATACC
AAGAAGCTACTGATGCTTTGCGCCATGAGAGGTTTGGACGAAGGCACGCGGAAGCAGTTC
TGGAGAGGGTACAGTTCTGTTCTCGTCAGTTTATCTCTTAATTTGTATTAATCTCTACTC
TCTTTCCCATGATCCCATCATTTCCACTTTCCTAATAGATGTTTTAGACATCAAAAGTCA
AAACAGCTTTAAATACAAACTTTCAACCGTGCCATATTCTATCTATGTAACCACATGGAA
GTAGTCCCTCCTCTGAGAAGGTTGAAATGCAGATTTGCTAAGTTTTGATTACAAACTCAC
CATAATATGGATAGTCAAAATTTCAATAATCGGATTATACGCATTCTAAAATGACATTT
TTTTGAGATGGAGGGAGTACATCAATTTTCGCAGATTTACATTTATTTGAGATGGAGGGT
GAACATTAATTTTCACTGATATTCTCCAAGGTTTCAAATTTATGATTAATAGTTGATGGT
GTGAGAAGTGTTTGTAAAGTGCATGAAGTAAACGCACATGTAGTCCTGTATCATATTTTG
TGCTAAATGGGTAATCGTACTTGTGCAGGGATGCTCTGTTGCTTTTCTCATTGATTCATT
TCTGAAGTGTCCTATTCCTGTTGGATTACTGAATTATCTTTTGTTCAACAGGTCTTGCAT
GAAATTGAAGAGAAAGCTGAGCTTATCTTGGATGAACGAGGTAATGTGAAATGCATACAT
TGCTTCATTGCCTGATAGTACACTGATTATGCTTAAGTTTGGACATGTATGCAATTATTT
TGTGCTCAAGCATATCTTTGCATTTGACCCTTTCAGCTGAGCATAGGAGGATGGTTGAAG
CTTATGCTCTAATGGATCAGAAGTTGCAACAAGCATTGCTGGAGCATGACAATTTTGAAA
ATACCATTAGGAATCTAAAGGTGCGTACATCAATTTTCTGTTAAGTATAGTAGTCTCCCA
TAGTGAAGTTTTAACAATAATCTTGTTTTTGCAGTCAGAGTTAAAAAGGCGGGAACGTGA
TCATAGTATTGCTCAGAAAGAAATAGATGATCTGCAAAAACAAGTGAGTCTTTAAGCATG
ACATCTGCATTTTGTTCTTTTTGATTGATTCACAGATTAAATTGTCTATGTAAGGAAAAT
AGAAATGTTAACCTCTTGCCTACTCTCTAGATATTTAAGATCTGGTGCAACTTGATGTGA
TACTAGTTCTCACCAACATCTTTTCAAGGATGCTATTCTAAAAGGGGTGGAGTCCATTTT
TGGCACCTAAATATTTCTTGGACTCTAAATTTACGCTGAACTAAAAGATCGGTTTTAGTT
CACCTTCAACTTTTATTTATAAAACCAGACAAGTAACACCTCATACCTGATTCCATGGTG
GTTTAGTTGAGATGACATGGTTTTCACTGATGATTAGCTTCTATTAGCTGAGATTAATTG
ATGTTTAACCAGCTATTTGACATTCGCACCAACACAAGCTTGCATATTAGGAGTCTGCAC
TAGCAAAACTATTATGATATCAATGGAAACCACTGTGGAGCAGTGTTGAAGGTATTAAT
AGTATTTGTATGGTTTTGAAAGTCAAAGGGTGGAAAACACTAGCTTTTCAATTTGAAGTT
AAAATGGACCTAGAAAAGAGTCCAAGAGCCAAAAATAGACTATGCCCTTTGAAAATATGT
CGATGCTTGTGGTCCTCACCTGTTCAAATATAATTTGAAGGTGGATATTCATTCTTGCAT
GTCACTACTGACAAGAACATTGAATCAACATTTCTTTTGTGGTACTGCAGATGCTTTTGC
TAACTATATGCTGTGTCTGCCCTCTAAATATTTGCAGATAGCTGTCCTTTTAAAGGAGTG
CCAAGATATACAGCTTCGTTGTGGTTCTAGCCTTCCAAATGTAGGAGATGGTGCTCTTTC
TACAAGCACAAGCACTGGAGTGCCTGAAGTTGAAAACAATATCCATGAGCATGTGAGTAT
GCTAGTCCGTTGTATTCTCTTTCAGTTTCACTGTGTTGGTGCTTGCTTTAACTGTTCGAT
ACTGTGTTTCAGATGACATTCAATGATATCAATGGGTTAGTACAGCAAAATGTGCAACTC
CGGAATCAAGTTCATTTGCTCTCTGCTGATCTTGATAAAAGGGACATGGAACTCAGGGTA
TATATAAAGTTTGACTTTGTTTTTCTATAGTTTCAAATGTTTTAGTTTGTTCATACATC
AGTGTCAGGGCATACTTTTGTATCCAATGACATGAGTACGTGATGAAAAATATCTCGTTT
CTGTACTTTCCAGGAGAGCTTCCAAATTGAGTTGAAGAAGATTACAGATGATGCTGCGTC
CAGGGTTGAGAAAGTGATGAAAAAATCCGAAGAACAAGCAATAATGATTGAATCCCTTCA
CAGATCTGTATGTTTTTGTATTCTCCTTGCCACGAAGTTGGAAATCTTCGTTTTGAAACC
CTGTCTGCAAAATTTCAATTGCATGCTGTATGTGATACCAGTCCTAAAATAGTTCTCTTT
                    snp_2_31026954
TTTGTAGGTAGCGATGTATAGGAAGCTGTGTGAAGAACAACAGAAGTCACGTTCCAATGT
TGAACACATACCCAAAAATTTGGAAGGTTTGTCCTTCTGATGTTTTCAGTTCAGGCAAAA
TGGTTAAATGTCTAACCATGATGGTTTCAACTGCATGTTACTGCTATAAGAAATAACCTA
CATGTGATGGTTTTATTTGTTCTCTAGATGATGGCAGAAAAGACCTGATGGTTCTATTT
GAAGGATCACAGGTAATTTTTTGATGATGGAAGGCTTATTGAGGCTTTAGAATACCATA
GATGTTGTGGTGTCTTTTTTCAAATTTCAATCTATTTTGACCAGGAGGTTTCAAGGAAAG
CTTATGAGCAAGTTTCAGAGCGTGCCAAAAGCCTTGATGAAGAGCTGACTAAGTTGAGGT
GGTGTTTTCCTCCCCTTTTAAATCTTATTGGCATGATAGAATAACAGCTACGGGAAGAAG
TCATTTGAATAATTTTCATTCCGATGTATCATTGGACAAGATGAATACTGATTACGAAGC
```

FIG. 17 Continued 2

```
AATGTAACAACATCCCTTTGCTAAAAAAAAGTAATATGAACGACTAAGGCCCTGTTTGT
TTCAGCTTAAAATTATTATAATCTAGATTATTAAGACATATTACTATAGGCTGGATTATA
ATAAGCCGACATAGAATAAGTTGTTAGTTGTTTGTTGCTCTAGATTATTAGCTGGTTGTT
AGGTGTTAGCAACCCAATAATCTAAAAAAAGCACCTTTAGAGTGGATTACTAGATTATAG
TAATCTGGCTTATAGATTGTAATAATCTATCATAATAAGCTATCTGTTTGTTTCAACTTA
CTCCTAATAGTCCAGATTATAATAATCCTAAGCTGAAACAAACAGGGCCTAAAGCATTAA
GGTTAACTTTCTATGGTCTTTTCAAACTATAGAAGTTTATGTCATGAAAAATAATTTGCA
AGCAATCCAACGTACTTATTTTACGTAGTTAGTCCATATACTTTTGCAATATGAACGACT
AAAGCGTTAAGGTTAACTTTCTATGGTGAGCTACACTTGGAAATGCACAGATCCTATGCT
GGCCTACATATGTAGACAAAGGGAGTACTGGAGTACTATGAAACGGATATCTTGAAATGT
TGTTAGTGCCCAGCTCTGTTGAGGTCGTGTCGTTATAACTAAGCATGCTGACGGAAGTGT
GAATGTAGCACTCCCTCCATCTGAAAATATAACACCTTTTAGCATTCAAACTTTCCCCAC
AATATAATAACTTCACCTATTCACTCATCTCAACCAATCACAACAATCTCTCGGGTAAAT
CTAATGGGCGGTGATCGCTGGGAGCGATCAACCCGCCCCTCCCCCCTATACGCTCTTCC
TCTCCCCCTTCCTCCTCCCCTTCTTCTCTTCCTACTACAGTACACCATAAATTTTTTAAA
AAATAAAAAAACAAAGTTGGAAAAATTTATGTATAGAAATACTATATATAAAAAACATTT
GAATTCAAATTCAAATTGAAACGGGTATGTAAACTTTTGACTTAAAACTTTAGGTGTATA
AACTTTAGATGTGTAAACTTGAGGTGTACAAACTTTAGGTGCATAAATTTACTAAAATAG
GAAAGTAATGCGGTGCCAAAAAAGGAAACCACGTGGAGGGAGGGGGGGATCCGAATCCTG
ATCGCTAGGGGCGCTTAGCAATCTCGCAATCTCCCACTTAATTTCTCGACCTACTTTCTC
ATCTCAACTAATAACAATTTTCCCCATTTAATTTCTCCTGCTTTCTTAATACCTTGTACA
ACTCTAGAAATCCTTATATTTTGTGATGGAGGGAGTAGTATATAGACGCACATCTAAGTT
ATCTGTGTCACGGTTGGTTTTAACTTACCATGTATCTGTGCTGTTAAGGGTTCCATTTC
TTGTTGGTTCTTCATTTTTACATGATTTTGGATGGCCCTACTTATTGTGGTATTTGGACT
GTTGTTGATTATGTTATATTATATTTGATCTTGCATAGAATTTCTGATCAATACTGATTA
CTATTCATTAGGACTGAGCTTCTATCTTTGCGTTCTGAGCGTGATAAGGCGGTTCTTGAA
GCAGAATTTGCTCGAGAACGACTTAATGGATTTACAGCAGAGCTTGAACACCAGGTTCTT
TCTTTGATGTGTTATATCATGATTTGTTAATATTTATGTTTGTTACACTGAAATGGACAT
AATAATGTCCATAACAGTCTTTTGGAAGAAGATAGCATTTATTACATGCTGTATCCTTAT
TTACTTTGTACATGTAAAAAACAGAGGAAGGAAGCTAATTCTATTTCGCTAAGAAATGCG
GAATTGATGCATTTAGTAGTTGATTACGAAAAAAGATTGCGTGAGAACTCAGAATCTATG
                              snp_2_31024549
AAGGCTGTAGAGGAGAACTCACGGAAGCTATTAATGGAGGTTTGTTGATATTTTTACATT
CCTCAAATAATATTAAGACCCAGAGTCCTGACATGATTTCCATTTCTCTAGATGTCTATT
CTAAAGAATGAAAAGAGATCTTAGCAAAGTCAGAGAAAAAGCTTTGGAGGAAGTTCAT
GATTTGACCACGAGGGTGCATCGCCTGCAGGTATTTCCCTTGCTGCCATATCTTTTCATT
ACTTTGGAGTTTCAATATTGTCTTGTACCCCCTCCATCCAATAAAAAAAGCGTGTCCATG
ATCGTAGCTAGGGTTGGTCTTTTTTTGGGACGGAGTAGTATGTATTGCAGTTTCTGTTAG
TTTGTTATGTTTCCAAAACAGTTGTAAAACTGTTATCGTCAATTATATTCTATACTTATG
AATATATACTCCTTCTGTCCCAAAAAGAATTAATTTCTAGGTAAGAATCTGGGCATAGAC
TATATGTCCAGATTCATAGTCAGAAATTGGTTCTTGTTGGGACAGAGGGAGTATATTATT
GTTATGCTCTTTTTGAAAGGATAATTTAGTACTTTTCGTAGCTCTGCCCTATATTTCTCA
TGACAAATTTGGAGCTGTCAGTTTCGCACAACTGTATGGTCTACTCAAGCATGAACAAGC
AAGATCTTTTAGCTATTTGTGTTTTTAATTTGCGATCTCAAATAAGTTAAATGTTCGTGA
AACAAATAAAACATGTCAATTACTTTGTCTTGAGGCTTTTATAAACTTGCACTGACTTGT
ATATATGATGCATTGCAGGCGACCATTGACACAATACATGCCACCGAGGAGGTTCAAGAG
GTACAATATGTCTAGATGAGTCACATTAATACTTGAAATTCTTCTCTGTCTATCTCTTAA
TCTGTGAATAATTTAGAATGCAAGGTCTATTGAAAGGAGAAATCAAGAGGAGTACATCAA
GAGACTAGAAGTAAGACTCCTATTTGGCATCACATATGCTTTAGTATTTTGTGCTTATGT
AGCTTCGTCATTGCCTCTCCTCTCACATTCAAGCTGTTCTTAGCTTTAAAATGTAATTTC
CTGTACTGATACCTTGAACATTGAGAATACTACTGTGACTCTGTGAGATTTGTTCTCTTT
CTGCATGCTCATTGTGGGGATATATTGCTCCATGTATTCCTTCTGTATCTTATCTTGGTT
GAGCTTATTCTAATTTGAAATGCATCCATAGAGGGACTGGGCTGAAGTGAAAAAGAGCT
TCAAGAGCAAAGGGATCATGTCCGCGTCCTGACGCTTGATAAGAAAAATGCCTTTGACGG
ATGTCTGAAGCAGGTAGAGGATATGAGAAAGAGTTACAAAATTCATGGAAAGCTGCTAC
TGATGCTGAATCTAGGGCTGCTGTTGCAGAGGTTTGTTCAAGTAATTCATTTTTCTATAG
```

FIG. 17 Continued 3

TTAATCGCAAACATATTATCTAACTGGTAACTATTTTGACATTTCTGTAGGCAAAGTGTT
snp_2_31023080
CTGATTTGGAGACAAAACTAAAATCAAGAAAGGTAGATACTTATAAAACTAATACACTGT
TATATTGTATATCTAATACAATGATGTTGAAAGCACCATACATCATAAAACTGTCTGTAT
GTAATTTCCTATTGATAATCTCTCGCAATTCCTGGTTTTGTCATGAGTAAATGATTTTCG
GTACAATTATTTCTAAGCTGTTTAATAGTCTGTTCTGTAAAGGAAGCACATGATTTCAGC
TGAATTACATAATCTTCATATCTTTGTACGATTGTCAAATTCTGCTTTGGATGTTGTCTG
ATCATTGAAATAGTCATATCGTTTTAATTGAAATGTCATTCATGGATATCCATGAAAAA
TAGTGGAATGATGCATCACGTTAGTTTTAGCATTAGTGCATGTTTAAAATTTTCTTTAC
AAATCAACATCAAATTTGTTGTCTATATTATCCGTTTGTAGGGAGCTAATTTCATTGCTC
TTGTTAATTAGCTATAGGTGTACACTGCATCTAAATATCTCTGTACTTTCTACCTTCTCT
CCTATATACTGTATCACCCTTAATTGAGCTGGTGTAACAATTCTGATTATAATTATGCAT
TCACGCGGTAACTTGTAAAGCATCCATGGATGCGTGTAGTTGCTGTACAATTTGTTCATT
ACCATGATTGAATTGAGTAGCATGTTTCTTTGATGAAAGCATGGATATTCTGGTAAATGT
ACTTTATTTCTTGGGCATTGATCTGAAACAAAATTAATCCTACAAAAGCAAATGGTGGGA
GTACAACTAAAAGCATGTAGTATTCTTAATACCTTTTCATTGTATTGTACATGCTATTTA
GCTTTCAGCTGACTGCTGTTATTCTGCTAGACCATTTTTAGGGATGGTGGTCGTGATATC
TTATCAGCAACTGAGGTGAGCTAGTTTTTTCCTGCTATTTGGACAATATCATATGCTTCT
ACATATTTTATATGGTTAAAGATCCTATGGTCTTAAAATTTCTGGATAATTTCAATGCTC
AGTTGTTAAAAATTTGCCCTGTAGGAGAATGATGAGCTTTTCCAGCTGAAAGAGGAGTTG
GAAAAGTACAAAGAGGAAGCTCAAGCAAATAAAAGCTACATGCTTCAGGTCAGTTTGCCC
CATCACCTTGAAAGGCTAAATTGTTTAATTACATTGTGGAGTCATCAAGCTCTTTTACCA
TTAGAAACATTGTCACTAGCTACATTTATTAGTTTATCATTTGACATCACCAAGGAGTAA
TATTCTGAATTTCCTCAACAACTATCTATCGCTGTGCACAAGAGATATTTTAGGTTTGGC
ACTCCCATTAGAGAAAGATTACCCCTTTACTTATAGGAAGTTATTGTTCATGGTGATAGT
GACATCACCATTAGGGAGCAGATGCTGACCCTTGAGAAGTTGAGGTTGTAGCCATCCCAT
CCCTCTTGCTTAATACATATCTTGTAAGCCTGACGAGGTTATGATCAATCATTCTGAGGT
CAAGTCGATGCCATGCTGGATGCAACTTTGATAATTTGTTCCCCTAATTGATCACCTTA
GCTCATAATATGCAACAGTTTTCTAGTTATCTATGATCGGTGTGGTCCATGGAGCTGGTT
TGAAGTGGATTAATTATTTTGTCATTCTTTGCTCCTTTTCACTCAATGATTCTATGCAT
TACACCAATTTCTGAAATGCTAGTGATATACAGATCATATCCATATCTGGTATTCTGGTT
CCAAGCATGAGAGGACCGTGCAACATAAACAACAATGGATTGTTATGATAATGAAGATGT
GATGTAATAGAGTTATTTTCCTCTCTTGAAGGCCCATGCATGAATAATATATCTAGCATA
GCCACCTTTGTCATAATCAGAAAGCACACCATATTTCCTTTTGAAAGGTCATTATAATGG
CTTAGTTGTTCTGTAGAGTAGGTGAACTGAATTCATTGGTGCTTGCGTAGTGTGGCCTGT
GTTTCTATTTTGCCTTGTAGAAGTCAATTATTTGCTGACCTCTTTAAGTCATATTATAAC
TCTAATTACTTGACAGTACAAAGAAATTGCAAACTCAAATGAATCTGCATTGAAGCAAAT
GGAGTCTGCACTTCAGGATTTCAAAACCGAGGTACTGAAATGCTTTCTGTATCCTTATCT
ACCTATGCTTGATATTTACATGAATTTCTATTTAATTTTCAGTCTGAGACTATCAAGAAA
AGCTTGGAAGATGAGATTACAAAGTTGAGGACCAAGATATCTGAACTGGAGAAGTGTTAT
ATAATGAAGTGTGAAGAAGCTGCCAGTGCAATTGAAGCTAAAGAGAAGGATACCACTTCT
CTCATGAAGGAAATCTCAGTTTTGAGAAATGAAGTTTCCGAGAAAGTGTAAGCAATTTAT
ATACCCTATAGAGGCAGGCATATGCTTTTCTCAATTTGGAGATGCTTCTTCGATTGATGT
TATCTCTTTTATTTTCTCATTCCTCAAAACAGAATACAGATTGAAAAATTAGAAACTGAA
CTGGCTTCCTCGAAGAGGGCTCTTGACGAGCAGTATAAGCGTTGGCGTAGCGCTCAGGAC
AACTATGAGCGTCAGGTACTTTGGGGCACTAACAATTTTGTCAAACAACACATAATGTTA
TTATGCTTTCTACTTATATCTTGGTGCTTGCGGTGCTGATGCTTCATTACAATTGATGTG
CAATCACAACTTGCAGTGATACTAATGTTATATGGAGCATGTTGCTAAATGTTTTCACCA
TTTTACTTGAACTGTAGCTGCTATTCTAGGCTACTATAAAAGACACCAGTGGTGGTGGTG
GCTGCACCTTTTACAAACTAGTCCCTGATAATTTCAGATATTATGCGAGTCTAATATTTG
TTTGAATCAAGTCAATACCATATATTCAAATAAGGAAACAAGTAATACTAGCATATTTGT
TAAAAAAATATTTTGTCTATGACATATACTTTCTTTTACCCATAGCAAAGCATGGTCATT
TTGCTAGTGTATGCAACTTAGTTCATAGCATCACCATCAAAGATCAGATGGCATGTACAT
GATACAATAAAGTAACTGAAGTATATCAAGTTCAGATTGATTTATCCTTCTTACTTATTA
CTTGCAATTCTTATAATGAATCTCCTTGGTGTTTATATACAATTATTTTTTTTGTACATA
CTGTGTTATCCTAGAATGAGGCTGTGAAAGCACTTATTGTGTGTGTGTGTGTGTGTAT FIG. 17 Continued 4

```
CTCTTCTGTATCTTCTGTAGGTTATTCTGCAATCGGAAACAATACAGGAGCTGACAAGTG
CTTCTAAGGAGCTATCTTCTTTGCAGCAGGAAATCATAGTGCTTCGTCAAACAGTAGAAA
CACAGAAGGCTGAAAATGTAAATTAAAACTGCTCCACTGACCCTCTTGTCTGAACTTCTA
TTCATTTGGCGTGTAAGAGTAGAAGTCTTTGTGTCTTGGACAGATCTAAAGGGATGTGTT
ATTTGTGGCTGAACTACCCTTAAATTAGGAGAAATAAACCTTACCAGCTAATGCTTAATT
TATGACGCTAGGTCTGCTAGGTGTGGCGTTACACGCTTCTGTGGTGCTTGCCCCAGTTGT
CATAGCCTCACATTTTAGCTAAAGTGTTGTGCTTGATCTGGCTGCTGCAAGCCCCAGGCA
AGGAACCAAATAACGTCAAGAAGTCTTTTAAAAGTTACACCTTGTACCTTCCCACTTGTT
GATCCAACCTTTTTGTGGATAAAAATGGTCTTATGGCATCTAAAATTCAAAGCACACAGA
TTAGCGATTACCACTAGTTCTTTGCTGGTGTTCAATAAAACCTTTGCAATTTTTGACAAA
TCGGGTGAATCAGTCGAGGAATAGTTCAATGTGTCTACCTTTCTGATATTTCTATTCTGT
GCATAACAGCAGTAATCTGGCTATACCTATACTACTTATGTTGCTTTTGGAATAGATTCA
TGATTAGTGATAACTTATCCTGATCGAGCTGTTCATAGGAACTAATCATCATTTGTTGTA
                                                      snp_2_31019010
ACTAATCGACACTGCAAATACTTTTTCAGGATGGTCTAAGAACCCTTGGAGAGCAAGAAA
AGATAGAGCTGGTGAAAGGAAAGGATGAGGCCTTGCAGAAATACAATGAGCTAAATGATC
AGGTTTAAAAGCTTGTAGCTATCGATATCCAGTTATTCTTAAAACATTCACGTTTTAGA
ATGTTATCTGATCTCCATGTTTCACTACCAAGAGCAAAAGTGGGATTTTACAAACCTAAG
GGAGCTGCTTATATAGCATTGACATTAAACAACTCAAACATGAAACAAAATCCTGGCAAT
AGCAACAAAAGAAAAGGGTGGATACTCCAGAGACTTCACATCCTGATTGTTGTTCCTTC
CTTCCAGCCATGACTGAACCTCACTTTCGACTTGTTCTAGTAGCTTTGCTCCACCTGCTG
CGCGCTTCTGTTTTCTTCTGACTTCTGCAAGAAGTACCAGTTAGTAACCCAGAAACTAAC
AGGAAAACTCATTTCAAATAGCCCCACTAAATGGCTGAAATCCCCGCGACAAAGTATCTG
CTTTCTGTTTTGAAATGGAATACCCATTTCTCTTTAAAGAATAAAATGAAACACCCATTC
TTCTAGCACCTGCAGCACATATCGAAGAATATTGTTAAAACCACGGGAACAGCTTAAGAC
ACCCCCATTTTTGGCATTTATGATCTTTTCCAATCCTTTTCTACACAGCGATCTTTGGTT
ATATACTCTTTTTAGCGTTAACAAAACACAAATTTTGATTTGAGAGGAATCCTGATTTTC
CACAAAATATTGTGTGCAAATTCCACTACTATCAATTCCAACCACAATTTCGGAATTACT
GGGATTAGTTTGGCATAGGAACCAGAATTGATTGGTTTGATTACTATAATGCTTAATTGA
TTATGGGATGGGTGTCGAATTTATGGACTTCTACATGCACATTTTGAGGGGTATGTATTT
TATACCTACCTATTGAGAACATACATATGAATATTTTTAATGATACAAATAAAATTTAA
TAAGGCACTTGTCTACATGGTGCTTTACACTAGGGTTTCATGGGCTTATTTTTGTTTTT
TTTAACATGCTTGATAACTATTTTCATAACAGTTGCCTGTTTCGACTTTCGAGCCTTAAT
ATAAACACTGCCTTACAAAATCAGTATATCACTACAGTAACTGATTGTACTAGTATATGC
TTAATTCGTTGGCAAGATAATGCTGGATTAATCTTGTTTTTCTGGTCTAAAAGATGTTCA
GCATATTTAAACCATAATCTAGAATGGTTACTGGTTGTAGTTGGTTGCCATTCATATTTT
TTGTTTGCTTCCATTGCATGTCCTTCCGTTCTGTATATAAACACGGGTGGTCGTTAGTTG
CCATTCGTGAAGATCACATGAATATACATTCTTGCTATTTTCTGTACTTGATGACAGTGG
GTTACCATGAATCACATATTTTCTTCAAATGCTGAATGCAGAATAAAATTCTACACAATC
AACTAGAAGCTTTGCACATTAGATTAGCTGAAAAAGAACGCAATATTGCTGGTCTTTCAT
CGCAACGCATTGATTCACATGGTGAAGATGATTTGCATAGCGTCATTGGCTACCTGCGCA
GATCGAAAGAAATAGTGAGTATAAGATTCAGTGTCCTCTTCTTCTTTATTATTCCTCTAC
TTGGAATGGGATGTTATTTATGTAGTCTGATGGTAATTTCACTATTTCAGGCAGAAACCG
AGATATCTTTGCTTAAACAGGAGAAGTCACGGCTTCAGATAGAAGTATGATCTGCTTGCT
CTTGCATATTGTTATTTGTTCAAATACCCATAATTGTGCCACGTCAACTACTGTACTCCT
CCATCCACAAAAGTTACACATTTTACTTTTGTCACCAAGACCATGAAGAAATTAAATTAT
CTTGGATGCTACAACATCAAGGAGTGAATGCAAGCATGCAACCAATGAGTATTTAGATGA
CTACTTGGGTTCTCATCAAACATTTAATTTATCTCTTCATTTAAGTCTTAAATACATAAA
GATTACAAATAGGTACAACTTATTTGGAAAAACTCAAATGTGAAATATGTCTAACTTTTG
TGGATGGAGTAAAACAGAACTCTACCTATGCTTACTTGAATTGTATGTAATTATAAAGGA
ACTGTTCTGTTTCTTTTGTTTTATGTAGTATGGTGACTGCGAATATTGAACTGCCACCTG
CCAGACTTTGTTGTTTTGTCATTTTGTTCCATGCTCCCATTTAATCTGCCCATAGGACAA
TTCCATGAAGTTTCCACTGTTTGACCCATCATATTTGGCATTTGGTATCATCATGGAACC
AATCCATATGGCCTTGTCTCCTTTGTGTGATTGCTTGCCAAGCTTGTCTCATTTAACTTG
ATCCTATGGCTCCACTCTGGTCTTGTATGAACATGTCATGTGCCTCTGTACTTTCAACAC
ATAACTGAAAGTTATGCATTATTGTTCAATCTGTTTGTCTTGCATGATTTGAGAACTTGT
```

FIG. 17 Continued 5

```
TTTCACTCCTCATTTTGACTATATGATTTCCTATTATGTGTTTTTGTCTGATGTAGTTTT
ATCTGTGTGCCTTCCATGATATTAGAACCGTTTCCGTGCTTGATTTTGTGGGGGCAGCTT
AAGGTGTTTCTAATCTGCTATAATTTTTTTCATGCTTATATAGTTGGAAAGTGCATTGAA
GTCCACAAAGGAGGCACAGGACTTGCTCCGCAGTCAAACTGATAGTGCAAGAACATCAAT
GCTCAAGGATGAAGAATTCAAGTCACTGCAATTCCAGGTGCCATTCTTGTCGACTCCCTC
CTCAAAATATCGCTATTTCTAGTGCTTAAATTTTGTCCCAGAATATAGCTATTTCTATAG
TCCTACTTTCCCCACCAAACACTCGTCTGCTTTTCACTCACCTCCATTCCTCCAACTATC
CCTCATTTATTTATTTATTTATTTATTTTTGGGGGGGGGGGCATCATAGTCTTTT
CCGTTGATCGTTAAATCTCTCCAAAAAGCCACAAGTTATATTTTAGGGCGGAGAGTGTA
TTGGGTATCTGTCATGACTGCTCCCTTTCTCTTGATTTTACTGTTGCTCTCTTATTCCTT
TTTTGTAGCTTGTTTTCTTTTGTATTAAAAATGCTTTACCTCAGGTGAGAGAGCTTAATT
TGCTTCGTGAAAGCAATATACAGCTTAGAGAGGAGAACAAGCATAATTTCGAAGAATGCC
AGGTAAGTTTATTGATGTTGTCTTGTTTATTTCTTTTATGGTGCATGTTTTGATGTGCTT
CATTGTTCTTTTTTTTCTCTCCTGGGTTCAGAAATTCCATGATGAGGCTCAAAAGGCTA
AAATGGAAGCTGAAAGGTTGCATAATCTTTTACTGGAAAAGCAGGTAGATGCTGAAATAT
GTAAAAAGAAATAGAGATGCAGAAGACCGAAATAGCTAATCTAAATCAAAAGATTTCCG
AGGTATGTTATTTACCCATTATCATTATGCAACGCATCATGAATATAATTGGTTTATTTA
TATGCGGTTAGCATTTCCTTAAGGTAGCTGACATTTGATACATGACCTTTTCTAATAAAT
AATAAATAAGAATTAAAATATAGCACTGTAGCAGCTAATGTTGTACTAGTACATTAGATA
GAGACCATGCCAGGTCAAAAAATATTTTCTTGAACTGGAGGAAGCAAACCCTCAAATGCT
GATGCTAGTTTTTTTTAGGAAACTTACATCTAAGCTAGGCAGCGCTTGTGTGGAAATGTG
CGTTTGTGTACATCTGACTTGATATTCTTGGTGCTACTTGTGTCTTCACTTTCTGTCATT
GGTTTTGTTATGAATGGAGGGACTTTAGGATTAGTTGCCCAGTGCATGTGCACAGAAAAG
GGTGTCTGAACAGCAGACCGGTGTGCCGGTGTGTACATCGAGCAGGGGTTCTTGCATTGT
GTATAAATTCAGTTTATGTTTTACCTCTTCATCAGTTAGTCTTGAATAGAATTTGTCTAG
TGTTTCCCAAAGTTCTAACATTATTATTAACATTGTTATAAGCTTGCTATTATCATTGTT
CTATCAGGTATTTTGTTTGACTCTTATGTCAACTTTATTCTTCTGCAGTTGGTTGAAAA
TAGTAGAGGCGTTGATTTGAGCACATATGAGACCATGAAGGATGAACTTCAAAACATAAA
AGTTAGTGGTTTTTTTTATTATTTTTATCTTTTCAAATCATTTGATAAGTATTTTTAGT
TATTATGTTATACTTATTCTTTTGGTGATTGAATTTGGTCTGAACATATTTTTGTTCTA
TAAATTGTACTCTGATCCAAGATATAAGAACTTCTGGTATTCTTGGGGATTAAGGAAAGA
GGTGAAATTGAATTGGGGATGGTTGCGATTAGTTGAGATGAGGAAACAAGTAGAGAAATT
AGATGAGAAATGGTTGTGATTAGTTGGGATGGGGGAGTAGGTGAAGTTGCTATATTTTGG
GACATTGAGAGTACTGATAAAATAATACTACATTTGTTCTTTTGTATGCTGGTTTGACTA
GAGATCAACTGTTTAATGAAGCATTCGGTTCTGAACCTAGTTCAAGCTTGGAATCAGATA
GCTACGGTAAAGAATAGGGAAAATGACCATTGGTGAGACAATTAGAGGGAGGGGACAGAC
AATATAGTCTGGAATAAGAACTTTGAAGCGAAACATACTTTCTAATTATTATCGGCTAT
CGCTGGTATTGGACTTGTTATGCCCTTTCATGCGCATATGCTGCTCGTTTTCTAATTATT
GATGGCAGTTGAGTTAGTTTCCCACTTTTCTCAACTTCTAATCGCTCGTTTTCCACACGC
ACACTTTTCAAACTGCTAAACAGTGTGTTTTGAAAAAAAACATATATATCGATTTTCA
ACTTTTTTTTTAAATAATACTTAATTAATCATGCTCTAATGAGTAGCCCAGTTTTCCATG
CAGGAGGGATAAGTTCTCAACCTGTATTAACGAACACAGCCTTAGTGATATATAACACTG
ATACTGATGTACATCCCTTAATTAGCATGGATGGCTGGCTTAAATTTCATTATTTGGTCA
ATACGACTGAACTTAATGAGTTTGTAAGGTTGAGTTTTGTGATAAACGATTATCACATGT
ATTTCTTAAATACAACAGGCAACCTTGAGAGAGAATTCGGCAGAGCTAGAGCGCACAAAA
AAACTTCTTTCTGAGAAGGATTCTGTAATAAGAAATTTGGAGGAAAAGCTTGCTGGATGT
``` snp_2_31013745

```
CAGTCTGAATTGGATGCTAGGGAAAAGAAGCTGAATGATGTTGAGGTCTGATATAATTTC
CAGTAACATTCTCCTGGCCATTTTTACTTTAGTTGTATTAGTAATGCCTTTCCTTTTGCA
GGCTAGCCTTAAATCTGAAATTGACAGACATAGGAAGATTAATATCAACATAAAGGTTAG
GATCTTTCCCTTGTTCTTCTATTGCAAGATCGAAAGTTCATTGCTGTTTTCATGTGCTTA
TATCATCCTATTAAATAATGTAGAGGAAGCTTGATGCATCAGCAAAAGAGAAGGAGGAAC
TGACGAAAGAAAAACAAAGCCTTTCAAAGCAATTGGAAGATCTCAAATCAAGTACTTAAT
TAATCTTATTACTTTCACACAACCACCTGAATTATATATTTTGTATGATCACTCATGTTT
TAAATTTGATATACTTTAGCAGGTCAGAAAACTACAACAGAAAATTCAAATGAACAGGCC
ATCAAAGAAAAGGACTTCAGGATACAGGTCAGGAGGTTGTGATTTTTATGAACATGAACT
```

FIG. 17 Continued 6

```
CCTTCAGGTTTCTTACATAAACATATATTAACAGACATTGGAAAAAGTCTTGGAGAAAGA
GAGAGATGATAATAAGAAAGAAAAAGCATTCCGCAGAAGGAATGAGAAAGTATTTACTAC
CGCCATTCAAAATATGAATCAGGTATTTCTTCCTCAACTAGCCTGAGTACAGTCTTGTCT
TAAAAATTTTTTTGTTTATCGTCAGTTGGGTTTAGATTGAGCACCAAATTTATCATGGAA
CTACTGATTTAATACAGATTGTCACAAAGCTACACATTAAGTAGCAAATTTGTCACAAAG
CTACTGGTTTATTGCCAATTTAATCCCAAAACTACAACGTCTATATCTTCAACATAACTG
TAGTGCTAGGGATTGAAAATCTAAAATCTGTAGTTTTTTTATAACTTGAGCAATAAATCT
GTAGTTTTGTGATACTTCTCCCTAAATCTGTACCTGATAGCTTTGGGGGAGTGGATTCTA
ATCCCTTGAGGGGATGTCCCGTCGTGTACCTTTTCTTTCAAATTCGATACAAATAGTTG
TAAAAATTTATGAAAAAAATTCGACCTACTATTTATATCTCTCGACGTGTGCGTTGCGTT
TGGACCTAAGATTTTATGGAGTTGTATACTTATGTTGTATGAGTGTTGTCGATCTTTTCC
AGAATTTTTCATAACCATTTGGATGGTTTTTAAGCAAACAAGGGGACATCCCTCGAGGGA
TCAAAATAGTTTCCCTAGTTTTGGCACTAAATGTATAGTTTTGTGATTTGTCTTAAATCC
GTAGTTTGTGAAATTTTCTCCTTTTTTTTAACCGATGCAGTAGATTTTCTAATAAGAAAA
GCCAAGGAAGTAGACATTAAGATAATGAAAGATTGATATGTTGACATGTTCACAGATGAA
CTTAGAAAAATGAAAAACTTAATGTGTTCTGGGATATACAAGATGAAACTTTTAAGTAGG
ATGTTTTAGTGTATTCTAGAGTTGGAAAGTTGGCATCATTATGAATGTTCTAAAGAATAA
GTGCCATTTTAAACCTTACCAAAAAATTGGCAAGCCAAATTTTGGTAAAGTTTGAGTGTT
TGGTTTATAACCAAGTTTTTGTCAATGTTGCTTGTGATGTATTGATTGTTTTGCCAAAA
TATTGGCAACACAAAATCTATGGCAACAAACCAAACACACACATTTTCTTGCCCTTGCCA
ATTTTTTTGTATAGTTTGTTTGGGCTATAAACCAAATGCTAAGTGTTCATGTCCATTGCC
AAACCAACCCTGAGTATTAAGCCTATCATTATGATCTACACTTTTCGTTACATTTTCTTC
TATTGAATGATTTCTTAGAATATGAAATTTCACTGTTTAAAGCTTGCAAATGTAGCATCA
TTTGAGTTTGCTAATGGTTAATGTTTAGCATGATCACAGGCAATTATAGTACACTATAGT
AAATTATTGTCTGGGGTTTGCTTATTGGCTTTTCAGGCCATGTCCCATTCCTGTGATAGC
CCTTAATGATCAGTTAGCATGCATTGCAGCTTGCTCCAACCTGTTTCCTTAGTATTTACT
CGTATTTGTTACCTAATGATACATGATGTGTACCTATTAAAAATGCAACATAACAACTTC
ATAGTTGCTTGTTTCTCCAATAATTAATCTGTCCTGCCTGGTTAGTGTGTGGTATATGCG
CACCCTCTAATCCACTTGTTGCTTTCGAAAATTAATTGCAGGAAAGGAAACAAGTAGAGG
AATCAATTGAGAAGCATAGGCAGGCTGTGAAAGAGGTGATTGAGGTACAGTTTATCTGCT
CCCATAGATTTCATGTTTCATTATTGCTGCTGCAAATGAAAGTTCCTAGTATATTTTATT
TAGAGCTTTGCTACAGCTGATGTGCGTTCTCTGCAGCATTATACTGGAATATCCTCTCAA
ATCCCATCTGGATCTGCAATCGATGAGCAGCTGCGTTCATATTTCCTTGCCATCAAAGCT
GTTGAGGAGTCTCCGAGTCCCTTCCAAGATGGTGCAGCAAGCCAGACACCATCTGTTGAA
AGTGCCGATGTGGATGCATCTGCAGCTACTGCAGGTTCCTTTCTGTTCAATTTTTCATTC
CACGCTGCTAGTGTATATTTAATGATCTCTATTAGTTAATCATAGTATCTGTTAATGACA
TGTGATACTTACTAGTTCAGAAATTATATTAGATCTGATCTATTACATGTACTCTTGAAC
TCGATGTGAATTTGGTTTTGAATGATTTGGCATGTCAGATATTGTTCGGACTTCGGAATG
TGATATGATATTGGATTTCTAATGCATCATTTTCTTGCATTGGTTCCATCGCGTGGATCT
GAATAATGTGTTTTTCCTTTGCTTTACCGTCACTTGATCAATATGGTAGTTCATAAGGCT
GCTGCTTTTTTTTTTTCTAATCTCAGGGAGACAGGTAGCTACTCCACCAAGGCCTGCTC
AAGTTAAAGTGGTGGAGGAGAGAGCAGTTTCTACTTTGCCCAAACCAAGCACTGAAGTAC
GTAGACCAGGAGGAAGGAGACCACTTGTTCGACCTTCACTTGAACGAGTTGAAGAACCCC
AAGCTGATATTGATACAACAGTAGTTGAAGGTTCCACAGAGAAAGGCGGCTTGTTGATGG
AGCGTGAAACTCCTGGTGGTGTATCTGCGTTACAGCCATCAAGTCGTAAACGTCTAATTC
CATCACCACAAACGAGAGATGATGCTTCACAAGGAGAGACAACGGATGCCAATCCACCAC
TGAAGAAACCCAAAGAAGGATCTTCACAATGTACTAGTGAGCTAAAAACTGAACAGTCAC
CTCATGAAGATGTCATGGCACCTGTTCCTGTGCTACCATCTACAGAGTTAGATGAGCAAC
AGCCTGGAGAAGAGATGGACACCGATCAGTCTTCCTTGCCAGTTGAAGAGGTTGAGGAAA
``` snp_2_31010249

```
CAAGGGAGGATGACTTGGGTGATAAGGATGACATGGAAACACATATAGACGCTTCAATGG
ACATCCAAGGACAAGATGCAGAAACTGGTATTGATAATGATGCAACTACTGTGGAAGATG
TGCCAGTCAAGTCAGAAGCGGTTATGGAATCACTGGAGGAAGACCTGAAAACTGAGGATG
GGAAGGAAGAGGGTCAGTTTACTGCAACCACTGATGTTGAAGATGAGAGGGAGGAGGGAG
AGTTGCCAGATGAACCAGAACAACCAGACAGCACTCCCCCTGTGCTGGATGTTGGTGAGC
AAGCCGGTGATTCTTTCAGGGCGGCATCTCCAGCAGGACCAACTGAAAAGAGTGATGTTG
```

FIG. 17 Continued 7

```
ACATGCCAGAAGAAACTGGAGAAGGTGATGGTACCATGGAATCAGACCAAAGCCCTGTAC
CACAATCTGGTGGAGCAGATGCGTCACCGAGCCAAATGGCTGATGCGTCACCAAGCCCTG
CACGTGAACCTTCTCCTAACCCAGTCCAAGCTGGTGCACCTCCTGAACAGCAGAATCCCA
CCCCTCCTAACCCAGTCCAAGCTGGTGCATCTTCTGAACAGCAGAATCCCGCCACTGCAG
CAGAAGGTGTTGAAACTCGTAGTACCAGAACAATCAACCTAACTGAGAGAGCGAGGCAAA
ACCGGCAAGCCAGGATTCTTCGCTCAGCCACTCAACAGAATGCAAGGGGCCGTGGCAACC
AGTCTCTTACATACAGGGTATGGTTTTATACTACAAGACTACTGAGTTTATTTCTGTTGT
GTTCTATTTTTGTTATATCCAGTGTTAATTCTGATGGAGAACAATGTTTTCTATGTGCAG
AAAGATGGCGGCCGAGGAACACGGGGTCGTGGTGGGCGTGGTCAGTCGTAGAGAATTTAG
GTTTGTCTTTGCTCAAGCGCGGAGACTAGTTTTTTGCAAAGGACATACTGAATCAGGGCG
GCATCATATTCATTTGTAGCACTATCAGAATTGCGAGCGTACATGTTACTCTGCTTAGA
CAAATTCATGTGGCTAAGCAGCGCTTATTAAAATGTTCTCATTGCCCGTGCGGATTGCCA
GATGACCTATATTTAAATTGAACTCTAGTTGACAAAGATGATATAAGCATTCGTAGCGCG
TAAGCTGATTTTTATTTTCTTTTTGATTCGCTGCGTAAGTTGATACTGAGTTGTAAATG
CGTACAAGGTTTGCTAACGAATGTCGGTTATAATTTGACTGTAGAAAACTGAACATTTCT
GAATGTTAGTCGGAGTAAATGATTTTGAACCGGACGATAATAAGATGAAGGCTACAGTTT
CACGATTGCTCATAGCTAAGCAGAGCTAGTAGACTCGGGGTCAAAAGATGAATAGATTAA
AGCCAATAATTAGATCTGAACAATGAAAAATAGCCTATAATCCCCTACATTTGAGATAAG
TTTGCACCCAGGATCTACAAAAGCCGCGTCGATCTACAGCCTCTAGTTTGGTTGTAAAAG
TAAAATCGGATGAGACGAGCCAGACACATCAGTGTATTATTAATAAATCGAAGTTCTCTT
TCAAAAAAATCCAAGTTTTTTTAAAAGCATGGCAAAAGAATTTTGCCTAATATATTTA
TGGAGTGGAAGATTGATAATAAATCAAAAGATTACATCAGCAAAGAATACATTAGGAGAA
TTTGCATACATGTTTCATTCTGCGCTAACAACTGGGACAACGACTTTGCTACTATCATTC
TGTTCGATTAGCTATATATATTCTAATGTACAGAAGTAACAGGCCGAGGCCGTCCAGTAA
CGTTCACTTTTTGTGCTTTAAAGAATGGGAAACAGTATAATCTCCACAGAAAAAAAAA
GCTAATAAACCCCAGCCACAAGCCGCAGTAGCCAGCCATACTGCAAGTTCTTCTCCTGC
ATGATACGGCCTCCACTCCACAGTCATCATCGGTCCTGCATCTGTGGGTAGGTAACACGT
CTGGTACATGGCATGCACTCTCCCACGGGGAGCCAACGCTTTGCCGGAAAATCGTTTCTG
GACAAACTTGAGACGACAATGCGCTCACACGGAAGGGTTGGCTGTCATCCTGAAGATAAG
TTTTTGGTATCATTGTTCATGCAAGTAAGGAGGAACTGGGAACA

>LOC_Os04g39430
TGTACAATTGTAGCTAACAAAACAGAATAGTAAGTGTAAGTACTCTCTCCATCTCATTTT
AAATATATTTGTGAAATTTTTGTTAAACGTTTATCTGTCTGTCTGATTTATTTTTTTATG
ATTAATATTTTTATTGTTATTATATGATAAAAACATAAATAATACTTTATGTATGACTTT
TTTATTTTTTCATAAAATTTTCAAATAAGATGGACGGTCAAATGCTGGATACATATACCC
ATAAATACACTTTAAATGAGACGGAGGAAGTACTCTTCTTGCGGTGGGCATAAGTAACAA
ATGCGAAATATATAAGAGAGTCAAGTCAGGACATCTGGTTGTGATAGTGATACGACGAT
GAATGCAGCAGTCAAGGTCCTAGGTGCGAGGACAACACCAAGTTTTTCTCCTTTCGTTTG
ATAGCATCAGGGCATCCTCAATCCACTTATATGCATATCTTCAATTCATATGTGCTTAGT
TTTCCTTATCCACCTATCCACTTAGAATTTTTCTGATTTAGTGAACTAAAGATGGCACAA
AGCCATTGTATATGTCCTCATAAATTCGATCACATATTCTAGTTACAATAGAATAGGAGT
AGAAGCAAATGGTATTTATAACTGAGACTTGAAGTTTAATCCAGTGGATTCTTTTTAAAG
TCCTACTCAAAGAAAGTTAATTGTTGGTGCTTGGTGTTGGGTACATTTTGGTGGCCATTG
TAGGAGTAGGTCTAATAATTGCCAGTAGAGGTAAGATTATACAGGGCGGGGAGGGTGGCA
GTGGTTGTCGGAGTTCCCCTGTTAGCAAGAGACCAGTTCCTGTTTGGTGTAAAATTTATA
CTTTGGCAAAACTAAAATATCGGTAAAAAAATGTATTACTGTAGAGTTTTAGAGGATAA
CTATCTTTAATGACAAGTTAAAAATGAATAACTATTTTCTCGGTGGTTTTCTACCGTTAG
TGCTACTATAATCACCGGTAGAAGAAATCTCTCAGTTGTTGATTTATAAATTCTACCACC
AATAGATAAAAACATTATACTAATAGTTAGGGTGGCAGTATAAATAGATAGGATCCAGT
AAAAAAAAGTCTAGATATCTATTATCAATAGAGACCATAGTAAAACACCTACTTCCTTCA
TCCCAAAATGTTGCTAGACAGATGATGTCCAGATTCATTGTTCTAGGATGGAGCAACATT
                              snp_4_23472861
TTGAGATGGAGGAAGTATAATGTATTACCCCGCAACCACTTGTTATACGAATGATTTGTA
```

GTATATATCTAGTTGAGTTAACTTGACACACTAAAACTTGAGCCATGCGCATATGCAATG
TTTATACATATTATAGCGTCGCAGGATTTTGATTATGTTTTAATGTGACTTTCTTTTCAT
              snp_4_23472700
GTTCTTATGAGATTGGATTGTTTGCACTTTCATTCTTCGTACACGTTTTTCGAACTACT
AAATGATGCGTGTTTTTTATAAAAAAAATATAGGACAGTTGCTTTGGAAAAAAATGTATT
AATCTATTTTTAAACTTTAAATAGTTAATACCCATTTTCTTTAATGGCTTATCTCGTATT
CTGTACTTCACAATCTTCTCATTTTCCTTCTCTCAAATACTCCATCCGTCCAAAAAAAAA
ACCCACTTCTGGGTTTGAATATGGACATAAGTGGTTTTTTTTTGGGAGAGTTACATGTTG
ACCTAGGACGACGAGATTGTGCATGCATGGGGAGACGTTTGACTTTTGAGCATAGCTCGG
CAAAGGCCGGCCAGATTGCTAGGGAGAAACAGGGCCAGGGGAGACATGACATATGTTGTA
              snp_4_23472273
CACTATACAACATCTTCAGAATTATGACAAAGCACACACAAGTCACCATAAAAAACACAG
ACAAACTGAAGTGAACAAGGCCAAATCGACCCCTGTTGCTGTAATTTTTGTCATGAAAAA
GAAGGGCTTTAGGAAATGACACAGATATGAGTCATCGAAGCAGGGGATCCCCAAGAACAG
ATTGCAAAGGCAAGGTGTGTGCGCGCGCGCATAAGCTTCATCAGATTCAGAGAGAGCT
TAATTATCACCGATGTCCCATGCATCGATCTGCACCTGGCTGTGCATGTACTACCCCAAT
GCATTTCTCTCTCTACCTGCGTGTTTGACTGCACCTTGAGCAGCAGCAGCAGCCTAGATG
CTAGCTACTCTGCATTGGACCATCCTCCTAGTCCTAGGCTGTAGGCTCATAGCCCTCCTT
GATAAAAGCTACTACTGGCACAGTATATGCATGCAGCCAATTCACTTCACTGCAGTAAAA
AAAAAAGAAAACAGAGAGAAACAGAGATCAAACAATGCAAGAAAGAAATACCCCTACTT
CTACTTTAAAACAAGGCCAAAGCAAGGAAACAAAAGGCAGCCTCTATTTTTTTCCCTCC
CCCCCCTGCTCATCACCCCTTTCCATCACTCCCTCCCTTTGCAAAGATCCTTCCTGCCTT
TGCTTCTACTGCTATATAGCCTCCCCCCTCACCTTCCATTCCAGAGAAAAATAGAGGGAG
GGAGAGGGAGAGAAGCAGAGTGTTGAGCACAAGCTAGTGAAAGGGTTAGATAGAAACTTG
GTAGAATAGACAGATAGGCAGAGAGAGAGAGAGAGCTTAGCAAGCTAAGGCTTAGCTGCT
GCAAGGCTCCATCCATGCTTCTTGTTGTGAGATGAGATTGAGATAAGATGAGCAGGGGGT
                             CDS Start
GGTGGTGCCTGGTGTGAGGCTATAGGTAAGATGGTGGGAGGAGAGCTTGTGCTGGCTGCT
CTGGTGATCCTGCTTGCTTTGCTGCTGACCCTGGTGCTGAGCCACTTCCTGCCTTTGCTC
CTGAATCCCAAGGCTCCCAAGGGAAGCTTTGGGTGGCCTCTCCTTGGTGAGACGCTGAGG
TTCCTCAGTCCTCATGCTAGCAACACCCTGGGCAGCTTCCTGGAGGATCACTGCTCCAGG
TAAATTAAAATCATATGCAGTAAACATTTCTATCAGTATCACCACCACAACCACACAGGA
GCAACAAGTGTCATCTTACCATGCAATTAAGTACTGTACCATTATTTCATGTGACAGCAC
AAGGTAATGCTGCTGTCCTGTCCCAGCAGCTTTATCACGCCCTTTTTTTTCCTCCCTGAT
GAGGGGGGTGCTGTAACATGAATTGGACAGTGTTTAGCATCTTGTTAAAGAGTTGTGCAA
ACCTTTTCTTCCGATGAACAAGCGAGAGAAAAGGAATGTAAAGGTTGCACAACACTTAAC
TAGCTAGCATGCATGGTGGTAGTAACACTGATGATGGTGTGATGATGATGATGCAGGTAT
GGGAGGGTGTTTAAGTCCCATCTGTTCTGCACCCCACCATAGTGTCCTGTGACCAGGAG
CTGAACCACTTCATCCTTCAGAATGAGGAGAGGCTGTTTCAGTGCAGCTACCCCAGGCCA
ATTCATGGCATTCTGGGCAAGTCCTCCATGTTAGTGGTCCTAGGGGAGGACCACAAGAGG
CTCAGGAACCTTGCTCTAGCACTGGTCACCTCCACAAAGCTCAAGCCCAGCTACCTTGGC
GACATTGAGAAGATTGCACTGCATATAGTTGGGTCATGGCATGGCAAGAGCAAGGACAAG
GGGATGGTCAATGTCATCGCCTTCTGCGAGGAGGCAAGAAAGGTTAGCAAGTGTACTAAC
TTGAAACCAGAGCCATATCACCACAAGGACATGATCCCTTGAAACAAGGGAGGGAAAACT
TTGCACATGTTAGCTACATACCATCATCATCATGTTGTTACTTGCTGCTGCATGAATCTT
TGTCCCAAGGTCACTTTGACTTACCATGGTCTTTTTTACCTTTTCTTTTTTTTCTCTCT
CTGGTGTGCTCTCTTTCCTTGAGAACCACAGTTTGCATTCAGTGTAATAGTGAAGCAGGT
GCTGGGGCTATCACCAGAGGAGCCGGTCACTGCCATGATACTTGAAGATTTCCTCGCCTT
CATGAAGGGTCTCATCTCTTTCCCTCTCTACATCCCAGGGACGCCCTATGCCAAAGCTGT
GCAGGCATGCAACTCAACATCTCATTTACACAAGTCGTTAAACTGTCAATAAAATTTTCA
GGCCATTTTATTTTTGTATACTTACCATAATAACTTCATCCTTTTGTCCGCGAATCCTCA
CAGGCCAGAGCGAGGATATCAAGCACTGTGAAGGGTATTATTGAGGAGAGGAGGAATGCT
GGCTCCAGCAACAAGGGTGATTTCCTTGATGTGCTGCTTTCAAGCAATGAGCTCTCTGAT
GAGGAGAAAGTGAGCTTTGTGCTGGATTCCTTACTGGGAGGATATGAGACCACCTCACTC
TTGATCTCCATGGTTGTGTATTTCCTTGGGCAGTCAGCTCAAGATCTGGAACTAGTGAAG
GTATACAGACTTCTCATGCTGAAAAAGACAGAGCAGTACTGGTAAATAAGTACTTAATTA

```
AGTGGCCATCAATAAAATATATATTAACATGTTTGCATGCAGAGGGAGCATGAAGGCATA
AGATCGAAGAAAGAGAAGGACGAGTTCTTGAGCTCTGAAGACTATAAGAAGATGGAATAT
ACCCAACATGTAAGATGATCGTTCAATACATGCTTTAGGATTAGTTAGTAAGCCAGGGGT
ACCTTTTTTCCTATTATCAGCAACTACACAAATATGTGACCCTCCGAATATGAGGTTTA
CTCATATTCAGAACGATTCTCCTATGCCTACCCATATATGCAATTTTTGAATTAAGCAAA
AAAAAGAAAAGAAACAGAGAGAGAAAGAATCTCATTACAATAGAGTGAAAAGGGCGGAA
GGGACATGTTCTTCAATAATGGAAACTGTATGATGATGCATATGCTATGCCCTTACAGGT
TATCAATGAGGCACTGAGATGTGGCAACATTGTCAAGTTTGTCCACAGGAAGGCTCTCAA
AGATGTCAGATACAAAGGTAATTAACCCTACTTGAGGCTTTCCTTGAAGATTCCATTGTG
CTCATCACATGATAATGGATCAGGCAAAGTGGATGGTTGCACCTTTATTACTGATTTTTA
AGCATTGTTATTCCTAAAATACCTCAGCTTTTCATAGAAGATGCTCAAAAGCAAGTGGCT
CTTTTTTCTTTGCTCTGTTGCAGAGTATCTGATTCCTTCTGGTTGGAAGGTCCTACCTGT
TTTCAGTGCTGTTCATTTGAACCCCTTACTTCATGGAAATGCCCAACAATTTCAGCCCTG
CAGATGGGAGGTACGTTTGTTTCCATAATCTGTGAATGCTCCGCAATACTTACTAAATGT
TTATTGTTAATGACCTAATGAAAAATGTTTTGGACCAGCTAGGCCACGAAGCTTAGCTTT
CACGTAGTATACTTTTCTATAATACAAATTTATAAAATGAAAGTTCAGAGCACCTATCA
AGAGAGCTTATCTGGAGCCTTGAAAGAATCTTCTTTAAAGGGTGTTCTCTAACTAATTGC
TACCTTTAATTAGTGAGCGCCCAACTATGACATAATTACTCGCAACTATTCTGGTGTCTT
CAGATGCCAAACAAGCTCCCTGTGGCTGCAATGCCTTTTGTGCATGGTCCTAACCATGAT
TCCTCTCATTCAAAGCCAGCATTCTTGGCTTTGCTTCCTTTTCTTAGTTTCTGTGATGAA
GCTAATGGTCTGATTCATGTGTGTTCCTAATCTGATTGATGCAACAGGGTGCAAGCCAAG
GGACAAGCAAGAAGTTTACGCCGTTCGGCGGTGGCCCCGGCTCTGCCCTGGATCAGAGC
TTGCAAAAGTAGAGGCTGCTTTCTTCCTCCATCACCTTGTGCTCAATTATAGGTAAAACA
AAAGGGTATATTTGTCCTACCCGAGTAGAAGATGCATGGATCAAAGTTGACTGGCTTAAA
CAGCAATGAACAAAATACGTTCAGAAGTAATATTTAAGAAGCTGGTGCAGAGTAGTTGGT
GTTTAAATAGGCCATAGAAAACTGTTGAGGCAAACATGAACAGGAAAACATACTGATGCA
GTTACCACTCTCATACTGATAATACACACTACACTAGACCACTAGTAAGTAATGGCAAGA
AGGCCATGACAGCAACTAGGCAAATTATTTATGCTTTTGTCTGTAAGGACCGCAAGTCTG
AACTCAGCTATCTTGTGCATTTTCATAAGTGGCACTGTAGAGCATAGAATCAGACGACAA
CACACAGAACAAACATGACAGCATGGAGTTTTCGATAGGTAGGCTATGCAAGTTGAGTTG
AGGGCTGCCATACAAGATAAAATATACTACCACGATATGATCAAACTCTTTTTTTTAAAA
AAAAAACTAGGTTCATTAGCAACAATCTATACGTGACAACTGACAAGAACAGGCAGATTT
ATGTAAATTATGCGGTTGTTTCAGAGTAGAGTCTACATGTACTTACTGAATATCCATGCC
AGAGAAAGGCTGATCATCGTTCTTCGTTTCTTTCGTTTCTTGAAAACCTGTGCAGATGGA
GAATCGATGGCGATGACATTCCGATGGCATACCCGTACGTGGAGTTCCAGAGAGGTCTGC
CCATAGAAATCGAGCCACTTTGCTCTGAATCCTGACAGGTTTGCAGTTGCAGCCACGGTG
AGCGAGTTCATCAAATCATCCCCGCAAGCGAGGGGGAGATGCGGGCGAGAACGACGGACT
GAGAGGATTAGTCAGTGAAACAAAAAAAGGAGAGAAAATATTTCAAGAACTGAAGAATG
CACTGAGCATTAGCTAGTAGTACCTATCAATGAGCCAAGCTGAGATTGTAATTTGCTGTA
CATGGTGTAGATATATTTGTCCATGCCGATTGCTTGCGGTGGTGGTGGTGCGGTGCTTC
ACCCTGTAACATCCTCCACTGTTTCAACTTTCATCTGCTATTCTATAGAAGAAAAAAAA
AGAAGAAAATTGGGCTATTGGGCTATTGAAAAGATTTTGGATGAAGCCAAAGATCTTCAA
AAACAAATCATTGAAACTTTGAAAGAGTACTCCTATCCTTTAATAATATGAACATGAACA
TGAACATGTATGGACTGTACTCTGCACTACTTCTCAGGGAATTTCGGAGCAGACAAATTC
GATCGTGGATAATCCCTATCAATCGGAGATGGCTGGTCCCGTTTGGATTGGAGGAATTTC
TGAAGGAATCCTTTCCTGCAGGGGAAATCTTAGTTTCAGTGTTTCTGGACTGAAGGAAAA
AACCGGACGAACAGCAGCATTATTCCATAAGAGTGGGAGTTCCCCCCCCCCCCCCCTCA
CATCGCTAGACGATTTCACGGGATAACAGTCCCCGAATCCACCACGCGTAACCTCGCCCA
GGATCGAGGCCGAATTCCAGCCGAAGCCGCGCCGCGCCGTCGTCCCCGTATCCAATCCAC
CGCGGCGTCGACTCTCCCGCCGTTGCGCCCGGCCCAACGCCGGCGGCGGTCCCGCCTCTA
GCGGCGCCCGCAGGATCATCTGCACACCCCGCGCGACACCGCCGCCCGCCATGCCCGCC
GCTCGAGCTCAACGTGAGAAGGGGAAGGGGAGAGAGATCATAGTATGAGAGGTTTACTGG
AGAGGATAAGTTAAAGAGAAAAAGGTATAAAAAGAAAGAAAGAGAAAGATCATAATAT
GATTTTTCTATGTTTTTTTACCAAAATTTTCGATGTTTATTTTTACCAGAATTTTCTA
TGTTTATTTTTACCAGAATTTTCTATGTTTATTTTTACCAAAATTTTCTATGTTTGGT
GGAGTAATCCTCAGTTTTTGCAGTCGTGTTGCTGTGTTTTCTTTTTTGCGCCTATATTCC
TGTGTAATTTGTATAGGGCATAAAGTTTGTCGGAACTTGGGATTATGTGGAACATAGCAT
```

FIG. 17 Continued 10

CGCATTGTTCAGGAATGAGGACTGCAATTTTGATCTTCGGGGATTTGATCTTGAAAAACA
TACGCACATACAAAATTGTATCACATTGTTCAGGACTCAGGATTGC

>LOC_Os11g35390
AGTTTCAGTTTCAGAGAGAGGAGTCAGTGGCTGTATGCTGCCATGGCTCTCAAGGTGGCT
AGATAGACAGACATGTTGCCCATCAACTTAAGAAGCAACTAGCTGCTGCTGCTGCTAAGG
GAGAGCTATAGGCTTAGCTGTGGTAGGCTATAGATATTACTATTAGGTAGCTACTAGCCT
        CDS Start
ATAGGCAGACATGGGGAGACCTCCATGCTGCGACAATGGCGTCGGCGTCAAGAAAGGGCC
ATGGACGCCAGAGGAGGACATCATCCTCGTCTCCTACATCCAGCAGCATGGCCCCGGGAA
CTGGCGCTCCGTGCCCGAGAACACCGGTTAGCCCCCCCCCCCTCCCCCTGGCTCTCGCGT
TTTCGATCCATTCGTCGTCGAATGATCGATATTGCATGTGTTTGATTTTTGCATGGTTGA
TATCAGAAGCTGTTTTAGTTATGCTTCTGTTGTTGTTTAGGAGTTGATGATAAGTTTGTT
                                                    snp_11_20737146
TCTGTTGTGTTTTTGTATGTGTTTAGGATTGATGAGGTGCAGCAAGAGCTGCAGGCTGC
GGTGGACGAACTACTTGAGACCGGGGATCAAGCGTGGCAACTTCACCCCTCATGAGGAGG
GGATCATCATCCACCTCCAGGCATTGCTTGGCAACAAGTAATCACGTACATAACTCAATT
TAAATAAATTGTTGTATCATATACATGAGCATCAAAATCTAATGGATGTTTTTAGTTTA
TTTTCTATCCTTGAAGAGATATATATACATCCGTACCACTCCGAGATAAAAAAAACTGTA
AATCAATTGAACTGATTAGAATTGACATTGTTAGAATTTTCCTGGTTCTTGGGATGAATA
AAATGTTTACTTTTATATGTGAATCTAGATGTAGATTATGTCCAGATTCATTTAAAAAAT
AGACTTATTTTATAACGGAGGGAGCATATAACCTCATAGTTTTACACGTAAGGTACATAC
CTCCTAACTAATACTCATACCTCTTAAAGATTGAAGAAAACGCCAACAAATATATAGGTG
AACTCCCAATCCTACTCTCATTTGTTATGATATTGGTTTTGGTACATCACTTCACAGATC
TTATATACCTCTGAACTCTAGTCCAAGAATGAAAGAAAACCTCTATGCACTCCTATATAT
TGTTTATAGTTTAAGCTTAGTTTATGATAACTCAAGCAAACCCTGACTTTCTGATGATC
ATCTGAACTTTTTCAAAATCATATTGTCTTTACCTTAATCATGCTTTACCTTTTGCATAT
ATTACATGACAGGTTATAACATACGCCCTCCGTCCCAAAAAACTCAACTTCTAGAGATTG
AATTTTGTCTAAAAAAAACAACTTCTATCATCCTACCTACTCTCAGTACGTAAAACGAGA
AGTTTTATCCCTTCAATACCCTTTACCTATCTATCTCTCTTACTACTTTTTTTCAATGAT
TATGGGTATTTTAGTCAATCTTCATCTCCACTATTTTGTCTTGGGATGTTAGGATTGAC
ATTTTTATGGGACGGAGAGAGTAGTGCCTAAATATTTATCTATTGTGCATGCAGGTGGGC
AGCAATAGCCTCCTACCTCCCCCAAAGAACAGACAACGACATCAAGAACTACTGGAACAC
ACACCTCAAGAAGAAGGTGAAGAGGCTGCAACAACAACAACAATCACACCCTGATCATCA
TCACCACCATTCCTTCCAAACCACCCCTTCTTCCTCCAATGCAGCAGCAGTAGCAACAAC
CAGCCCAAACTACTACAACCCTAACAACAGCAACAGCAACAGCAGCAATTACCTCCATAA
CAACAACCACAATCTTGAATCCATGCAATCCATGGCCACTGCACCTAGCAATGAGGCCAC
CACCATCCCCAAGCTCTTCCAGTTCCAGACATGGATGAAGCCATCACCAGCAACAACATC
ATCAGCAGCAACAGCTGCTGCAGGTAGCTGCTACAAGCAGGCCATGGCCATGCAGGAGCT
CCAAGAGGAGCAAGAGGGCTCTGCTGCTGCTGCAATGGCTTCTTCCATTGATGGCGT
CTCCAAGGACCAGGATTATCACATGTGTGCTGTGATCAGTGGTGATGACAAGTCGTCGTC
GTCGGAGATGATGACGGCTGCGGCAATGGCCGGCCATGGCGAGGCGGCCACGACGACCTT
CTCGCTGCTCGAGAACTGGCTGCTCGACGACATGCCGGGGCAGGCGGCCATGAGCGCCGC
CATGGATGGGTTCTTGGAGATCTCTGCTGGATACTGCTGTGCAGACCCTATCATGTTCTG
AACTTTCTGAACTTCTGATGATCATCTCAGCCTTAATTTCCCATATGAGTCTCTCTTTGC
TATAGGTTTCTTAATTTCACTGAGTTAATTTGCACTTGTACTAGCTGTTTGATGCTCTCT
CTCTCTCGATGATCTTGTGTTTCCGGTAATAAACCGTTGGTTTAATTTCCTCAAGAAAAA
GCAATCCACCTGGAAATAATCTGTTGGTTTGGAGAAATATTGTCAGTTCTCAAGGATGT
AATAAAAGGATTAAAGCTGCCATAATTCGTTGCCTGATATGCAATGTTCTTGTTGTTTTT
GGAGATGG >LOC_Os06g40780
ATGTAGTATATTTTTATTCTACTGGCTCTTGTACTGGATGTTGCTGCTGCAAGTGATCGA
    CDS Start

FIG. 17 Continued 11

TGCATGCATGAGAGTGATGAGCTGCTTCTGCTTGTTGCCTTCCTCACTTTGGGCATTTCT
CTCTCGCCTTCCTGTCCATTGCTGGCCTTATGTGAGGTTTTGCCAATACCTCTAATCATC
TCCTCTCTCACTTTCTCTCTCTCTTGATGCTACTACTGCCTTGCAGAGGCAGCAACAGGA
GAGAGTAGCAGATTCCTTTGTTGTTCTGCCCACAAGAGAGAACTCACAACTCACAAGTAG
TAGCAGTAACAACATCAGCAGCAGGTACTACTAGACCCACACACATGCAAGCACAGATAT
GAGTATATGATCTTTCTCCCATGCCACAAGTGAAAAGATTTCTCCCTCTCCATTATCCTT
TGTTTCCTTTTGCCTTTTGTATTGTTCTGAATGCATGCTGCTAGCTACTCCAGCTACTGG
TTGCTCTCTACACATGTGTGTATACAACTACACATACTATGCTTATTTGTACAAAATT
TTGTGCAGGGTTGGAAGCAAGGGATCTCTGCATGCTGTGGTTGCATGACACAGATGCACA
TGTCCCTTTTGGTGGGTAATGATGGGGTGCAGGTGGAGGTGATGATAGATTGCCTCATCT
GGGGACTGAGACATTCCATCCAAGGGTGCCCAATGCCATGCCCTCACATTCACTCACAGC
TAGTAGAGCTATCCCCCTCCCCTCCCCTCTTTGCAATATTCCATTTGTTTGCTAATGTGT
TGTATCAAGATGCCCTTGATGTGAGTGTTCACTGCCCTCTCTGTCCCTCATTTTTTGCAT
CTCTCATTCTCATGCATTGCATACCATGTACAACTACTGCTTCAGCTAGAATTGCATGTG
ATGTATATATATGATAGTATATCCTTTGCATCTCGGGAAATATGTAGTGCAAATCACAT
ATATAGTGGAAACTTGAAAACTACCGTTGAATCGAGAAATGGACGTCCGAGATTCGTCCA
CGTCATCATGAGTTAAAATTTAACTCGCAGATTCACTCATGAGTTAAAATTTTACTCGGA
GTTAAATTTTAACTCATGATGACGTAAACGAATCTCGGACGTCCATTTCTCGATCCAATG
GTAGTTTTCAAGTTTTCACTACATATGTGGTTTGTACTGTATATTTTCCCTTGCATCTCC
ATGTATCTCAAAAGTTACATGAGTGGCACTTGCTACTGTGCATGTAGTATGTGTAGCAGC
TAGGTTATAAATTTCTTTATGTGTAACATGTGTGTGATGCATAGTATATGCAATGTGAAA
CACTGACACAGCTAGACCAGGTGTGGGGGGTGTGCTTGTTCTTGTTGCAAGGAAGTTATC
                                                              snp_6_24312857
TGGAGGCCATCATCAATGAAGATCCCACCAAGGGACAAAACATGAGATGGTTGGAGACTT
GGGTCTGTCTAGTCTCTATTCAACCATTTAAAGCATTGCGTGTGTAGGCTACACTCGGAG
AGAGAACACAGAGCAGCCGTCCAAACCGTCTGAAATGATAACTTACTCTAAGCTAGTAGG
AGTGCTAGTAGTACCCTCTATATGTGCAATTTTATTCGTTAAAAAGGTTTCCATGCATGC
TTTTTTAGTTTATCAATAGCCTAAACCTTTTGAATTATTAAGAGTTAATTAGTCCCAAGT
GTGTATGATTACTCCCCCAAATTCTCTTTGTTTTCTTCGAAAAATTTGCAGTTATTTAAG
TGAGGTCCTCTCTCTCTCTCTCTCTCTCTCTCTCTTTGATAAACTGAGGTTCTCAAGTTT
CATGTTTTACCAATTAATCAATCCCAAGTAGGTTTTATTTTGTTGATTTAAGTCCTCGG
ACCTCAAGCCCTGAACATTCAATAATTTATCAAATTCAAGGACCTGCAGTTAGATAATTT
                                     snp_6_24313378
TTAGTTAATAGAAAAAAATATCGCATTTGTTGCAACGGGTGAAGACTATTTTAATCTTAT
TATTGTTATACGGTTTAGCTAGGGTAAAATTTACTCTAAAAATTCGTTTGAACTTTTTTT
AAAAATGTCATGAGCTACAATTAGGAGTTTGACTTTCGTCACAAGTTAGCATGCAAGTTT
TTTTAAATATATTTCTTATACGACTCCTTTTGTATTTTCAAAAGTGAACAAACATAAAAG
CTAACTCAAACACAAATCTATATTTGCAAAAGCGAACGAAATTAAAAACCAGCTCAAACA
AGAATGACATACAAAGTACTGACAAAAACATATTTAATTTTTATAATAGTAGAGATATGA
GTAAAAGGGACCAAAATCAACAAAGCAAATAGTGGAGAGCCGGAATCAACACTGTCTGAC
TTGGTGAAGATCTCAATTACACAAAATGAATGCTTTAAAAGGATCATTTAATTAAAGAA
ATACCAAATATATAATAATAGCTAGTACCATCATATTATATATACTCCCTTTGTCCCTGA
AAGAGTATTATCCAGATTCATTCATAGCTAAAATACACTCTTTTAGAGATGGCCGGAGT
ATCATTATATGTCTATAGCATATACTTCTACTTAACATATATAAATACATACTCCCTCCG
CCCTAAAATAAGTGCAGTTTTGCACTATTCACGTTCAACGTTTGACCGTCCGTCTTATTT
GAAAATTTTTTATGATTAGTATTTTTATTGCTATTAGATGATAAAACATGAATAGTACTT
TATGTGTGACTAAATGTTTTTAATTTTTTATAAATTTTTCAAATAAGACGGACGGTCAAA
CGTTGAACGTGAATAGTGCAAAACTGCACTTATTTTGGGACGGAGTTAGTACATATATAT
ACACATTACACATTGCATACATAAACATACAACCACACTGCCCTCTAGCTATACACATGC
CATGATGCCAAGAGCCAATGATCACCACCCAAATCCTTCTAGCAATAGCTCCCTATGGCA
CAAACAGTCACAGCTGCACAAACACACACACACACACATATCACCCATTCATCTACTC
TAGCTAATCTAAAGGCACTAGCATAGTACTACAATCAACCAGTAGTAGTAGCCCTCATTT
GCATGTTTTATTTCGCCCACCAATCCTTGGAATGTTTTAGATTCCCCCCTCTCACTCTC
TCATCAAGGAATGAGCATCCCCCATTCTCCCCCAACCCCTCATATTTTCAGTTTCTCACT
CTACCTTTCCCCTCCTCCCCTAGCTAACCCCTCTCTCTTTCTCTCTCTAAAGCTCCAATC
TTTCTACCTTTCTCTCTCTAAAAGCTGGAGTAGCTTAATTTCTTTCTTTCTTTTTCTTTC FIG. 17 Continued 12

```
TCAGCTGGGATTGCACAGTGAAGCTAGGGAGAGGCTATAGCTATGGGGGTGATGTAGCTG
GGCAGTGAGGCTAGTGACAATCTCTCTCTCACACACACACACACAAAAACACTTGTGTAT
TTTTGGCAGATGATGTCCTGTCAAGGAAGCTGCAATTGCAAGCCCAGATGTTGGACGTGC
ACGCTCGCCCTCCCTATTAAACCCGCCCTCCTCCGATGCTCCCTCTCCTCCTCCCCCCTC
GCCGCCGCCGCCGCCACCTTCTCCGGCAGCTCACCGTCGTTGTAGTAGCTCTGGTGGTGG
TGGTGGTGACGACGACGGCTACGGCGGCGGCGACGGCATGCTCCGGTCACTCCACTCCTC
GTCGTCTTCTGACACGGATAACAACAGCGGTGGCTGCAAGAACAATGGCGGCGGCGGTGG
CGAGGCCGCCGCCGCCGTTGAGGGTGGCGGTGATCAGCGTGCCGTTGCGGCGGCGGCGCC
GTCGACGCGGGACTTGCTGCTGGCGTGCGCGGACCTGCTGCAGAGGGGGGACCTGCCGGC
GGCGAGGCGAGCGGCGGAGATCGTCTTGGCGGCGGCGGTCGCCGCGGGGCGACGCGGC
GGACCGCCTGGCGTACCACTTCGCCCGCGCGCTGGCGCTCCGGGTGGACGCCAAGGCCGG
CCATGGCCACGTCGTCGTCGGCGGCGGCGCGGCGCGGCCGGCGTCGTCCGGGGCGTACCT
GGCGTTCAACCAGATCGCGCCGTTCCTGCGTTTCGCGCACCTCACGGCGAACCAGGCCAT
CCTCGAGGCCGTCGACGGCGCGCGCCGCGTCCACATCCTCGACCTCGACGCCGTCCACGG
CGTGCAGTGGCCGCCGCTGCTGCAGGCCATCGCCGAGCGCGCGGACCCGGCGCTCGGCCC
GCCCGAGGTCCGCGTCACCGGCGCCGGCGCCGACCGCGACACCCTCCTCCGCACCGGCAA
CCGCCTCCGCGCCTTCGCCCGCTCCATCCACCTCCCCTTCCACTTCACCCCGCTCCTCCT
CTCCTGCGCCACCACGGCGCCCCACCACGTCGCCGGCACGAGCACCGGCGCCGCCGCCGC
CGCCTCGACCGCCGCCGCCGCCACTGGCCTCGAGTTTCACCCGGACGAGACGCTCGCCGT
GAACTGCGTCATGTTCTTGCACAACCTGGCCGGCCACGACGAGCTCGCCGCGTTCTTGAA
GTGGGTGAAGGCCATGTCGCCCGCCGTGGTGACCATCGCCGAGAGGGAAGCAGGCGGCGG
CGGCGGCGGCGGCGACCACATCGACGACCTGCCGCGGCGGGTCGGGGTGGCCATGGATCA
CTACTCGGCGGTGTTCGAGGCGCTGGAGGCGACGGTGCCGCCGGGGAGCCGGGAGCGCCT
CGCCGTGGAGCAGGAGGTGCTGGGCCGGGAGATCGAGGCCGCGGTGGGGCCCTCCGGCGG
CCGGTGGTGGCGCGGCATCGAGCGGTGGGGCGGCGCCGCCCGCGCCGCGGGGTTCGCGGC
GCGGCCGCTCAGCGCGTTCGCCGTGTCGCAGGCGCGGCTGCTGCTCCGGCTGCACTACCC
GTCGGAGGGCTACCTCGTGCAGGAGGCGCGCGGCGCCTGCTTCCTCGGGTGGCAGACGCG
CCCGCTGCTCTCCGTCTCAGCGTGGCAGCCGTCGTCGTCGTAG
```

According to a specific embodiment, the OsTPR protein sequence is:

```
>OsTPR
MPLFMSEEELRLLGGDVAAVAERADAAIRELRQQVDTVRAEADAAAIAAEQTCALLEQRY
DTLSAEADRFRAELAELAAASERRAADLASSQSEIHQLRIQAIAKDGEIERLKVEISEVH
KSKSQSLELIEQRDAEIREKDGIIQNYLDKIVNLADSSASKGARIQEVEAKFTHLQATCN
RITQEKDLLEKHNLWLDEELKEKVKNLAELRKSNMDEEARMSAKVAELERETSESSSSLR
RSKERVSELEQRVSYMEKELCSTKDAAAANEQRLAAELSTVMKLAELHKESSEEWSKKAG
ELEGVIKALETHLTQVEDEYKEKLEKETSAKRDLEMEATYLKQKLEKCESDLENTRKSSE
LSFTPLVAADPCDLAGSPMKEMAFSDPANQNDLMIVPKVPTGVSGTALAASLLRDGWSLA
KIYEKYQEATDALRHERFGRRHAEAVLERVLHEIEEKAELILDERAEHRRMVEAYALMDQ
KLQQALLEHDNFENTIRNLKSELKRRERDHSIAQKEIDDLQKQIKLSIYLTFAPTQACIL
GVCTSKNYYDINGNHCGAVLKIAVLLKECQDIQLRCGSSLPNVGDGALSTSTSTGVPEVE
NNIHEHMTFNDINGLVQQNVQLRNQVHLLSADLDKRDMELRESFQIELKKITDDAASRVE
                  snp_02_31026954
KVMKKSEEQAIMIESLHRSVAMYRKLCEEQQKSRSNVEHIPKNLEDDGRKDLMVLFEGSQ
EVSRKAYEQVSERAKSLDEELTKLRTELLSLRSERDKAVLEAEFARERLNGFTAELEHQR
                          snp_02_31024549
KEANSISLRNAELMHLVVDYEKRLRENSESMKAVEENSRKLLMEMSILKNEKEILAKSEK
KALEEVHDLTTRVHRLQATIDTIHATEEVQENARSIERRNQEEYIKRLERDWAEVKKELQ
                               snp_02_31023080
EQRDHVRVLTLDKKNAFDGCLKQVEDMRKELQNSWKAATDAESRAAVAEAKCSDLETKLK
SRKENDELFQLKEELEKYKEEAQANKSYMLQYKEIANSNESALKQMESALQDFKTESETI
KKSLEDEITKLRTKISELEKCYIMKCEEAASAIEAKEKDTTSLMKEISVLRNEVSEKVIQ
IEKLETELASSKRALDEQYKRWRSAQDNYERQVILQSETIQELTSASKELSSLQQEIIVL
         snp_02_31019010
```

FIG. 17 Continued 13

RQTVETQKAENDGLRTLGEQEKIELVKGKDEALQKYNELNDQNKILHNQLEALHIRLAEK
ERNIAGLSSQRIDSHGEDDLHSVIGYLRRSKEILESALKSTKEAQDLLRSQTDSARTSML
KDEEFKSLQFQLVFFCIKNALPQVRELNLLRESNIQLREENKHNFEECQKFHDEAQKAKM
EAERLHNLLLEKQVDAEICKKEIEMQKTEIANLNQKISELVENSRGVDLSTYETMKDELQ
                                                          snp_02_31013745
NIKATLRENSAELERTKKLLSEKDSVIRNLEEKLAGCQSELDAREKKLNDVEASLKSEID
RHRKININIKRKLDASAKEKEELTKEKQSLSKQLEDLKSSQKTTTENSNEQAIKEKDFRI
QTLEKVLEKERDDNKKEKAFRRRNEKVFTTAIQNMNQERKQVEESIEKHRQAVKEVIEHY
TGISSQIPSGSAIDEQLRSYFLAIKAVEESPSPFQDGAASQTPSVESADVDASAATAGRQ
VATPPRPAQVKVVEERAVSTLPKPSTEVRRPGGRRPLVRPSLERVEEPQADIDTTVVEGS
TEKGGLLMERETPGGVSALQPSSRKRLIPSPQTRDDASQGETTDANPPLKKPKEGSSQCT
SELKTEQSPHEDVMAPVPVLPSTELDEQQPGEEMDTDQSSLPVEEVEETREDDLGDKDDM
 snp_02_31010249
ETHIDASMDIQGQDAETGIDNDATTVEDVPVKSEAVMESLEEDLKTEDGKEEGQFTATTD
VEDEREEGELPDEPEQPDSTPPVLDVGEQAGDSFRAASPAGPTEKSDVDMPEETGEGDGT
MESDQSPVPQSGGADASPSQMADASPSPAREPSPNPVQAGAPPEQQNPTPPNPVQAGASS
EQQNPATAAEGVETRSTRTINLTERARQNRQARILRSATQQNARGRGNQSLTYRKDGGRG
TRGRGGRGQS FIG. 17 Continued 14

METHODS OF ENHANCING GRAIN YIELD, PLANTS AND PRODUCTS GENERATED THEREBY

RELATED APPLICATIONS

This application is a Continuation of PCT Patent Application No. PCT/IB2020/055840 having International filing date of Jun. 21, 2020, which claims the benefit of priority under 35 USC § 119(e) of U.S. Provisional Patent Application Nos. 62/926,585 filed on Oct. 28, 2019 and 62/864,548 filed on Jun. 21, 2019. The contents of the above applications are all incorporated by reference as if fully set forth herein in their entirety.

SEQUENCE LISTING STATEMENT

The ASCII file, entitled 90442SequenceListing.txt, created on Dec. 21, 2021, comprising 47,024,652 bytes, submitted concurrently with the filing of this application is incorporated herein by reference.

FIELD AND BACKGROUND OF THE INVENTION

The present invention, in some embodiments thereof, relates to methods of enhancing grain yield, plants and products generated thereby.

Altering the panicle architecture of rice was a major breeding target to improve grain yield during green revolution (Zhu et al., 2013). Compact dense panicle with more primary and secondary rachis branches was preferred, resulting in more number of grains and thus increased yield (Sweeney and McCouch, 2007). Rachis branching pattern in rice mainly depends on the inflorescence meristem activity abortion. Also, delay in rachis branch meristem conversion into terminal spikelet meristem, and next order rachis branch formation lead to an altered number of secondary rachis branches (Ikeda-Kawakatsu et al., 2009).

Molecular genetics mechanisms underpinning rice panicle architecture identified yield-enhancing genes that were functionally validated using mutants or the transgenic approach (Ying et al., 2014). Genes belonging to growth-promoting hormones and transcription factor families were characterized, which influenced rachis branching and the number of grains in a panicle (Xing and Zhang, 2010). Such genes affecting the rice panicle architecture include MOC1 (Li et al., 2003), FZP (Komatsu et al., 2003), Gn1a (Ashikari et al., 2005), APO1 (Ikeda-Kawakatsu et al., 2009), DEP1 (Huang et al., 2009), SPL14 (Miura et al., 2010), LAX (Tabuchi et al., 2011), SPIKE (Fujita et al., 2013), TAWAWA1 (Yoshida et al., 2013), PAY1 (Lu et al., 2013), FUWA (Chen et al., 2015); Ghd7 (Weng et al., 2014), OsNAM$_{1 2.1}$ (Dixit et al., 2015), GRF4 (Sun et al., 2016), and DWARF11 (Wu et al., 2016) among others.

Increase in grain number targeted through more secondary rachis branches can create a tradeoff between yield and grain quality (Mohapatra, 2013). Inferior grains (in the lower part of the panicle) formed due to secondary rachis branches have inordinate protein content, poor palatability and reduced milling quality due to high chalk as compared to the grains located on the primary rachis branches (Matsue et al., 1994; Matsue et al., 1995). Paradoxically, the number of secondary rachis branches is more important for yield than the number of primary rachis branches (Adriani et al., 2016). Increase in the number of grains on upper secondary rachis branches can improve grain quality including lower reduction in grain weight (Wang et al., 2008). The trade-off between yield-enhancing factors and maintaining better grain quality must be considered to ensure wider adoption of high yielding rice varieties (Das et al., 2018). Genes that increase the number of secondary rachis branches bearing grains that are not compromised for quality traits are thus desirable for a meaningful increase in yield.

SUMMARY OF THE INVENTION

According to an aspect of some embodiments of the present invention there is provided a method of enhancing grain yield of a Gramineae plant, the method comprising:
(a) crossing a recipient plant with a donor plant comprising a sequence variation in a TPR allele, the sequence variation imparting enhanced grain yield; and
(b) selecting a progeny plant of the crossing comprising the sequence variation by identifying said variation, the progeny plant being characterized by an improved grain yield relative to the recipient plant.

According to an aspect of some embodiments of the present invention there is provided a method of enhancing grain yield of a Gramineae plant, the method comprising:
(a) crossing a recipient plant with a donor plant comprising a TPR allele of haplotype I; and
(b) selecting a progeny plant of the crossing comprising the TPR allele of haplotype I by identifying said variation, the progeny plant being characterized by an improved grain yield relative to the recipient plant.

According to some embodiments of the invention, the recipient plant is heterozygous for the sequence variation or haplotype I.

According to some embodiments of the invention, the recipient plant is null for the sequence variation or haplotype I.

According to some embodiments of the invention, the selecting is based on phenotypic screening for a grain yield- and/or grain quality-associated trait.

According to some embodiments of the invention, the selecting is by marker-assisted selection.

According to some embodiments of the invention, the marker-assisted selection is by a method selected from the group consisting of: allele-specific hybridization; Southern analysis; Northern analysis; in situ hybridization, deep-sequencing; and hybridization of primers followed by polymerase chain reaction amplification of a region of a marker.

According to some embodiments of the invention, the method further comprises:
(c) backcrossing the one or more of selected progeny plants to produce backcross progeny plants; and
(d) selecting a backcross progeny plant comprising the sequence variation or haplotype I, the progeny plant being characterized by an improved grain yield relative to the recipient plant.

According to some embodiments of the invention, (c) and (d) are repeated one or more times.

According to some embodiments of the invention, the donor and/or recipient plant is a rice plant.

According to some embodiments of the invention, the recipient plant is a rice plant selected from the group consisting of: the *indica* rice group; the *japonica* rice group; and the *glaberrima* rice group.

According to some embodiments of the invention, the donor plant is a rice plant of the *indica* rice group.

According to some embodiments of the invention, the recipient plant is a rice plant of the *indica* rice group.

According to some embodiments of the invention, the recipient rice plant is of a variety comprising a sequence variation in a gene selected from the group consisting of D11, MOC1, and MYB4P.

According to some embodiments of the invention, the method comprises breeding the recipient plant, donor plant or progeny plant to comprise a sequence variation in a gene selected from the group consisting of D11, MOC1, and MYB4P.

According to some embodiments of the invention, the recipient plant or the progeny comprises a sequence variation in a gene selected from the group consisting of D11, MOC1, and MYB4P is show in Table A.

According to some embodiments of the invention, the grain quality-associated trait is selected from the group consisting of amylose content, chalkiness, gel temperature, viscosity, retrogradation, and cooking traits such as the cooked grain length or width.

According to some embodiments of the invention, the grain yield is manifested by at least one of TSP, USRB and head rice yield.

According to an aspect of some embodiments of the present invention there is provided a plant obtainable according to the method as described herein.

According to an aspect of some embodiments of the present invention there is provided an elite line of a Gramineae plant comprising a sequence variation in a TPR allele or a haplotype I, the plant being characterized by an improved grain yield as compared to a control plant.

According to some embodiments of the invention, the recipient rice plant comprises a sequence variation in a gene selected from the group consisting of D11, MOC1, and MYB4P.

According to some embodiments of the invention the plant is a rice plant.

According to an aspect of some embodiments of the present invention there is provided a part of the plant (e.g., seed, grain) as described herein.

According to an aspect of some embodiments of the present invention there is provided a processed product comprising DNA of the plant as described herein.

According to some embodiments of the invention, the sequence variation comprises at least one SNP selected from the group of SNPs shown in FIGS. 15-16.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWING(S)

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIG. 1 is a scheme showing correlations of multiple panicle traits. Correlations of primary rachis branches (PRB) and secondary rachis branches (SRB) at different panicle levels (bottom: BPRB, BSRB; middle: MPRB, MSRB; upper: UPRB, USRB; entire panicle: TPRB, TSRB), and total number of spikelets (TSP) per panicle of 310 resequenced *indica* accessions with colored boxes (shades of green) significant at 95% confidence level.

FIGS. 2A, 2B, 2C and 2D shows significant genetic variants in chromosomes 1 and 2 that are associated with USRB. (A) Manhattan plot depicting results of EMMAX associations tested across 12 rice chromosomes revealed significant peaks of multiple SNPs (lightgreen highlight) from chromosomes 1 and 2 associated to USRB rising above the suggestive line threshold (blue line) at q<0.0500 and p<1.5314E-05. (B) Quantile-quantile plot showed samples were unrelated and the sample population was normally distributed with evidence of inflation factor (0.95) less than 1.03 threshold. (C) Barplot depicting negative logarithm of the p-values and corresponding beta values (thicker bar: higher beta value, black color: positive effect; red color: negative effect) of tag SNPs belonging to different haplotype blocks within the significant region in Chromosome 2 associated to USRB. (D) USRB variation of the *indica* samples as explained by distinct haplotype blocks represented by tag SNPs within the significant region in Chromosome 2 associated to USRB based on GWAS results. Asterisks in boxplots indicate significant difference using two-tailed t-test (*P<0.05, P<0.01, *P<0.001, ****P<0.0001).

FIG. 3 shows phenotypic variation explained by significant nonsynonymous SNPs of OsTPR possibly regulated by important flower-related transcription factors, and allelic variation of OsTPR among *O. sativa* subgroups. Haplotypes formed with an upstream SNP overlapping flower-related cis-motifs (SPL3 and SPL14) in the promoter region of OsTPR plus six nonsynonymous genic SNPs of OsTPR revealed superior allele (AGGATCA, SEQ ID NO: 1) explaining higher branching-related traits and spikelet number but lower percent chalkiness, as compared to other alleles such as TATTCGG (SEQ ID NO: 2), TATACCG (SEQ ID NO: 3), and TATTCCG (SEQ ID NO: 4) which showed lower TSP and branching-related traits. Haplotype TATTCCG also showed highest chalkiness percentage among other haplotypes. Asterisks in boxplots indicate significant difference using two-tailed t-test (*P<0.05, P<0.01, *P<0.001, ****P<0.0001). The superior haplotype AGGATCA was also found to be enriched within *indica* subspecies while one of the inferior haplotypes, TATACCG (SEQ ID NO: 3), was abundantly present in *japonica* and other rice subspecies found in the 3,000 rice genomes in SNP-Seek Database. Panicle architectures of lines with high USRB (HUSRB, SEQ ID NO: 5) are present above the panicle architectures of lines with low USRB (LUSRB, SEQ ID NO: 6).

FIGS. 4A, 4B and 4C show nucleotide diversity calculation among different rice subgroups using OsTPR SNPs. Nucleotide diversity values were higher in *indica* subgroup compared to *japonica* or aromatic subgroups from SNP-Seek Database using either (A) the index SNPs from whole LD block significant region in Chromosome 2 where OsTPR was located, or (B) the seven significant SNPs of OsTPR. (C) Phylogenetic analysis of 13 crop species using OsTPR protein orthologues showed closer relationship of *Oryza sativa* subsp. *indica* to *O. nivara*, while *O. sativa* subsp. *japonica* was more related to *Oryza rufipogon*.

FIG. 5 shows an association network of SNPs with different branching-related traits and spikelet number of *O. sativa* subsp. *indica*. Multiple SNPs were significantly associated (P<0.05) to secondary rachis branches (SRB) at different panicle levels: bottom (BSRB), middle (MSRB), upper (USRB), and entire panicle (TSRB); total primary rachis branches (TPRB); and total number of spikelets (TSP) of *indica* samples based on multi-locus GWAS (blue nodes) and targeted association analysis (red nodes). Most common SNPs were found in OsTPR (pink edge) and reported genes related to panicle architecture such as DWARF11, MOC1, and TPR genes. Edge associations were based on beta-effects.

FIG. 6 shows a comparison of superior and inferior lines in terms of traits related to panicle architecture, yield, quality, and grain appearance as explained by different haplotypes of D11, MOC1, MYB4P and TPR. Superior lines (green) have TSP 1.5 times higher than the mean TSP (147.59) of all the 309 lines while inferior lines (orange) have TSP 1.5 times lower than the mean TSP. With some exceptions, superior lines usually had the superior alleles of the four prominent genes—D11, MOC1, MYB4P, and TPR—regulating panicle architecture traits based on slGWAS, targeted association analysis, and mlGWAS, while inferior lines possess at least one inferior allele of the aforementioned genes. Spirographs further showed distinction of the superior and inferior lines in terms of different sets of traits related to panicle architecture, yield and quality phenotypes with values normalized using common logarithm. Rootless phylogenetic tree constructed with D11, MOC1, MYB4P, and TPR significant SNPs showed unclear relationship of inferior and superior lines.

FIGS. 7A and 7B show coexpression analysis results. (A) Hierarchical clustering dendrogram and gene regulatory network derived from genes involved in different panicle developmental stages (>1 mm, 3-5 mm, 10-15 mm, 40-50 mm, and heading stage). (B) Network of genes co-expressed in the module containing the candidate gene OsTPR reflecting interactions at edge weight >=0.30089 with node sizes representing the degree of connectivity and the central hub gene marked with thick black border. OsTPR was found to be strongly coexpressed with multiple known genes related to panicle development such as D11, MOC2, LAX, SPL14, and APO2, among others.

Figure 10:
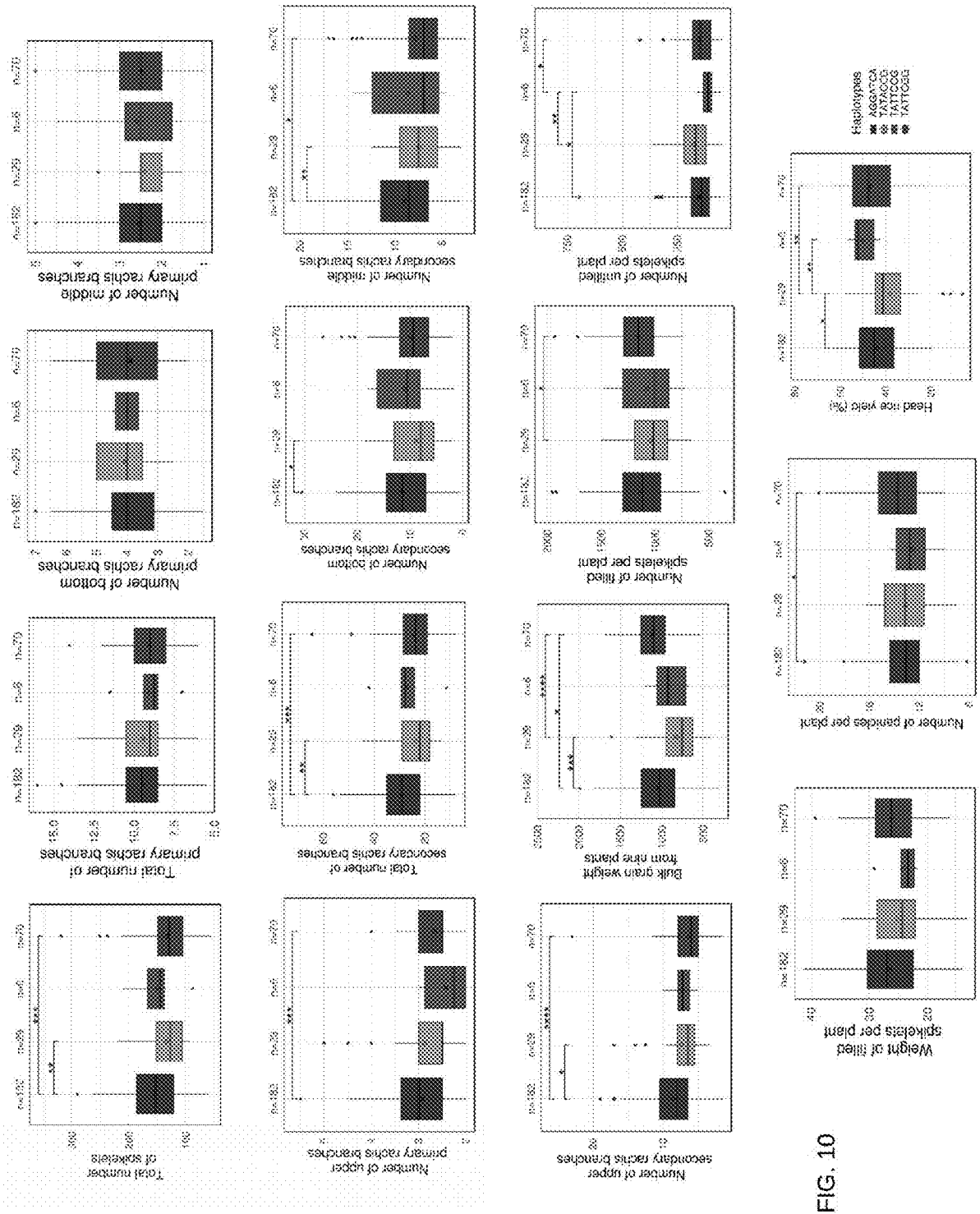
Figure 10:
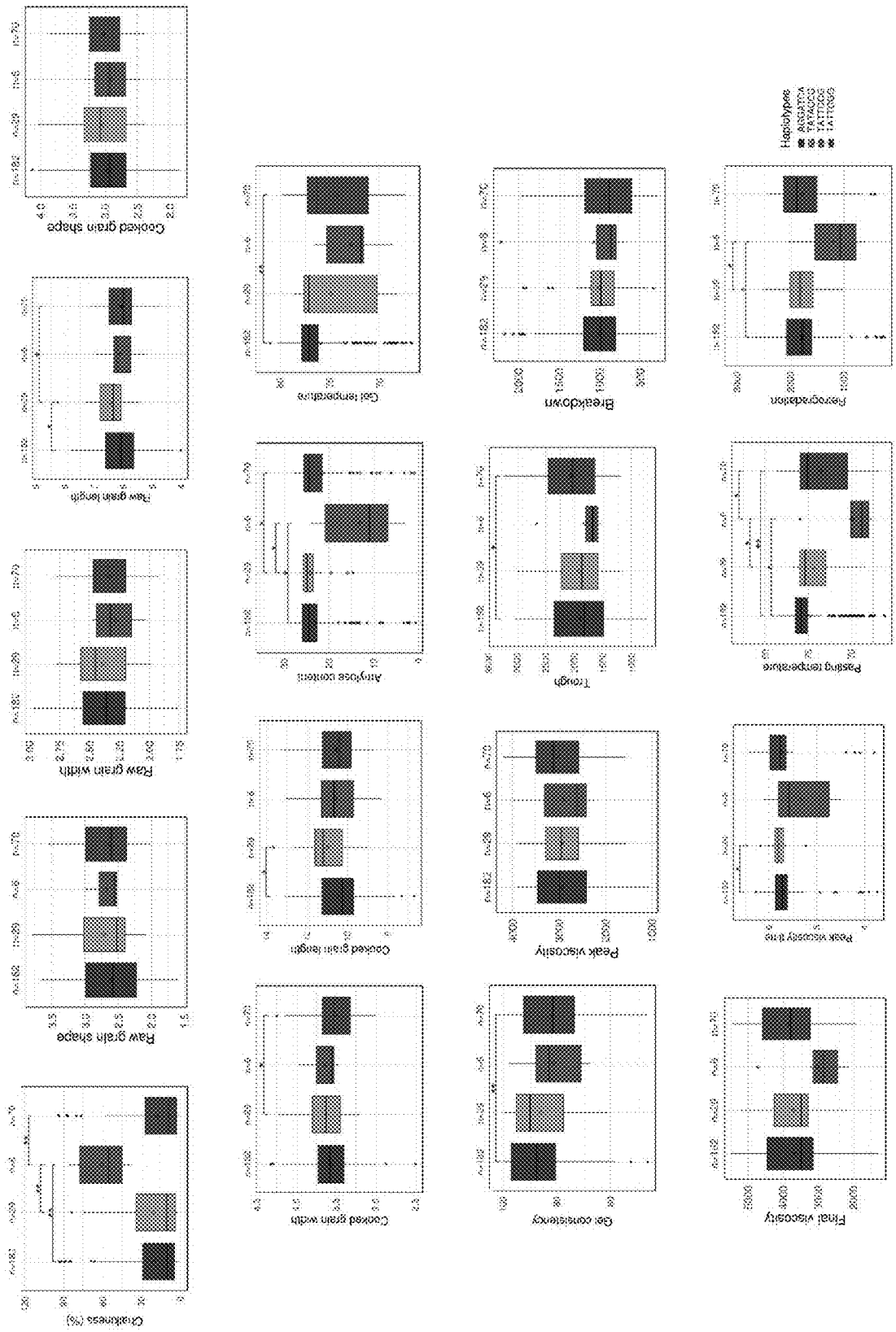

FIG. 10 shows phenotypic variation of the *O. sativa* subsp. *indica* samples as explained by OsTPR haplotypes in terms of panicle architecture, grain yield, and grain quality traits. Apparent tradeoffs and differences were observed between superior and inferior haplotypes in terms of the number of panicle components, number of panicles per plant, grain filling attributes, grain weight and some grain quality traits. The superior haplotype, AGGATCA, also showed high number of spikelets and branching-related traits and low chalkiness, whereas one of the inferior haplotypes, TATTCCG (SEQ ID NO: 4), had low number of spikelets and branching-related traits and very high chalkiness. Asterisks in boxplots indicate significant difference using two-tailed t-test (*P<0.05, P<0.01, *P<0.001, ****P<0.0001).

FIGS. 11A, 11B, 11C and 11D show D11 and MOC1 significant SNPs explaining phenotypic variation and correlations among *indica* samples, and their allelic abundance among different *O. sativa* subgroups. (A) Phenotypic variation in terms of traits related to panicle architecture, head rice yield, and chalkiness of *O. sativa* subsp. *indica* samples as explained by D11 and MOC1 haplotypes formed by significant SNPs. Asterisks in boxplots indicate significant difference using two-tailed t-test (*P<0.05, P<0.01, *P<0.001, ****P<0.0001). (B) Percent allelic abundance of D11/MOC1 haplotypes among different rice subgroups from 3,000 rice genomes in SNP-Seek Database. (C) Different sets of correlations for multiple phenotypes of *indica* samples having specific combinations of superior ($AAT^{D11}$, $CG^{MOC1}$) and inferior ($GGC^{D11}$, $GA^{MOC1}$) alleles from D11 and MOC. Shaded boxes (green: positive correlation; violet: negative correlation) significant at 95% confidence level. (D) Gene structures of D11 and MOC1 highlighting the significant SNPs used to form the haplotypes.

FIGS. 12A, 12B, 12C and 12D show TPR and MYB4P significant SNPs explaining phenotypic variation and correlations among *indica* samples, and their allelic abundance among different *O. sativa* subgroups. (A) Phenotypic variation in terms of traits related to panicle architecture, head rice yield, and chalkiness of *O. sativa* subsp. *indica* samples as explained by TPR and MYB4P haplotypes formed by significant SNPs. Asterisks in boxplots indicate significant difference using two-tailed t-test (*P<0.05, P<0.01, *P<0.001, ****P<0.0001). (B) Percent allelic abundance of TPR/MYB4P haplotypes among different rice subgroups from 3,000 rice genomes in SNP-Seek Database. (C) Different sets of correlations for multiple phenotypes of *indica* samples having specific combinations of superior ($AGGATCA^{TPR}$, $A^{MYB4P}$) and inferior ($TATACCG^{TPR}$, $G^{MYB4P}$) alleles from TPR and MYB4P, respectively. Shaded boxes (green: positive correlation; violet: negative correlation) significant at 95% confidence level. (D) Gene structures of TPR and MYB4P highlighting the significant SNPs used to form the haplotypes.

Figure 13:

FIG. 13 shows phenotypic variation of the *O. sativa* subsp. *indica* samples as explained by D11, MOC1, OsTPR, and OsMYB4P superior and inferior haplotypes in terms of panicle architecture, grain yield, and grain quality traits. Superior lines (green) have TSP 1.5 times higher than the mean TSP (147.59) of all the 309 lines while inferior lines (orange) have TSP 1.5 times lower than the mean TSP. Although with some exceptions, superior lines usually had the superior alleles of the four prominent genes: D11 (AAT), MOC1 (CG), MYB4P (A), and TPR (AGGATCA), while inferior lines usually had inferior the alleles. Compared to inferior lines, the superior lines had significantly higher number of spikelets and branches, grain weight and grain filling without substantial changes in head rice yield and grain quality traits such as chalkiness, cooked grain dimensions, amylose content, gel consistency, trough, final viscosity, and retrogradation. Tradeoff in the number of panicles per plant was observed in superior lines relative to inferior lines. Asterisks in boxplots indicate significant difference using two-tailed t-test (*P<0.05, P<0.01, *P<0.001, ****P<0.0001).

Figure 14A:
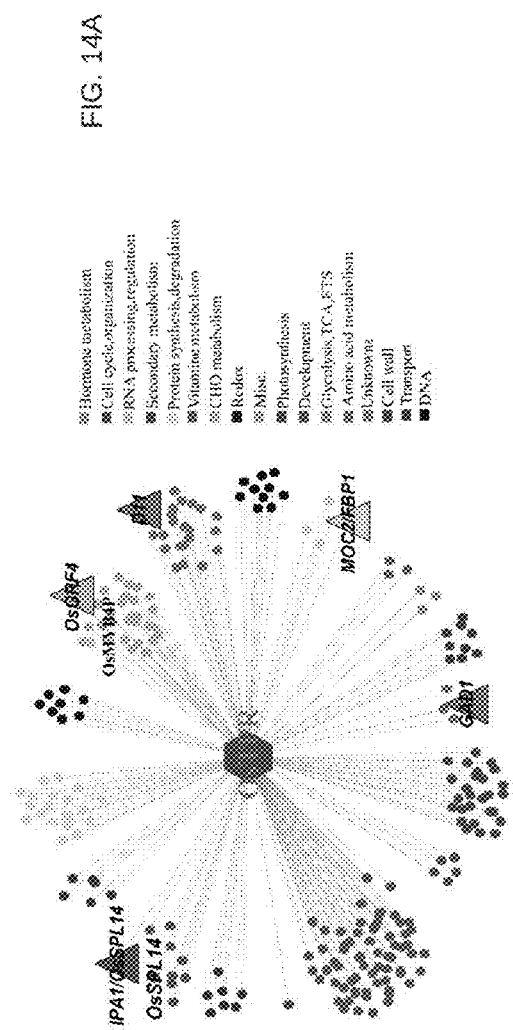
Figure 14B:
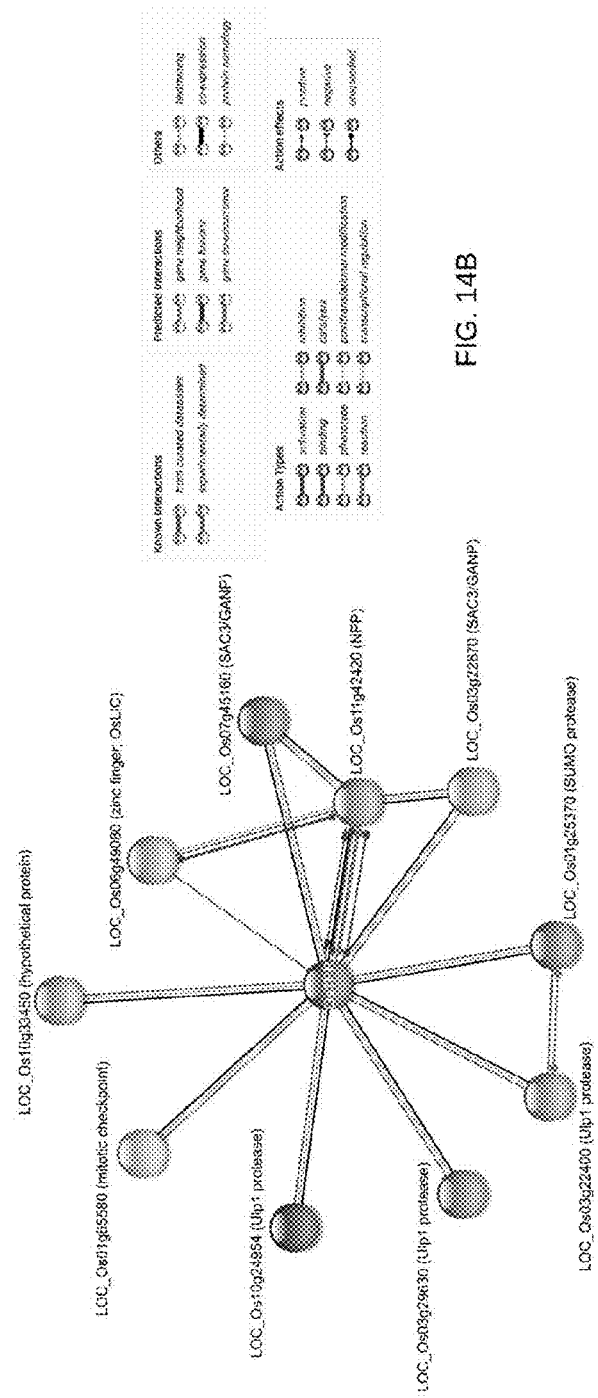

FIGS. 14A and 14B show first-shell neighbors and protein interactors of OsTPR. (A) The first neighbors of the candidate gene OsTPR from the blue module in coexpression analysis were identified to be involved in different important molecular functions such as protein metabolism and RNA processing among many others based on MapMan annotation with highlights on some major genes (e.g. OsSPL14, D11, MOC2, etc.) known to be involved in panicle architecture development. (B) OsTPR predicted first-shell protein interactors and molecular actions based on different types of evidence at high confidence level (0.7) suggests the importance of OsTPR as it interacts with other proteins involved in SUMOylation, ubiquitination, and plant architecture regulation in rice.

FIG. 15 shows the protein sequence alignment of nuclear-pore anchor-encoding proteins from *Arabidopsis* and rice. Amino acid sequence of OsTPR (XP_015625577.1, SEQ ID NO: 8) from *O. sativa* Nipponbare reference genome aligned with AtTPR (AT1G79280, SEQ ID NO: 10) from *Arabidopsis thaliana*, with amino acids highlighted in pink representing the translocated promoter region (TPR) domain.

FIG. 16 shows comparison of amino acid substitutions in OsTPR between superior and inferior *O. sativa* subsp. *indica* samples. Six significant non-synonymous SNPs in OsTPR showed distinct amino acid substitutions between samples with high number of upper secondary rachis branches (HUSRB; IRIS_313-8536 SEQ ID NO: 21, IRIS_313-8733 SEQ ID NO: 22, IRIS_313-9605 SEQ ID NO: 23, and IRIS_313-9832 SEQ ID NO: 24) and samples with low number of upper secondary rachis branches (LUSRB; IRIS_313-10274 SEQ ID NO: 17, IRIS_313-10385 SEQ ID NO: 18, IRIS_313-9184 SEQ ID NO: 19, and IRIS_313-8405 SEQ ID NO: 20).

FIG. 17 shows SNP locations on the OsTPR nucleic acid sequence (SEQ ID NO: 7) protein sequence (SEQ ID NO: 8) and LOC Os04g39430 (SEQ ID NO: 32), LOC Os11g35390 (SEQ ID NO: 33) and LOC Os06g40780 (SEQ ID NO: 34).

Figure 18:
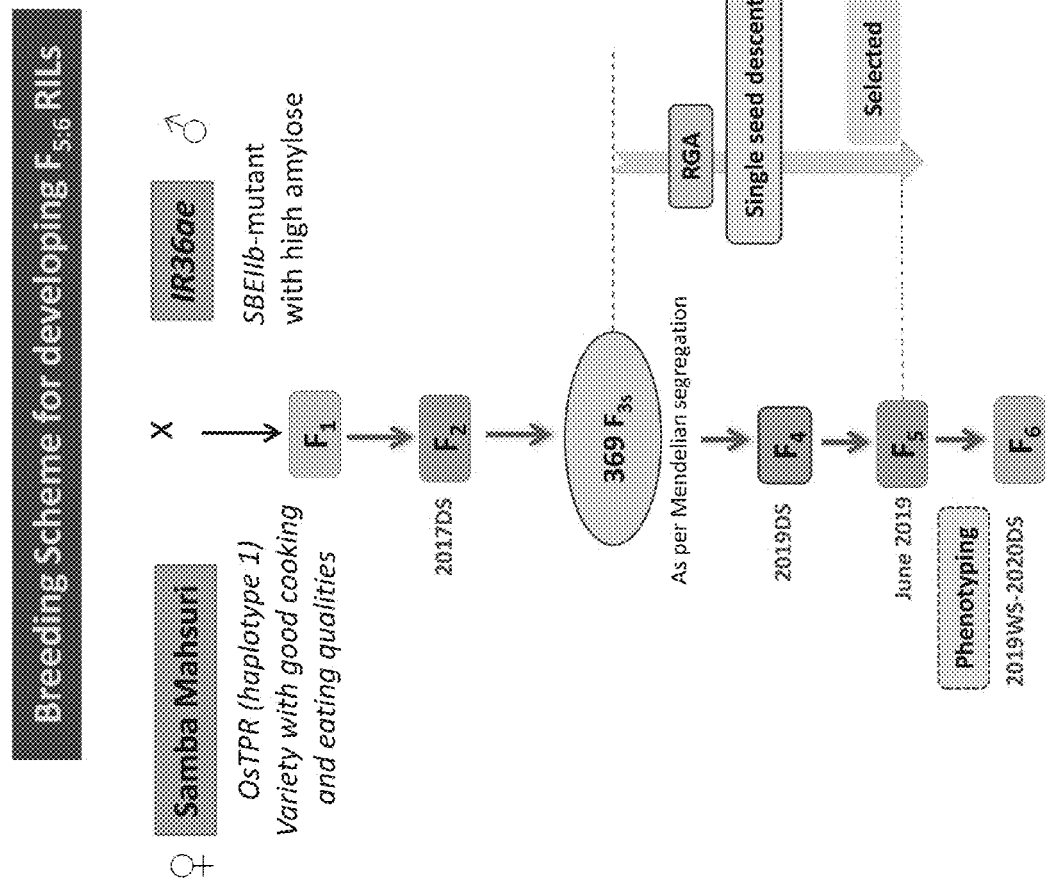

FIG. 18 provides a breeding scheme for Samba Mahsuri and IR36ae from F1 until F6 generation.

DESCRIPTION OF SPECIFIC EMBODIMENTS OF THE INVENTION

The present invention, in some embodiments thereof, relates to methods of enhancing grain yield, plants and products generated thereby.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

Rice is the staple for nearly half the global population. Ensuring food security by increasing crop yield of rice by meeting the demographic consumer preferences is critical. The classical tradeoff between yield increases for reduced grain quality is unacceptable in rice as value proposition defined through milling, visual and palatable qualities remain as economic drivers. The present inventors report 188 genetic loci interlinking several panicle architecture traits that increase yield and maintain grain quality as desired by rice traders and consumers. Multi-omics, single- and multi-locus GWAS, gene regulatory network and gene set analyses identified novel genes influencing secondary branching at upper and bottom part of the panicle, leading to increased superior grains. Multiple non-synonymous SNPs in a nuclear-pore anchor protein-encoding gene (OsTPR) were specifically associated with superior haplotypes of increased upper secondary rachis branches (USRB) and grain number. These grains maintained the quality traits including low chalk. This confirmed a critical role for OsTPR in influencing yield while maintaining quality and suggest directed evolution under artificial selection towards the desirable haplotype composition of the elite *indica* lines.

The present inventors identified additional genes D11, MOC1 or MYB4P or alleles thereof that can function optionally together with OsTPR in increasing yield.

Thus, according to an aspect there is provided a method of enhancing grain yield of a Gramineae plant, the method comprising:
(a) crossing a recipient plant with a donor plant comprising a sequence variation in a TPR allele, the sequence variation imparting enhanced grain yield; and
(b) selecting a progeny plant of the crossing comprising the sequence variation by identifying said variation, the progeny plant being characterized by an improved grain yield relative to the recipient plant.

According to an alternative aspect there is provided a method of enhancing grain yield of a Gramineae plant, the method comprising:
(a) crossing a recipient plant with a donor plant comprising a TPR allele of haplotype I; and
(b) selecting a progeny plant of the crossing comprising the TPR allele of haplotype I by identifying said variation, the progeny plant being characterized by an improved grain yield relative to the recipient plant.

So that the invention may be more readily understood, certain terms are first defined. Other definitions are provided throughout the description.

As used herein, the term "plant" refers to an entire plant, its organs (i.e., leaves, stems, roots, flowers etc.), seeds, plant cells, and progeny of the same. The term "plant cell" includes without limitation cells within seeds, suspension cultures, embryos, meristematic regions, callus tissue, leaves, shoots, gametophytes, sporophytes, pollen, and microspores. According to a specific embodiment, the plant is a plant line.

According to a specific embodiment the plant line is an elite line. The phrase "plant part" refers to a part of a plant, including single cells and cell tissues such as plant cells that are intact in plants, cell clumps, and tissue cultures from which plants can be regenerated. Examples of plant parts include, but are not limited to, single cells and tissues from pollen, ovules, leaves, embryos, roots, root tips, anthers, flowers, fruits, stems, shoots, and seeds; as well as scions, rootstocks, protoplasts, calli, and the like. According to a specific embodiment, the plant part comprises the nucleic acid variation in a TPR allele as described below. According to a specific embodiment, the plant part is a seed.

As used herein, the phrases "progeny plant" refers to any plant resulting as progeny from a vegetative or sexual reproduction from one or more parent plants or descendants thereof.

As used herein the term "Gramineae plant" refers to the cereal grass family, which cultivated species include but are not limited to maize (corn), wheat, rice, barley, rye, sorghum or millet.

According to a specific embodiment the Gramineae plant is a cultivated plant.

As used herein the term "rice" refers to a cultivated *Oryza* plant.

As used herein the term "cultivated *Oryza* plant" refers to a cultivated grass rice species having a diploid genome, 2n=24 (AA genome). Examples of domesticated *Oryza* species include but are not limited to, *Oryza sativa* (Asian rice) or *Oryza glaberrima* (African rice). The term may be interchanged with the term rice.

Domesticated *Oryza* varieties contemplated herein according to exemplary embodiments refer to long grain, short grain, white, brown, red and black.

There are three main varieties of *Oryza sativa*:

*indica:* The *indica* variety is long-grained.

*japonica: japonica* rice is short-grained and high in amylopectin (thus becoming "sticky" when cooked), and is grown mainly in more temperate or colder regions such as Japan.

*javanica: javanica* rice is broad-grained and grown in tropical climates.

Other major varieties include Aromatic and Glutinos.

Figure 3:
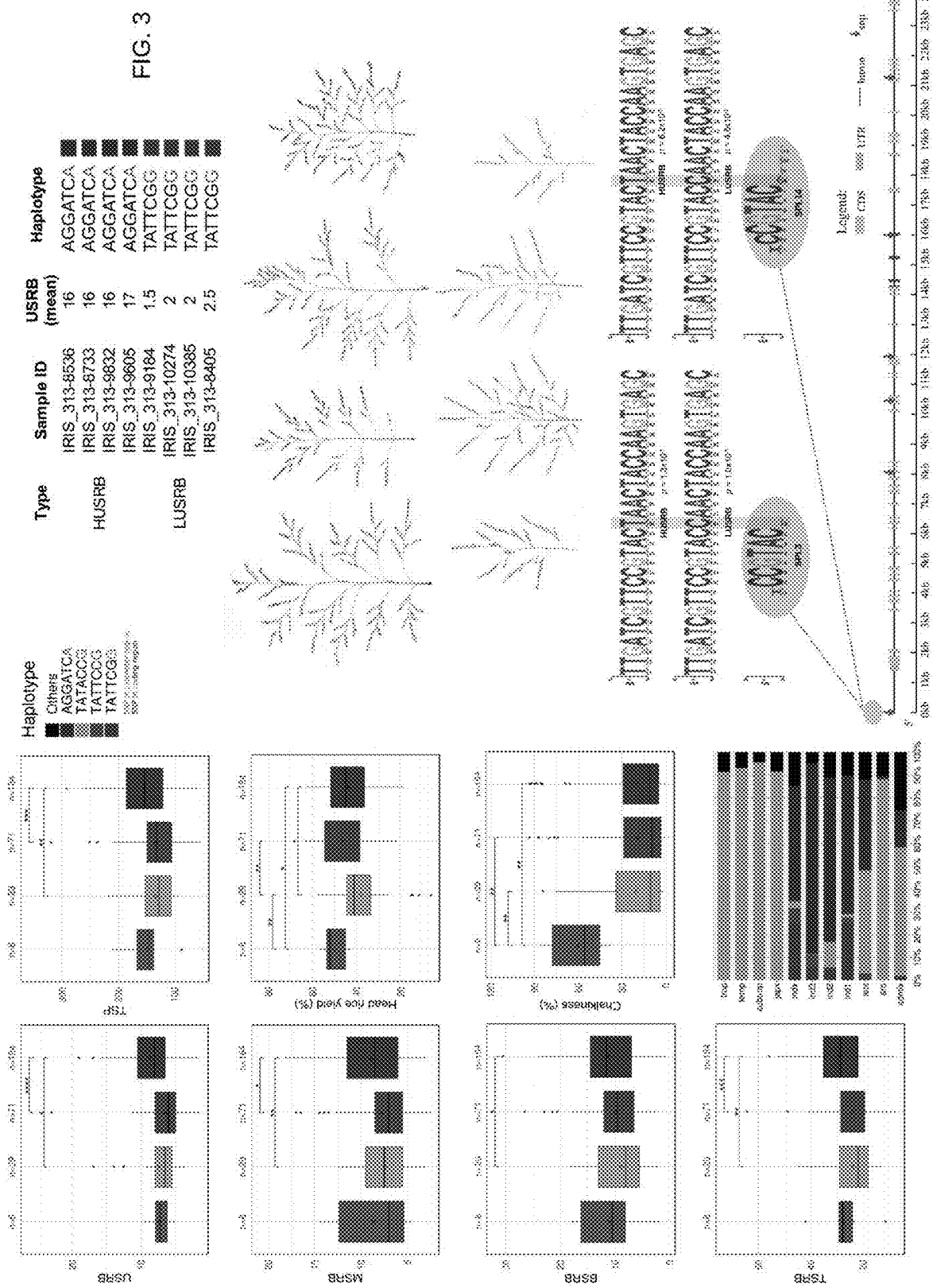

Allele mining using 3 k rice genomes revealed that within the *indica* subgroup the superior haplotype 1 was enriched while the inferior haplotype 3 was least represented (FIG. 3). The superior haplotype1 was not found in *japonica* subgroup suggesting its importance as an approach for improving the *japonica* rice lines.

According to a specific embodiment, the donor plant is *indica*.

According to a specific embodiment, the recipient plant is *indica* or *japonica*.

Within each variety, there are many recipient cultivars, each favored for particular purposes or regions. Any genetic background of domesticated *Oryza* e.g., *Oryza sativa*, can be used. Other varieties and germplasms which can be used according to the present teachings are selected from the group consisting of: IR64; Nipponbare; PM-36, PS 36, Lemont, 7S 27, Arkansas Fortuna, Sri Kuning, IR36, IR72, Gaisen Ibaraki 2, Ashoka 228, IR74, NERICA 4, PS 12, Bala, Moroberekan, IR42, Akihikari, Nipponbare, IR20, IR56, IR66, NSIC Rc158, NSIC Rc222, and NSIC Rc238.

As used herein the term "maize" is also interchangeably referred to as "corn" "*Zea maize* L." or "*Zea maize* subsp."

As used herein "cultivated maize" refers to the conventionally grown *Zea mays* for human or animal food or beverages or as a source of raw materials, food supplements, chemicals or fuel. The maize plant is diploid (2N=20) in nature.

Any genetic background of *Zea maize* can be used. A number of commercial varieties are available including, but not limited to:

*Zea mays* var. *amylacea* (typically used for producing corn flowerflour)

*Zea mays* var. *everta* (typically used for producing popcorn)

*Zea mays* var. *indentata* (Dent corn)

*Zea mays* var. *indurata* (Flint corn)

*Zea mays* var. *saccharata* and *Zea mays* var. *rugosa* (Sweet corn)

*Zea mays* var. *ceratina* (Waxy corn)

*Zea mays* (Amylomaize)

*Zea mays* var. *tunicata* Larrañaga ex A. St. Hil (Pod corn)

*Zea mays* var. *japonica* (Striped maize)

As used herein the term "wheat" is also interchangeably referred to as "*Triticum* L." or "*Triticum* subsp.".

As used herein the term "common wheat" is also interchangeably referred to as "Bread wheat" or "*Triticum aestivum*".

As used herein the term "durum wheat" is also interchangeably referred to as "Macaroni wheat" or "*Triticum durum* Desf." or "*Triticum turgidum* subsp. *durum*".

Wheat is conventionally grown for human or animal food or beverages or as a source of raw materials, food supplements, chemicals or fuel. The common wheat plant is allohexaploid (6N=42) in nature, whereas the *durum* wheat is a tetraploid (4N=28).

Any genetic background of *Triticum* can be used. A number of commercial varieties are available including, but not limited to:

*T. aestivum* (95% of the wheat production, also known as common wheat, typically used for producing flour for baking)

*T. aethiopicum* (commonly known as Ethiopian wheat)

*T. araraticum* (commonly known as Armenian or Araratian wild emmer)

*T. boeoticum* (commonly known as Einkorn wheat)

*T. carthlicum* (commonly known as Persian wheat)

*T. compactum* (similar to common wheat)

*T. dicoccoides* (commonly known as Emmer wheat, Farro, Hulled wheat)

*T. dicoccon* (commonly known as Emmer wheat, Farro, Hulled wheat)

*T. durum*

*T. ispahanicum* (commonly known as Emmer wheat, Farro, Hulled wheat)

*T. karamyschevii* (commonly known as Emmer wheat, Farro, Hulled wheat)

*T. macha*

*T. militinae*

*T. monococcum* (commonly known as Einkorn wheat)

*T. polonicum* (commonly known as Polish wheat)

*T. spelta* (commonly known as Dinkel wheat)

*T. timopheevii* (commonly known as Zanduri wheat)

*T. turanicum*

*T. urartu* (commonly known as Einkorn wheat)

*T. vavilovii*

*T. zhukovskyi*

The term "crossed" or "cross" in the context of this invention means the fusion of gametes via pollination to produce progeny (i.e., cells, seeds or plants). The term encompasses both sexual crosses (the pollination of one plant by another) and selfing (self-pollination, i.e., when the pollen and ovule are from the same plant or from genetically identical plants).

Although the present description refers in a more detailed manner to rice, other species of Gramineae are equally envisaged.

According to a specific embodiment, the donor plant and the recipient plant are from the same species (e.g., rice/rice).

According to a specific embodiment, the donor plant and the recipient plant are from different species (e.g., rice/corn).

According to a specific embodiment, the donor plant and the recipient plant are from the same cultivar (e.g., *indica/indica*).

According to a specific embodiment, the donor plant and the recipient plant are from different cultivars (e.g., *indica/japonica*)

As used herein "enhancing" or "increasing" refers to an increase of at least 10%, 20%, 30%, 40%, 50%, 60%, 70%, 80%, 90%, 1.5 fold, 2 fold or more as compared to a control of the same genetic background without the sequence variation (i.e., control plant e.g., the recipient plant).

As used herein "reducing" or "decreasing" refers to a decrease of at least 10%, 20%, 30%, 40%, 50%, 60%, 70%, 80%, 90%, 1.5 fold, 2 fold or more as compared to a control of the same genetic background without the sequence variation (i.e., e.g., the recipient plant).

As used herein "grain yield" refers to the measure of the yield of grains per unit area of land cultivation.

Grain yield can be measured in pounds per acre, typically at 12.0% moisture. Grain yield of rice can be determined by the number of panicles per unit area, the number of fertile florets per panicle, and/or grain weight per floret. According to a specific embodiment, the grain yield is manifested by an increase in total spikelet number (TSP) per panicle.

According to a specific embodiment, the grain yield is manifested by an increase in total number of secondary rachis branches (TSRB).

According to a specific embodiment, the grain yield is manifested by an increase in upper secondary rachis branches (USRB).

According to a specific embodiment, the grain yield is manifested by an increase in middle secondary rachis branches (MSRB).

According to a specific embodiment, the grain yield is manifested by an increase in total number of primary rachis branches (TPRB).

According to a specific embodiment, the grain yield is manifested by an increase in number of upper primary rachis branches (UPRB).

According to a specific embodiment a cross between the claimed haplotype (in Samba Mahsuri) to an OsMOC1 genotype the following values were obtained (see breeding scheme on FIG. 18).

The determination of the plant architecture as mentioned by the above parameters can be done as follows: the length of each panicle starting from the first node until the last node is measured and divided by three—resulting to bottom, middle, and upper levels within the panicle. The sum of rachis branches based on category of primary or secondary is calculated for each level. This provides measurements for primary rachis branches (PRB) at the bottom (BPRB), middle (MPRB), and upper (UPRB) levels of the panicle. Similarly, this approach is used for secondary rachis branches (SRB) at the bottom (BSRB), middle, (MSRB), and upper (USRB) levels of the panicle.

According to a specific embodiment, the grain yield is manifested by an increase in percentage of head rice yield. The weight of head rice, expressed as a percentage of the original rough rice weight, is defined as the head rice yield (HRY) and may vary from 0, where all kernels are broken to a theoretical maximum of approximately 70% (no kernels are broken, 30% waste consisting of husk and bran). According to a specific embodiment, the grain yield is manifested by an increase in weight of filled spikelets per plant.

According to a specific embodiment, the grain yield is manifested by an increase in bulk grain weight per a predetermined number of plants.

According to a specific embodiment, the grain yield is manifested by an increase in number of panicles per plant.

According to a specific embodiment, there is an overall increase in spikelets (filled and unfilled) e.g., when superior alleles of the four central hub genes are pyramided (see FIG. 13) as compared to samples of the same genetic background without the sequence variation (e.g., the recipient plant).

According to a specific embodiment, the increase in grain yield does not compromise grain quality.

Hence grain quality in a plant comprising the sequence variation in the TPR allele is about the same as or better than that of a control plant of the same genetic background without the variation.

As shown in Example 3, there is an association of TPR (OsTPR) with increased USRB and TSP without compromising the grain quality. Additionally, analysis of grain quality traits indicated that the amylose content, gel temperature, viscosity, retrogradation, etc., and cooking traits such as the cooked grain length and width (FIG. 10), were better or maintained in the OsTPR haplotype 1 grains on USRB.

Rice grain quality is typically composed of several factors, including grain appearance and milling, storing, eating, cooking, and nutritional qualities; appearance quality is mostly determined by grain shape and endosperm opacity (or chalkiness) [Zhang Q F. Strategies for developing green super rice. Proc Natl Acad Sci USA. 2007; 104:16402-16409. doi: 10.1073/pnas.0708013104; Wan X Y, Weng J F, Zhai H Q, Wang J K, Lei C L, Liu X L, Guo T, Jiang L, Su N, Wan J M. Quantitative trait loci (QTL) analysis for rice grain width and fine mapping of an identified QTL allele gw-5 in a recombination hotspot region on Chromosome 5. Genetics. 2008; 179:2239-2252. doi: 10.1534/genetics.108.089862.].

Embodiments of the invention therefore relate to any manifestation of a grain quality. Such include but are not limited to amylose content, chalkiness, gel temperature, trough, viscosity, breakdown, raw grain shape, raw grain length, raw grain width, retrogradation, and cooking traits such as the cooked grain shape, cooked grain length or width, final viscosity, peak viscosity, pasting temperature.

According to a specific embodiment, the quality trait refers to the raw grain and is manifested by chalkiness, grain size and/or grain shape.

FIG. 10 relates to any such parameter which is envisaged in this case.

Chalk. An opaque region of the rice kernel resulting from loose packing of the starch granules. Chalk may occur throughout or in a part of the kernel.

Chalkiness is a major constraint in rice production because it is one of the key factors determining grain quality and price. Its reduction is a major goal, and the primary purpose of this study was to dissect the genetic basis of grain chalkiness.

Chalkiness parameters include chalkiness rate, white core rate, white belly rate, chalkiness area, white core area, and white belly area According to a specific embodiment, chalk is less than 5%.

According to a specific embodiment, the chalkiness of the progeny plant is similar to that of the recipient or better (i.e., reduced chalkiness by at least 20%, 30%, 40%, 50%, 60%, 70%, 75%, 80%, 85%, 90%, 95%, as compared to the same genetic background not carrying the variation i.e., control).

As used herein "amylose content" which refers to percent apparent amylose content is typically measured by a continuous flow analyzer.

Apparent Amylose Percent. The most important grain characteristic that describes cooking behavior in each grain class, or type, i.e., long-, medium- and short-grain. The percentage of the endosperm starch of milled rice that is amylose. Standard long grains contain 20% to 23% amylose. Rexmont type long grains contain 24% to 25% amylose. Short and medium grains contain 16% to 19% amylose. Waxy rice contains 0% amylose.

According to a specific embodiment the amylose content is intermediate, i.e., 20-25%.

As used herein "gel temperature" or gel (gelatinization) temperature refers to the temperature at which rice starch granules imbibe water and lose crytallinity in an irreversible manner. It can be measured using the alkali spreading method. According to a specific embodiment, moderate gel temperature is preferred, as well known to the skilled artisan.

As used herein "viscosity" refers to the flow resistance of a rice flour suspension. It can be measured using a Rapid Visco Analyzer (RVA). According to a specific embodiment an intermediate viscosity is preferred as well known to the skilled artisan.

As used herein "retrogradation" refers to the appearance of starch clumps. Retrogradation refers to the crystallinization of amylose chains at room temperature which results to the hardening of rice after cooking. This parameter can be measured using RVA.

Grain Length (L). Length of a rice grain is measured in millimeters and can be measured using a SeedCount SC5000 Image Analyzer.

Grain Width (W). Width of a rice grain is measured in millimeters and can be measured using a SeedCount SC5000 Image Analyzer.

According to a specific embodiment the grain length and/or grain width are about the same as that of the control.

According to a specific embodiment, the grain characteristic is selected from high head rice recovery (HRR) and low chalkiness (less than 5%).

As mentioned the method involves transferring a TPR nucleic acid sequence comprising the superior allele (as an example for sequence variation) to a donor plant.

As used herein"translocated promoter region" gene or "TPR" belongs to the nuclear-pore complex that mediate the transport of RNA and other cargo between the nucleus and the cytoplasm. In *Arabidopsis* the protein was shown to play a role in RNA homeostasis, flowering time and auxin signaling.

The *Arabidopsis thaliana* homolog AtTPR (AT1G79280) is typically represented by the sequence SEQ ID NO: 9, NM_001198507, SEQ ID NO: 10 NP_178048.2, for the nucleotide and amino acid sequences, respectively. The amino acid sequence is shown in FIG. 15.

The present inventors have identified the rice homolog OsTPR, represented by the sequence SEQ ID NO: 7 NC_029257.1, SEQ ID NO: 8 XP_015625577.1, for the nucleotide and amino acid sequences, respectively. The gene is located on chromosome 2: 31009161 to 31033605 bp; minus strand. The amino acid sequence is shown in FIG. 15.

As used herein a sequence variation in a TPR allele, refers to at least one mutation that can be any of a deletion, substitution, deletion, insertion, inversion of one or more nucleotides in the OsTPR reference sequence.

The variation can be at least 90% identical, but not full identity with the OsTPR allele, in the DNA or protein level.

As used herein, "sequence identity" or "identity" in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff JG. [Amino acid substitution matrices from protein blocks. Proc. Natl. Acad. Sci. U.S.A. 1992, 89(22): 10915-9].

Identity (e.g., percent homology) can be determined using any homology comparison software, including for example, the BlastN software of the National Center of Biotechnology Information (NCBI) such as by using default parameters.

Hence according to a specific embodiment, the variation can arise from different cultivars of the species (e.g., *indica* to *japonica*) or different species.

According to some embodiments of the invention, the identity is a global identity, i.e., an identity over the entire amino acid or nucleic acid sequences of the invention and not over portions thereof.

As mentioned, this variation that may be of a single base to several hundreds or thousands of nucleotides e.g., 1-200 nucleotides confers the enhanced grain yield.

Methods of validating such variations and their effect in the phenotypes are well known in the art and described in length in the Examples section which follows.

The at least one mutation may be in the coding sequence.

Alternatively or additionally, the at least one mutation may be in the non-coding sequence.

According to a specific embodiment, the sequence variation comprises at least one single nucleotide polymorphism (SNP) selected from the group of SNPs of TPR and optionally other genes shown in Table A below.

According to a specific embodiment, the sequence variation comprises at least two single nucleotide polymorphisms (SNPs) selected from the group of SNPs of TPR and optionally other genes shown in Table A below.

According to a specific embodiment, the sequence variation comprises at least three single nucleotide polymorphisms (SNPs) selected from the group of SNPs of TPR and optionally other genes shown in Table A below.

According to a specific embodiment, the sequence variation comprises at least three single nucleotide polymorphisms (SNPs) selected from the group of SNPs of TPR and optionally other genes shown in Table A below.

According to a specific embodiment, the sequence variation comprises at least four single nucleotide polymorphisms (SNPs) selected from the group of SNPs of TPR and optionally other genes shown in Table A below.

According to a specific embodiment, the sequence variation comprises at least five single nucleotide polymorphism (SNPs) selected from the group of SNPs of TPR and optionally other genes shown in Table A below.

According to a specific embodiment, the sequence variation comprises at least six single nucleotide polymorphism (SNPs) selected from the group of SNPs of TPR and optionally other genes shown in Table A below.

According to a specific embodiment, the sequence variation comprises at least seven single nucleotide polymorphism (SNPs) selected from the group of SNPs of TPR and optionally other genes shown in Table A below.

According to a specific embodiment, the sequence variation comprises at least eight single nucleotide polymorphism (SNPs) selected from the group of SNPs of TPR and optionally other genes shown in Table A below.

According to a specific embodiment, the sequence variation comprises at least nine single nucleotide polymorphism (SNPs) selected from the group of SNPs of TPR and optionally other genes shown in Table A below.

According to a specific embodiment, the sequence variation comprises at least ten single nucleotide polymorphism (SNPs) selected from the group of SNPs of TPR and optionally other genes shown in Table A below.

According to a specific embodiment, the sequence variation comprises at least ten to 20 single nucleotide polymorphism (SNPs) selected from the group of SNPs of TPR and optionally other genes shown in Table A below.

According to a specific embodiment, the sequence variation comprises at least ten to 30 single nucleotide polymorphism (SNPs) selected from the group of SNPs of TPR and optionally other genes shown in Table A below.

According to a specific embodiment, the sequence variation comprises at least ten to 50 single nucleotide polymorphism (SNPs) selected from the group of SNPs of TPR and optionally other genes shown in Table A below.

According to a specific embodiment, the sequence variation is as set forth in haplotype I (AGGATCA, SEQ ID NO: 1).

According to a specific embodiment haplotype I and genetic variations in other genes are provided in Table A below:

ture which shows snp_02_31035009 (G/A; upstream SNP) as the first SNP (leftmost) and snp_02_31010249 (T/A) as the last SNP (rightmost).

Now the superior haplotype, AGGATCA, is a mixture of both reference and alternative alleles. Here, the alleles in bold (A and C) are from the reference while the ones not in bold are alternative alleles. The underlined allele (T) is an alternative allele which refers to the SNP which has both a missense and splice variant annotation (snp_02_31024549). The r-square values of snp_02_31024549 with the neighboring reference alleles, snp_02_31023080 and snp_02_31026954, are 0.623 and 0.564, respectively. Most of the seven SNPs have high D' (0.986 to 1.0) but the r-square values are variable (0.56 to 0.986).

Motif connection with haplotype SPL3/SPL14 in *Arabidopsis* bind specifically to the consensus nucleotide sequence 5'-TNCGTACAA-3'. For motif searching, the input sequence consists of a stretch of 31 bp, having the upstream SNP, snp_02_31035009 (G/A), in the middle (15th SNP) and is reverse transcribed for the software used. Snp_02_31035009 overlaps with the eighth position of the motif (5'-TNCGTACAA-3') having either T(A) for lines

TABLE A (variation is shown in a bigger font)

| | | | | | | | | |
|---|---|---|---|---|---|---|---|---|
| LOC_Os02g50790/LOC_Os02g50799 | OsTPR | snp_02_31035009 | 10231035009 | 2 | 31035009 | G | A | Variant in promoter region | — |
| LOC_Os02g50790/LOC_Os02g50799 | OsTPR | snp_02_31026954 | 10231026954 | 2 | 31026954 | C | G | Missense variant | Glu > Gln |
| LOC_Os02g50790/LOC_Os02g50799 | OsTPR | snp_02_31024549 | 10231024549 | 2 | 31024549 | C | T | Missense variant and splice region variant | Glu > Lys |
| LOC_Os02g50790/LOC_Os02g50799 | OsTPR | snp_02_31023080 | 10231023080 | 2 | 31023080 | A | T | Missense variant | Leu > Met |
| LOC_Os02g50790/LOC_Os02g50799 | OsTPR | snp_02_31019010 | 10231019010 | 2 | 31019010 | T | G | Missense variant | Gln > His |
| LOC_Os02g50790/LOC_Os02g50799 | OsTPR | snp_02_31013745 | 10231013745 | 2 | 31013745 | A | G | Missense variant | Val > Ala |
| LOC_Os02g50790/LOC_Os02g50799 | OsTPR | snp_02_31010249 | 10231010249 | 2 | 31010249 | T | A | Missense variant | Met > Leu |
| LOC_Os04g39430 | D11 | snp_04_23472273 | 10423472273 | 4 | 23472273 | G | A | Variant in promoter region | — |
| LOC_Os04g39430 | D11 | snp_04_23472700 | 10423472700 | 4 | 23472700 | G | A | Variant in promoter | — |
| LOC_Os04g39430 | D11 | snp_04_23472861 | 10423472861 | 4 | 23472861 | C | T | Variant in promoter | — |
| LOC_Os06g40780 | MOC1 | snp_06_24312857 | 10624312857 | 6 | 24312857 | G | C | Synonymous variant | — |
| LOC_Os06g40780 | MOC1 | snp_06_24313378 | 10624313378 | 6 | 24313378 | A | G | Intronic variant | — |
| LOC_Os11g35390 | MYB4P | snp_11_20737146 | 11120737146 | 11 | 20737146 | A | G | Synonymous variant | — |

Thus, the SNP can be located in an intron, a regulatory (e.g., promoter), and/or a coding region.

FIG. 3 shows exemplary locations of the SNPs which may build a superior haplotype such as haplotype I.

The at least one mutation can be in a functional domain. An example of a functional domain may be a promoter, a TPR domain, a binding region for SPL3/SPL14.

Exemplary SNPs include, but are not limited to:
snp_02_31010249, snp_02_31013745, snp_02_31019010 (SNP within the TPR domain), snp_02_31023080, snp_02_31024549, snp_02_31026954, snp_02_31035009 (SNP in promoter region).

As used herein "haplotype" relates to a set of SNP alleles that tend to always occur together (i.e., that are associated statistically).

The at least one mutation can be in a structural domain of the DNA, RNA or protein.

Haplotype and gene structure in FIG. 3, in connection with Table A. Since the OsTPR gene is in minus strand, the haplotype (3' to 5') is a reverse of the gene structure (5' to 3') presented. Given this, the sequence of SNPs (from left to right) in the haplotype is as follows: snp_02_31010249 (T/A), snp_02_31013745 (A/G), snp_02_31019010 (T/G; SNP in TPR domain), snp_02_31023080 (A/T), snp_02_31024549 (C/T), snp_02_31026954 (C/G), snp_02_31035009 (G/A; upstream SNP; colored as orange). But this sequence is reversedly presented in the gene strucwith high USRB (HUSRB) or C(G) for lines with low USRB (LUSRB). The alleles in parentheses are the reverse complement of the nucleotides in the genomic sequence. These alleles are colored in orange in the haplotype sequence, with A for HUSRB lines and G for LUSRB lines.

As used herein a "donor plant" which may also be referred to as a "non-recurrent parent" comprises the variation in the TPR gene.

According to a specific embodiment, Samba Mahsuri is a donor plant.

As used herein "a recipient plant" which may also be referred to as a "recurrent parent" refers to a cultivar e.g., an elite line, that could be made better (e.in terms of yield) by adding sequence variation.

The recipient plant may not comprise the variation at all, accordingly the recipient plant is null for said sequence variation, e.g., haplotype I.

According to other embodiments, the recipient plant may comprise a single allele or more but not all alleles which comprise the variation, in such a case the plant is heterozygous for the variation. In certain case, such a plant may be simply subjected to selfing to render it homozygous for the variation.

Accordingly, the recipient plant is heterozygous for the sequence variation e.g., haplotype I.

As mentioned, once progeny plants are selected for the trait, the progeny may be crossed to the recurrent parent (it is 'crossed back' to the recurrent parent, hence the term backcross). The progeny of this cross is selected for the trait of interest and then crossed back to the recurrent parent. This process is repeated for as many backcrosses as are needed to create a line that is the recurrent parent with the sequence variation from the donor parent. The goal of backcrossing is to obtain a line as identical as possible to the recurrent parent with the addition of the sequence variation that has been added through breeding.

According to an embodiment of the invention, the recipient rice plant may comprise a genetic background that comprises a sequence variation in a gene selected from the group consisting of D11, MOC1 and MYB4P (D11, MOC1, MYB4P, D11+MOC1, D11+MYB4P, MOC1+MYB4P, D11+MYB4P+MOC1). The present inventor identified a superior phenotype in terms of yield when variations in any of these genes were added to the TPR allele variation (see FIG. 6). DWARF11 encodes cytochrome P450 superfamily protein involved in brassinosteroid biosynthesis. Transgenic plants manipulated for His360Leu amino acid substitution were shown to confer clustered primary branch in rice (Wu, Y., Fu, Y., Zhao, S., Gu, P., Zhu, Z., Sun, C., Tan, L. 2016. CLUSTERED PRIMARY BRANCH 1, a new allele of DWARF11, controls panicle architecture and seed size in rice. *Plant Biotech. J.* 14:377-386. doi: 10.1111/pbi.12391. DWARF11 mutation leads to reduced rachis length, decreased grain number, and secondary rachis branches. Overexpression of DWARF11 leads to an increase in total grain number and thus yield enhancement by 16% (Zhou, Y., Tao, Y., Zhu, J., Miao, J., Liu, J., Liu, Y., Yi, C., Yang, Z., Gong, Z., Liang, G. 2017. GNS4, a novel allele of DWARF11, regulates grain number and grain size in a high-yield rice variety. *Rice.* 10(34):1-11. DOI 10.1186/s12284-017-0171-4. An exemplary sequence is provided in SEQ ID NO: 11 or 12.

MOC1 encodes a GRAS family transcription regulator which controls tillering, number of rachis branches, and spikelets in rice (Li, X., Qian, Q., Fu, Z., Wang, Y., Xiong, G., Zeng, D., Wang, X., Liu, X., Teng, S., Hiroshi, F., Yuan, M., Luo, D., Han, B., Li, J. 2003. Control of tillering in rice. *Nature.* 422: 618-621. DOI:10.1038/nature01518). An exemplary sequence is provided in SEQ ID NO: 13 or 14.

MYB4P encodes an R2R3 MYB family transcription factor which plays a role in cell differentiation, abiotic response, and phosphate acquisition (www(dot)uniprot(dot) org/uniprot/Q2R2L6; www(dot)ncbi(dot)nlm(dot)nih(dot) gov/pubmed/24813725) Yang, W. T., Baek, D., Yun, D. J., Hwang, W. H., Park, D. S., Nam, M. H., Chung, E. S., Chung, Y. S., Yi, Y. B., Kim, D. H. 2014. Overexpression of OsMYB4P, an R2R3-type MYB transcriptional activator, increases phosphate acquisition in rice. *Plant Physiol Biochem.* 80:259-67. doi: 10.1016/j.plaphy.2014.02.024. An exemplary sequence is provided in SEQ ID NO: 15 or 16.

According to a specific embodiment the recipient rice plant is of a variety comprising a sequence variation in a gene selected from the group consisting of D11, MOC1, and MYB4P.

According to a specific embodiment the method further comprises breeding the recipient plant, donor plant or progeny plant to comprise a sequence variation in a gene selected from the group consisting of D11, MOC1, and MYB4P.

Figure 6:
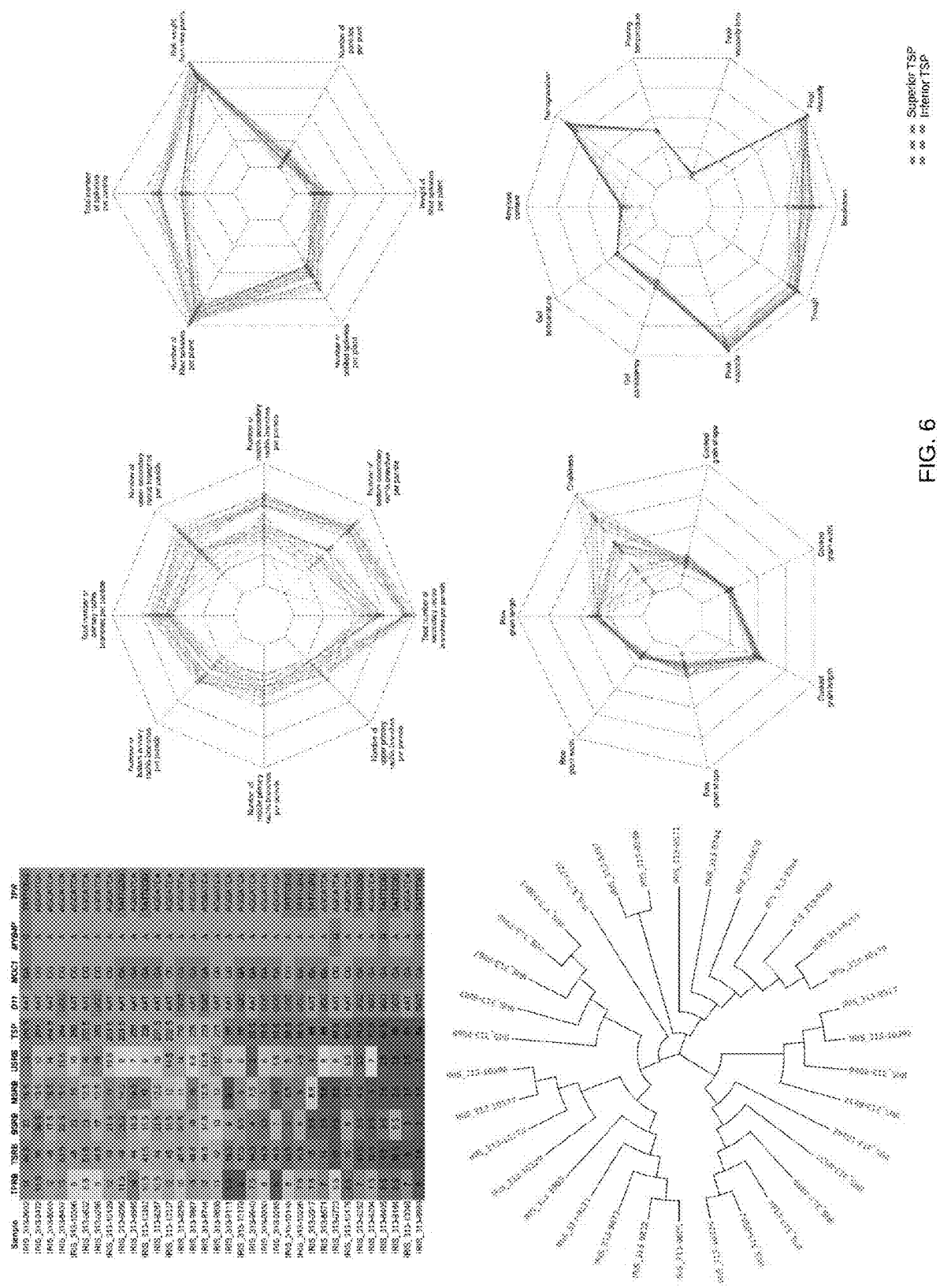

According to a specific embodiment the recipient plant or said progeny comprises a sequence variation in a gene selected from the group consisting of D11, MOC1, and MYB4P is shown in FIG. 6.

Such genetic backgrounds are available in the IRIS series shown in FIG. 6.

Exemplary haplotypes are shown in Table A above.

Other sequence variations are described in FIG. 17.

According to an additional or an alternative embodiment, the recipient plant is characterized by high amylose content (e.g., comprising a sequence variation which reduces expression of a starch branching enzyme IIb (sbeIIb, e.g., LOC_Os02g32660)), and optionally a sequence variation in MOC1. Such an exemplary line is IR36ae. According to a specific embodiment, the cross is between Samba Masuri and IR36ae (see FIG. 18).

Numerous ways are known in the art for crossing Gramineae plants or species thereof. The following refers to rice but in a non-limiting manner such that it can encompass other Gramineae or crosses therebetween (interspecific crossing).

Thus, according to one embodiment, for producing a rice plant with improved yield, protoplast fusion can be used for the transfer of nucleic acids from a donor plant to a recipient plant. Protoplast fusion is an induced or spontaneous union, such as a somatic hybridization, between two or more protoplasts (cells of which the cell walls are removed by enzymatic treatment) to produce a single bi- or multi-nucleate cell. The fused cell, that may even be obtained with plant species that cannot be interbred in nature, is tissue cultured into a hybrid plant exhibiting the desirable combination of traits. More specifically, a first protoplast can be obtained from a rice plant or other plant line that exhibits improved grain yield. For example, a protoplast from a superior *indica* line e.g., IR64. A second protoplast can be obtained from rice or other plant variety, preferably a popular *japonica* rice cultivar e.g., Nipponbare. Additionally, the second protoplast may be from a rice variety that comprises commercially desirable characteristics, such as, but not limited to disease resistance, insect resistance, weed resistance, etc. The protoplasts are then fused using traditional protoplast fusion procedures, which are known in the art.

Alternatively, embryo rescue may be employed in the transfer of a nucleic acid comprising the TPR variation as described above from a donor plant to a recipient plant. Embryo rescue can be used as a procedure to isolate embryos from crosses wherein plants fail to produce viable seed. In this process, the fertilized ovary or immature seed of a plant is tissue cultured to create new plants.

Traditional breeding techniques can also be used to introgress a nucleic acid sequence of the variation in the TPR allele into a recipient rice plant in which a higher grain yield is desirable. In one method, related to pedigree breeding, a donor rice plant comprising a nucleic acid sequence variation as discussed is crossed with a rice plant in which a higher grain yield is desirable. The resulting plant population (representing the F1 hybrids) is then self-pollinated and set seeds (F2 seeds). The F2 plants grown from the F2 seeds are then screened for improved grain yield and optionally grain quality. The population can be screened or selected for improved grain yield in a number of different ways. For example, the population can be screened by field evaluation over several seasons.

An embodiment relates to a rice plant having improved grain yield, or part thereof, comprising within its genome the TPR variation, wherein the variation is not in its natural genetic background. The rice plants having improved grain yield described herein can be of any genetic type such as inbred, hybrid, haploid, dihaploid. Further, the plants of the present invention may be heterozygous or homozygous for the variation. As mentioned, although the TPR variation may be transferred to any rice plant in order to provide for a plant having improved grain yield, the methods and plants described herein are related to Gramineae family.

Inbred rice lines having improved grain yield can be developed using the techniques of recurrent selection and backcrossing, selfing and/or dihaploids or any other technique used to make parental lines. In a method of selection and backcrossing, improved grain yield can be introgressed into the recipient plant (which as mentioned is also termed "a recurrent parent") by crossing the recurrent parent with a first donor plant (which is different from the recurrent parent and referred to herein as the "non-recurrent parent"). The recurrent parent is a plant in which an increase in grain yield is desirable. Optionally, the recurrent parent possesses commercially desirable characteristics, such as, but not limited to disease resistance, insect resistance, weed resistance, etc. The non-recurrent parent comprises a nucleic acid sequence with the TPR sequence variation. The non-recurrent parent can be any plant variety or inbred line that is cross-fertile with the recurrent parent (or fertilization may be aided by means which are well known in the art). The progeny resulting from a cross between the recurrent parent and non-recurrent parent are backcrossed to the recurrent parent. The resulting plant population is then screened (also termed here as "selected"). The population can be screened in a number of different ways. F1 hybrid plants that exhibit improved grain yield and comprise the requisite nucleic acid sequence for the variation are then selected and selfed and selected for over a number of generations in order to allow for the rice plant to become increasingly inbred. This process of continued selfing and selection can be performed for zero to five or more generations. The result of such breeding and selection is the production of lines that are genetically homogenous for the variation associated with improved grain yield as well as other genes associated with traits of commercial interest.

Instead of using phenotypic screens, marker assisted selection (MAS) can be performed using one or more of the herein described molecular markers (e.g., for haplotype I), hybridization probes, or polynucleotides to identify those progeny that comprise the nucleic acid variation. The MAS is used for by identifying said variation.

Molecular markers can include restriction fragment length polymorphisms (RFLP), random amplified polymorphic DNA (RAPD), amplified fragment length polymorphisms (AFLP), single nucleotide polymorphisms (SNP) or simple sequence repeats (SSR). A primary motivation for development of molecular markers in crop species is the potential for increased efficiency in plant breeding through marker assisted selection (MAS) and marker assisted backcrossing (MABC). Genetic marker alleles are used to identify plants that contain a desired genotype at one or more loci and that are expected to transfer the desired genotype, along with a desired phenotype to their progeny. Genetic marker alleles can be used to identify plants that contain a desired genotype at one locus or at several unlinked or linked loci (e.g., a haplotype) and that would be expected to transfer the desired genotype, along with a desired phenotype to their progeny.

After a desired phenotype, e.g., improved grain yield and a polymorphic chromosomal locus are determined to segregate together, it is possible to use those polymorphic loci to select for alleles corresponding to the desired phenotype: a process called marker-assisted selection (MAS). In brief, a nucleic acid corresponding to the marker nucleic acid is detected in a biological sample from a plant to be selected. This detection can take the form of hybridization of a probe nucleic acid to a marker, e.g., using allele-specific hybridization, Southern analysis, northern analysis, in situ hybridization, hybridization of primers followed by PCR amplification of a region of the marker, or the like. A variety of procedures for detecting markers are described herein. After the presence (or absence) of a particular marker and/or marker allele in the biological sample is verified, the plant is selected, i.e., used to make progeny plants by selective breeding.

Screening a large number of plants for improved grain yield can be expensive, time consuming and unreliable. Use of the genetically-linked nucleic acids described herein as genetic markers for improved grain yield is an effective method for selecting plants capable of fertility restoration in breeding programs. For example, one advantage of marker-assisted selection over field evaluations for improved grain yield is that MAS can be done at any time of year regardless of the growing season. Moreover, environmental effects are irrelevant to MAS.

Another use of MAS in plant breeding is to assist the recovery of the recurrent parent genotype by backcross breeding. Backcross breeding is the process of crossing a progeny back to one of its parents. Backcrossing is usually done for the purpose of introgressing one or a few loci from a donor parent into an otherwise desirable genetic background from the recurrent parent. The more cycles of backcrossing that are done, the greater the genetic contribution of the recurrent parent to the resulting variety. This is often necessary, because donor parent plants may be otherwise undesirable. In contrast, varieties which are the result of intensive breeding programs may merely being deficient in one desired trait such as improved grain yield. Backcrossing can be done to select for or against a trait.

Markers corresponding to genetic polymorphisms between members of a population can be detected by numerous methods, well-established in the art (e.g., restriction fragment length polymorphisms, isozyme markers, allele specific hybridization (ASH), amplified variable sequences of the plant genome, self-sustained sequence replication, simple sequence repeat (SSR), single nucleotide polymorphism (SNP) or amplified fragment length polymorphisms (AFLP)).

The majority of genetic markers rely on one or more properties of nucleic acids for their detection. For example, some techniques for detecting genetic markers utilize hybridization of a probe nucleic acid to nucleic acids corresponding to the genetic marker. Hybridization formats include but are not limited to, solution phase, solid phase, mixed phase or in situ hybridization assays. Markers which are restriction fragment length polymorphisms (RFLP), are detected by hybridizing a probe (which is typically a sub-fragment or a synthetic oligonucleotide corresponding to a sub-fragment of the nucleic acid to be detected) to restriction digested genomic DNA. The restriction enzyme is selected to provide restriction fragments of at least two alternative (or polymorphic) lengths in different individuals and will often vary from line to line. Determining a (one or more) restriction enzyme that produces informative fragments for each cross is a simple procedure, well known in the art. After separation by length in an appropriate matrix (e.g., agarose) and transfer to a membrane (e.g., nitrocellulose, nylon), the labeled probe is hybridized under conditions which result in equilibrium binding of the probe to the target followed by removal of excess probe by washing. Nucleic acid probes to the marker loci can be cloned and/or synthesized. Detectable labels suitable for use with nucleic acid probes include any composition detectable by spectroscopic, radioisotopic, photochemical, biochemical, immunochemical, electrical, optical or chemical means. Useful labels include biotin for staining with labeled streptavidin conjugate, magnetic beads, fluorescent dyes, radiolabels, enzymes and colorimetric labels. Other labels include ligands which bind to antibodies labeled with fluorophores, chemiluminescent agents and enzymes. Labeling markers is readily achieved such as by the use of labeled PCR primers to marker loci.

The hybridized probe is then detected using, most typically, autoradiography or other similar detection technique (e.g., fluorography, liquid scintillation counter, etc.). Examples of specific hybridization protocols are widely available in the art.

Amplified variable sequences refer to amplified sequences of the plant genome which exhibit high nucleic acid residue variability between members of the same species. All organisms have variable genomic sequences and each organism (with the exception of a clone) has a different set of variable sequences. Once identified, the presence of specific variable sequence can be used to predict phenotypic traits. Preferably, DNA from the plant serves as a template for amplification with primers that flank a variable sequence of DNA. The variable sequence is amplified and then sequenced.

In vitro amplification techniques are well known in the art. Examples of techniques include in vitro methods, including the polymerase chain reaction (PCR), the ligase chain reaction (LCR), O,.beta.-replicase amplification and other RNA polymerase mediated techniques (e.g., NASBA). Essentially any RNA can be converted into a double stranded DNA suitable for restriction digestion, PCR expansion and sequencing using reverse transcriptase and a polymerase.

Oligonucleotides for use as primers, e.g., in amplification reactions and for use as nucleic acid sequence probes, are typically synthesized chemically according to the solid phase phosphoramidite triester method, or can simply be ordered commercially.

Alternatively, self-sustained sequence replication can be used to identify genetic markers. Self-sustained sequence replication refers to a method of nucleic acid amplification using target nucleic acid sequences which are replicated exponentially in vitro under substantially isothermal conditions by using three enzymatic activities involved in retroviral replication: (1) reverse transcriptase, (2) Rnase H and (3) a DNA-dependent RNA polymerase. By mimicking the retroviral strategy of RNA replication by means of cDNA intermediates, this reaction accumulates cDNA and RNA copies of the original target.

There are many different types of molecular markers, including amplified fragment length polymorphisms (AFLP), allele-specific hybridization (ASH), single nucleotide polymorphisms (SNP), simple sequence repeats (SSR) and isozyme markers. SSR data is generated by hybridizing primers to conserved regions of the plant genome which flank the SSR sequence. PCR is then used to amplify the repeats between the primers. The amplified sequences are then electrophoresed to determine the size and therefore the di-, tri and tetra nucleotide repeats.

The presence of the variation in the genome of a plant exhibiting a preferred phenotypic trait is determined by any method listed above, e.g., RFLP, AFLP, SSR, etc. If the nucleic acids from the plant are positive for a desired genetic marker, the plant can be selfed to create a true breeding line with the same genotype or it can be crossed with a plant with the same marker or with other desired characteristics to create a sexually crossed hybrid generation.

As mentioned, selection can be also or alternatively based on phenotypic screening for a grain yield- and/or grain quality-associated trait, such as described above.

Once the appropriate selections are made, the process is repeated. The process of backcrossing to the recurrent parent and selecting for improved grain yield (or the variation or both) is repeated for approximately 2-5 or more generations. The progeny resulting from this process are heterozygous for the variation. The last backcross generation can then be selfed in order to provide for homozygous pure breeding progeny for improved grain yield.

The rice lines having improved grain yield described herein can be used in additional crossings to create hybrid plants having improved grain yield. For example, a first inbred rice plant having improved grain yield produced by methods described herein can be crossed with a second inbred rice plant possessing commercially desirable traits such as, but not limited to, disease resistance, insect resistance, weed resistance, etc. This second inbred rice line may or may not have relatively improved grain yield.

Regardless of the selection method, following trait selection and backcrossing the genome of the cultivated Gramineae plant e.g., rice plant of the recurrent parent is recovered to at least 85%, at least 87%, at least 90%, at least 92%, at least 94%, at least 96%, or at least 98%. That is, the plant of the invention has a genome being at least 85%, e.g., 85-99.9% that of the recurrent parent e.g., *Oryza sativa*.

Also provided are such methods, wherein the recovery of the recurrent rice plant's genome (e.g., *Oryza sativa*) is between 92% and 97%.

A rice plant having improved grain yield, or a part thereof, or an elite line obtainable by a method described herein is also an embodiment of the present invention.

According to an embodiment, the plant is not Samba Mahsuri.

According to a specific embodiment, the plant is not a breeding line.

According to a specific embodiment, the plant is not any of the below lines:
IRRI179
IR30
IR34
IRRI135
IRRI127
IR64
IRRI174
IRRI168
IRRI108
IRRI123
IRRI156

Also contemplated is an elite line of a Gramineae plant comprising a sequence variation in a TPR allele or a haplotype I, the plant being characterized by an improved grain yield as compared to a control plant (excluded are the lines described above).

Also provided are processed rice products which are produced from the plants described herein and preferably contain the nucleic acid sequence conferring the improved out-crossing rate described herein. Also provided are methods of processing the rice (e.g., to produce meal) or other processed products.

Food Characteristics:

Rice starch is a major source of carbohydrate in the human diet, particularly in Asia, and the grain of the invention and products derived from it can be used to prepare food. The food may be consumed by man or animals, for example in livestock production or in pet-food. The grain derived from the rice plant can readily be used in food processing procedures, and therefore the invention includes milled, ground, kibbled, cracked, rolled, boiled or parboiled grain, or products obtained from the processed or whole grain of the rice plant, including flour, brokers, rice bran and oil. The products may be precooked or quick-cooking rice, instant rice, granulated rice, gelatinized rice, canned rice or rice pudding. The grain or starch may be used in the production of processed rice products including noodles, rice cakes, rice paper or egg roll wrapper, or in fermented products such as fermented noodle or beverages such as sake. The grain or starch derived therefrom may also be used in, for example, breads, cakes, crackers, biscuits and the like, including where the rice flour is mixed with wheat or other flours, or food additives such as thickeners or binding agents, or to make drinks, noodles, pasta or quick soups. The rice products may be suitable for use in wheatfree diets. The grain or products derived from the grain of the invention may be used in breakfast cereals such as puffed rice, rice flakes or as extruded products.

Dietary Fiber:

Dietary fiber, in this specification, is the carbohydrate and carbohydrate digestion products that are not absorbed in the small intestine of healthy humans but enter the large bowel. This includes resistant starch and other soluble and insoluble carbohydrate polymers. It is intended to comprise that portion of carbohydrates that are fermentable, at least partially, in the large bowel by the resident microflora.

Non-Food Applications:

Rice is widely used in non-food industries, including the film, paper, textile, corrugating and adhesive industries, for example as a sizing agent. Rice starch may be used as a substrate for the production of glucose syrups or for ethanol production.

DNA detection in the processed products can be performed using methods which are well known in the art and are described in some detail hereinabove.

It will be appreciated that the present teachings contemplate the protection of cultivated Gramineae plants such as cultivated rice plants and will not in any way encompass wild Gramineae per se.

Applicant notes that all varieties designated IRIS are not restricted for use and can be provided by Applicant to $3^{rd}$ party for research purposes under a Standard Material Transfer Agreement ("SMTA").

It is expected that during the life of a patent maturing from this application many relevant markers will be developed and the scope of the term marker is intended to include all such new technologies a priori.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Maryland (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Culture of Animal Cells—A Manual of Basic Technique" by Freshney, Wiley-Liss, N. Y. (1994), Third Edition; "Current Protocols in Immunology" Volumes I-III Coligan J. E., ed. (1994); Stites et al. (eds), "Basic and Clinical Immunology" (8th Edition), Appleton & Lange, Norwalk, CT (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, CA (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Methods

Phenotype Data Measurement and Transformation

A total of 310 diverse resequenced *indica* rice accessions grown in the experimental station of the International Rice Research (IRRI), Laguna, Philippines (14° N, 121° E) during the 2015 dry season was harvested before full grain ripening, and then phenotyped using Panicle Traits Phenotyping (P-TraP) Tool (A1-Tam et al. 2013). The phenotype values were transformed using WarpedLMM (Fusi et al. 2014), a transformation tool which ensures Gaussian distribution of residuals by incorporating all available covariates and genotype profile (i.e. individual genetic loci and polygenic genetic background) of each accession in order to increase GWAS power in identifying important genomic regions and increase the accuracy in estimating heritability and predicting phenotypic values.

Genotype Data Filtering

Genotype data consisting of 15,099,561 bi-allelic SNPs from The 3,000 Genomes Rice Project was filtered for the 310 resequenced *indica* accessions using PLINK 1.9 (Chang et al. 2015). Markers with missing call rate more than 0.20% were excluded, followed by samples with missing call rate more than 0.20%. Moreover, variants with minor allele frequency less than 10% were filtered out to include only common variants and to control false-positive results (Tabangin et al., 2009). A total of 747,087 high quality SNPs were retained from 309 samples after filtering.

Single Locus GWAS Analysis

The marker-based Balding-Nichols kinship matrix was calculated through the Efficient Mixed-Model Association eXpedited (EMMAX) ver. Beta (Kang et al. 2010) using the emmax-kin function. The kinship matrix was considered as covariate while the SNPs were treated as fixed effects for the variance component linear mixed model implemented in EMMAX. The EMMAX associations between the filtered genotype data and transformed phenotype data for each trait were then computed. Manhattan and QQ plots were created using R (ver. 1.0.153) (R Core Team, 2018) in order to visualize the significant genomic regions and assess the reliability of the EMMAX associations, respectively. The red line represents the Bonferroni threshold (7.17) which assumes independence among all the tests (Tabangin et al., 2009). However, this correction method is extremely stringent and renders high rate of false negative results; hence, it reduces true discovery rate. In this study, SNPs with q-value less than 0.05 were considered to be significant in order to increase the discovery rate and control the rate of false positive results (Lin and Lee, 2015). The blue line in the Manhattan plot represents the SNP with the highest significant p-value whose q-value is still less than 0.05. All SNPs within the red and blue lines in the Manhattan plot were considered to be significant.

PLINK 1.9 (Chang et al. 2015) software and HaploView (Barrett et al., 2005) software were used to define haplotype blocks with regions inherited without significant recombination in the diversity population. Haplotype blocks were determined using the blocks function in PLINK 1.9. HaploView was used to determine tag SNPs based on LD coefficient (D'≥0.80). The tag SNPs per block and the haplotype groups formed therewith were further visualized in boxplots for USRB.

Gene-Level and Gene-Set Analyses

Gene and gene-set analysis were performed using Multi-marker Analysis of GenoMic Annotation (MAGMA) ver. 1.06 in order to simultaneously determine the joint effect of multiple markers (de Leeuw et al. 2015). All significant SNPs previously identified from GWAS results were mapped to genes from the Rice Genome Annotation Project (MSU v7) based on genomic location (Kawahara et al. 2013). The SNP-wise mean model was used in MAGMA for the gene-level analysis, incorporating the p-values of SNPs computed from EMMAX and the filtered genotype data to estimate the LD between SNPs. After computing for the correlations between neighbouring genes and other gene-level metrics, competitive gene-set analysis was implemented as a linear regression model in order to test whether or not the mean association of the genes in the gene-set would be greater than that of the genes not in the gene-set. This approach used to create different sets of genes by removing one gene from the set of the top ten genes based on p-value for every gene-set.

Multi-Locus GWAS Analysis

Multi-locus GWAS was performed using Multi-Locus Random-SNP-Effect Mixed Linear Model (mrMLM) function in R, as described in Misra et al. (2018). Inputs were transformed phenotype data, filtered genotype data, and kinship matrix for each panicle trait: TSP, DSP, BRSB, DSBRB, MRSB, DMSRB, USRB, DUSRB, TSRB, and TPRB. The SNP data used in slGWAS was re-coded into ped and map files using recode function in PLINK 1.9, and then converted into diploid hapmap file using TASSEL5 (Bradbury et al., 2007). The methods implemented were mrMLM and FAST multi-locus random-SNP-effect EMMA (FAS-TrEMMA) considering a critical LOD score equals 3 for significant quantitative trait nucleotide (QTN), a search radius of 20 to identify potentially associated QTN, and restricted maximum likelihood (REML) for the likelihood parameter in FASTrEMMA. The QTNs identified with mlG-WAS methods were validated by slGWAS results.

Targeted Association Analysis

Biallelic SNPs within 2 kb upstream and 1 kb downstream of known panicle-related genes were extracted by aligning resequencing data of 309 accessions against reference genome Nipponbare and tested its association with TSP, TPRB, TSRB and sub-component traits (USRB, MSRB, BSRB). SNPs with p-values <0.05 were considered significant and used to form haplotype groups. Pairwise comparison of haplotype groups were performed with t-test and p-values were adjusted using Holm's method. Results were visualized using boxplots created using the ggplot2 package (Wickham, 2016) in R.

Association Networks of Genetic Variants Identified Through mlGWAS and Targeted Association The Cytoscape (Shannon et al., 2003) has been used to visualize the inter-relationship of SNPs associated to USRB, MSRB, BSRB, TSRB, TPRB and TSP traits. The SNPs with LOD score of 3.0 or above identified using mlGWAS with significant beta values (p<0.05) obtained from slGWAS and SNPs identified for known panicle architecture related genes through targeted association with significant beta values (p<0.05) has been merged together and transform as network input file (Source node:Traits,Target nodes-SNPs,Interaction-b values). Each trait has been grouped separately and shown as big circle nodes with distinct colors. The SNPs associated with each and across traits has been shown as out-degree edges highlighted in blue (multi locus) and red color (targeted association) with solid circles at each node.

Coexpression Network Analysis

The publicly available microarray data (GSE19024 and GSE41556) were extracted as CEL files from the six panicle developmental stages [Panicle1 (less than 1 mm), Panicle2 (3-5 mm), Panicle3 (10-15 mm) including three biological replicates, Panicle4 (40-50 mm), Panicle5 (Heading stage) with two biological replicates from two rice varieties Zhenshan 97 & Minghui 63] and additional heading stage of Nipponbare with 3 biological replicates. GCRMA normalization of all microarray samples was performed using the justGCRMA function (Wu et al. 2018) in R software. A total of 47 samples and 5041 panicles related genes were selected from Knetminer (Hassani-Pak, 2017) database based on published reports, and differentially expressed genes across the developing panicles in rice (Kudo et al. 2013).

Weighted gene correlation network analysis WGCNA package (Langfelder and Horvath, 2008) in R was used to identify the clusters (modules) of densely connected correlated genes. First the correlation matrix (coefficient=<0.75) was transformed into a matrix of connection strengths (an adjacency matrix) by raising the correlation matrix to the soft power $\beta$(beta) of 6. The adjacency function $\alpha ij$=Power (sij, $\beta$)=Isijl $\beta$ where sij is the co-expression similarity, and $\alpha ij$ represents the resulting adjacency that measures the connection strengths. The power $\beta$ is chosen using the scale free topology criterion proposed in (Zhang and Horvath, 2005). The adjacency matrix is converted to TO (topological overlap) matrix. Further the hierarchical clustering was done on TO similarity using cutreeDynamic function to identify modules. The eigenvectors for each module were calculated and clustered Modules with similar eigenvalue at threshold 0.25 has been merged using merge Close Modules function.

The edge weight indicates the strength of the co-expression from all nodes to all nodes. However, selection of a stringent threshold after module detection is required to remove noise. The genes were shown as nodes and the connection strength as weighted edges. Degree of connectivity was calculated to identify intramodular hubs. Nodes with an adjacency value of zero are removed from the modules and the edges with weight >=0.30089 were only selected. The genetic variants strongly associated with different panicle architecture traits were traced in the gene networks and highlighted its interactions. The visualization of co-expression network was done using Cystoscape (Shannon et al. 2003).

Cis Motif Searching

Potential binding sites of transcription factors that may alter the expression of candidate genes were determined using TomTom (Gupta et al., 2007). Probe sequences of specific length (30 bp) overlapping each of the significant SNPs detected with targeted association results were reverse transcribed and then used as input, considering an E-value<10. The motifs were compared with entries in JASPAR Core (2018) Plants Non-Redundant DNA Database (Khan et al. 2018).

Protein-Protein Interactions

Predicted protein-protein interactions of OsTPR were determined using STRING-DB ver. 10.5 (Szklarczyk et al., 2017) at high confidence (0.700) for the minimum required interaction score including less than 10 interactors for the first shell, and zero interactors for the second shell. The active interaction sources which served as potential evidence suggesting functional link include protein-protein experimental/biochemical data, associations in curated public databases, gene-fusion, co-expression data and text mining data (PubMed abstracts) were highlighted.

Gene Prediction

According to MSU 7.0 annotation, LOC_Os02g50790 and LOC_Os02g50799 were identified as two consecutive genes matching similar biological function showing homology to nucleoprotein TPR proteins. To confirm the annotation and gene models, the genomic sequence was extracted where these two genes are present in the genome. This whole sequence was used as input to the FGENESH for predicting gene model using standard parameters (Solovyev et al., 2006). Monocot sequences of Maize, Rice, Wheat and Barley were used as training set. The gene model prediction was validated with another abinitio method named as AUGUSTUS (Stanke et al., 2003).

Multiple Sequence Alignment and Phylogenetic Analysis

Multiple sequence alignment was performed for the protein sequence of the candidate gene to decipher the phylogeny among the close relatives. Overall 13 species were under consideration including two sub-species of *Oryza sativa*—*japonica* and *indica*. Protein sequence of newly predicted *Oryza sativa* spp. *japonica* TPR gene from MSU7 was used to identify orthologous protein in other species including *Oryza sativa* spp. *indica* (Zhang et al., 2016). Whole proteome sequences from Ensemble database (ww(dot)plants (dot)ensembl(dot)org/index(dot)html) for other species were used to identify the orthologous gene using locally installed NCBI-BLAST (Altschul et al., 1990). Multiple sequence alignment was performed using CLUSTALW (Thompson et al., 1994) after identification of candidate protein. MEGA X (Kumar et al., 2018) was used to create the NEIGHBOR-joining phylogenetic tree with 1000 bootstrap. Evolutionary distances were calculated using poisson correction method. Percentage of total replicates (1000 bootstrap) used to form the branches in the bootstrap test presented near to the branches. Another multiple sequence alignment of candidate protein was performed with 8 contrasting lines using CLUSTALW where 4 samples with higher number of upper secondary rachis branches and 4 samples with low number of upper secondary rachis braches were considered. Alignment was presented with highlighted domain and important non-synonymous SNPs.

Nucleotide Diversity Calculation

7 SNP positons for genic region and 15 SNP position for whole LD block region were downloaded from the SNP-seek (Alexandrov et al., 2015) data for whole 3 k set. Whole population was separated into different sub-population based on classification present at SNP-seek database. Minor allele frequency was calculated for each SNP at each sub-population level to verify how many candidate SNPs are present in other sub-populations. Nucleotide diversity computed using VCF tools (Danecek et al., 2011) and presented as line plot.

Example 1

Correlation Analyses Between Panicle Traits and Spikelet Number

Figure 1:
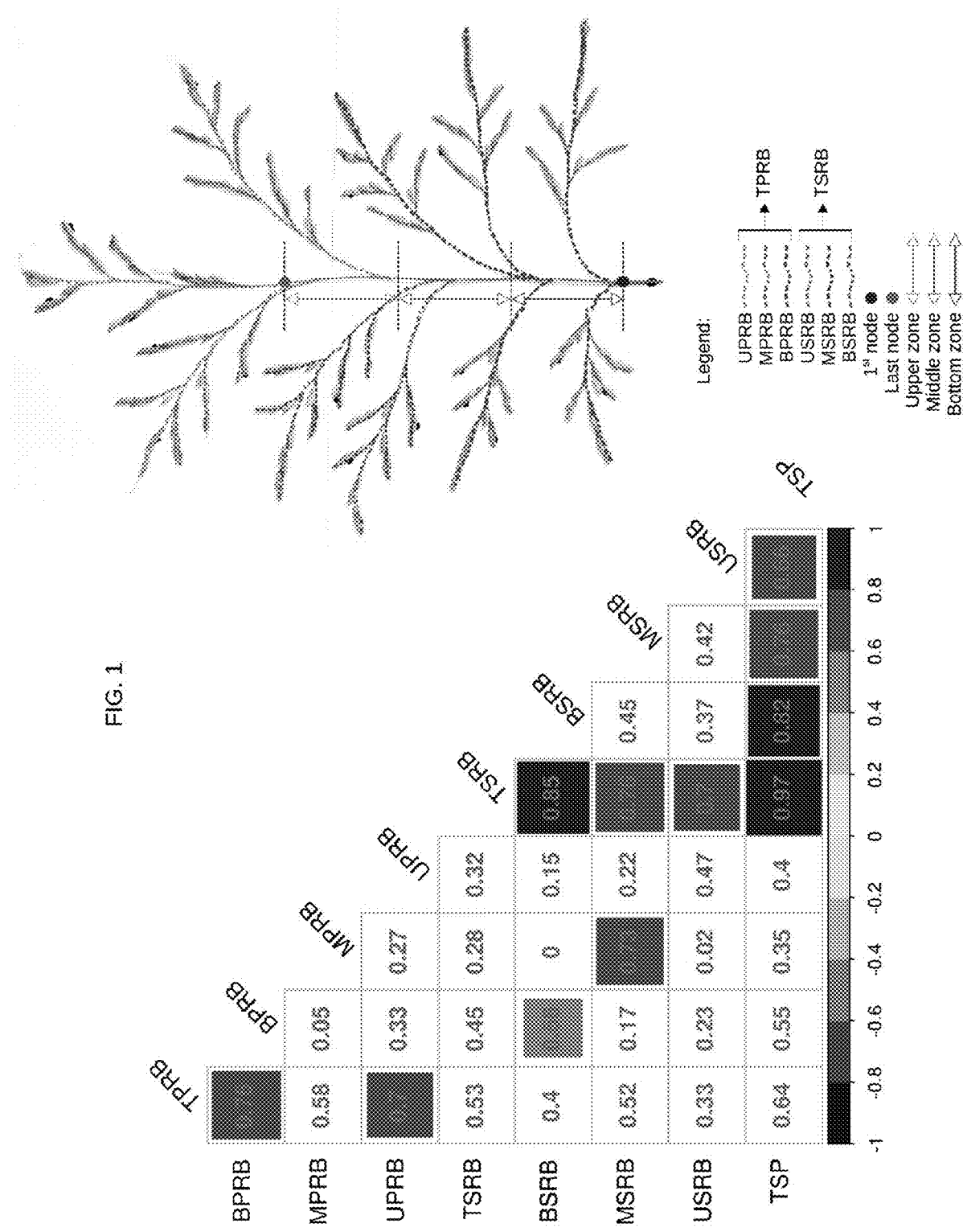
Figure 8:
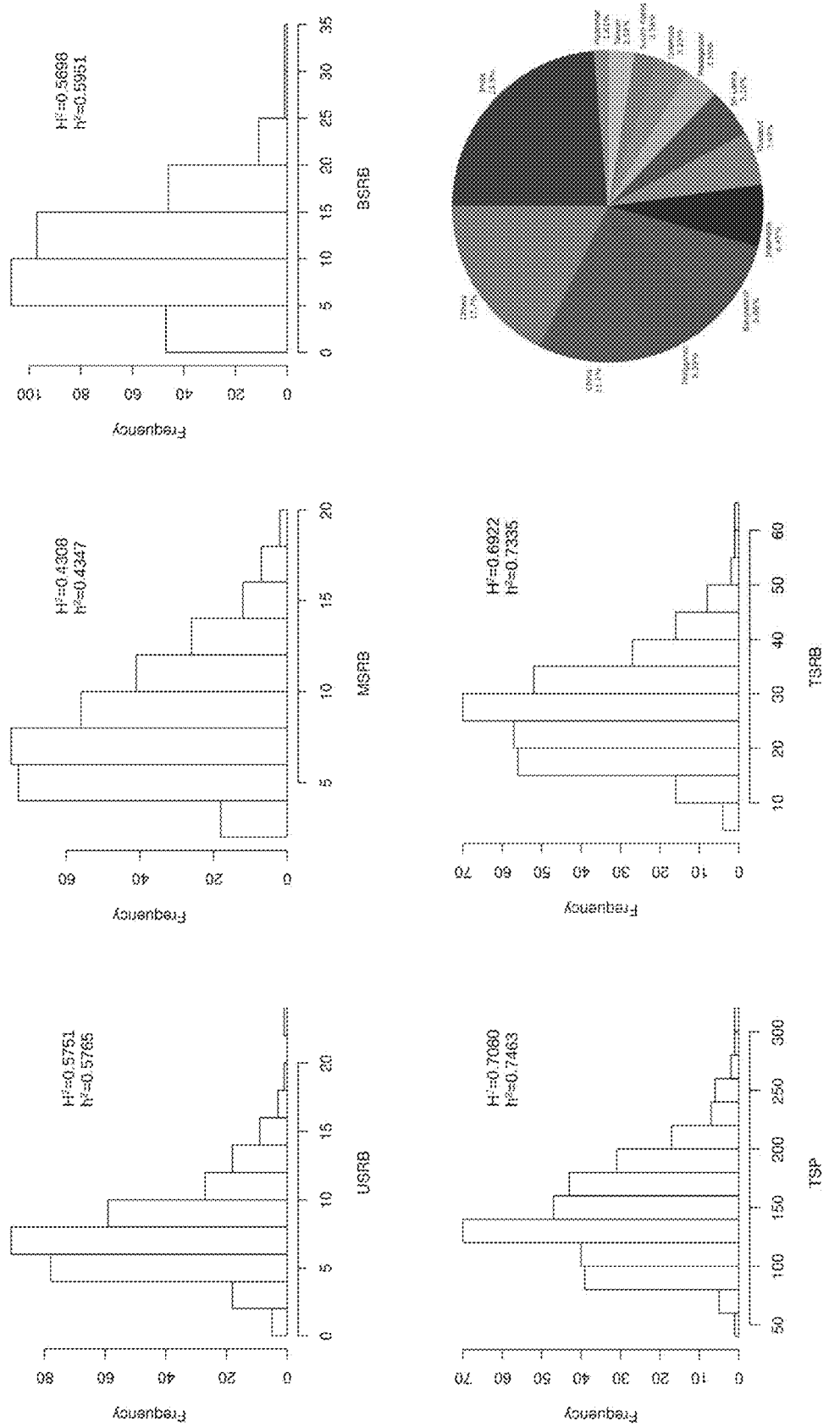
FIG. 8 shows the population used in the present study of diverse resequenced *O. sativa* subsp. *indica* samples. Frequency distribution in terms of total number of spikelets and secondary rachis branch-related traits along with corresponding heritability values of the 310 resequenced *indica* samples and their country of origin.

Using P-TRAP software 41 traits for panicle architecture were phenotyped in 310 *indica* accessions. The accessions represented diverse countries and exhibited a high heritability of $H^2=0.69$ for total number of secondary rachis branches (TSRB) and a wide range of phenotypic variation in this trait (FIG. 8). Correlation analysis revealed that TSRB was highly positively correlated with the total number of spikelets (TSP; $r^2=0.97$). The total number of primary rachis branches (TPRB) was only moderately positively correlated with TSP ($r^2=0.64$; FIG. 1). Apportioning the panicle into three zones, upper, middle and bottom, correlation of TSP with the number of upper, middle and bottom secondary rachis branches (USRB, MSRB and BSRB respectively) exhibited $r^2$ values of 0.66, 0.76, and 0.82, respectively. USRB was expected to have lowest correlation with TSP compared to BSRB due to acropetal reduction of SRBs within the rice panicles. On the other hand, TSP correlations with upper, middle and bottom primary rachis branches (UPRB, MPRB, BPRB respectively) showed much lower $r^2$ values of 0.4, 0.35, and 0.55, respectively. These results reinforced the idea of apportioning the panicle into three zones in order to appreciate which panicle trait modification held the promise of most gain for attaining optimal grain yield.

Example 2

New Genetic Loci Identified to Influence Upper Secondary Rachis Branches

Single-locus GWAS (slGWAS) underpinned genomic regions with significant association to various panicle architecture traits through 747,087 high quality bi-allelic SNP markers from 309 resequenced *indica* samples. The genotyping rate was 99.98% and minor allele frequency was greater than 10%. Genomic association was most pronounced for variation in USRB and a clear candidate region was demarcated by the slGWAS peak (FIGS. 2A-D). The quantile-quantile (QQ) plot (FIG. 2B) revealed that the effects of confounding factors such as population structure did not increase the rate of false positives in the GWAS. Results showed prominent peaks on Chromosomes 1 and 2 with 230 significant SNPs of q-values <0.05 (FIG. 2A, Table A in T) with genetic variance of 0.83. From the 230 significant SNPs, 33 were located on chromosome 1 and explained 0.62 of genetic variance ($\sigma^2 G$) in a 592.6 Kb interval between LOC_Os01g10680 to LOC_Os01g11660.

The 197 SNPs on chromosome 2 were mapped within a 126.4 kb interval with five distinct linkage disequilibrium (LD) blocks (FIG. 2B). The tagged markers found in this region exhibited equal beta-effects conferring genetic variance ($\sigma^2 G$) of 0.49. While all SNPs showed positive effect to the trait of interest based on beta coefficients ($\beta > 0.2880$), a single significant SNP (snp_02_14377682) in LOC_Os02g24780 showed high negative effect ($\beta = -0.5851$, p=1.0597e-05) on the USRB. Among the five linkage disequilibrium (LD) blocks, haplotypes defined, based on the tag SNPs within LD block 4, clearly distinguished a wide range of phenotypes for high and low USRB (FIG. 2C).

Figure 9:
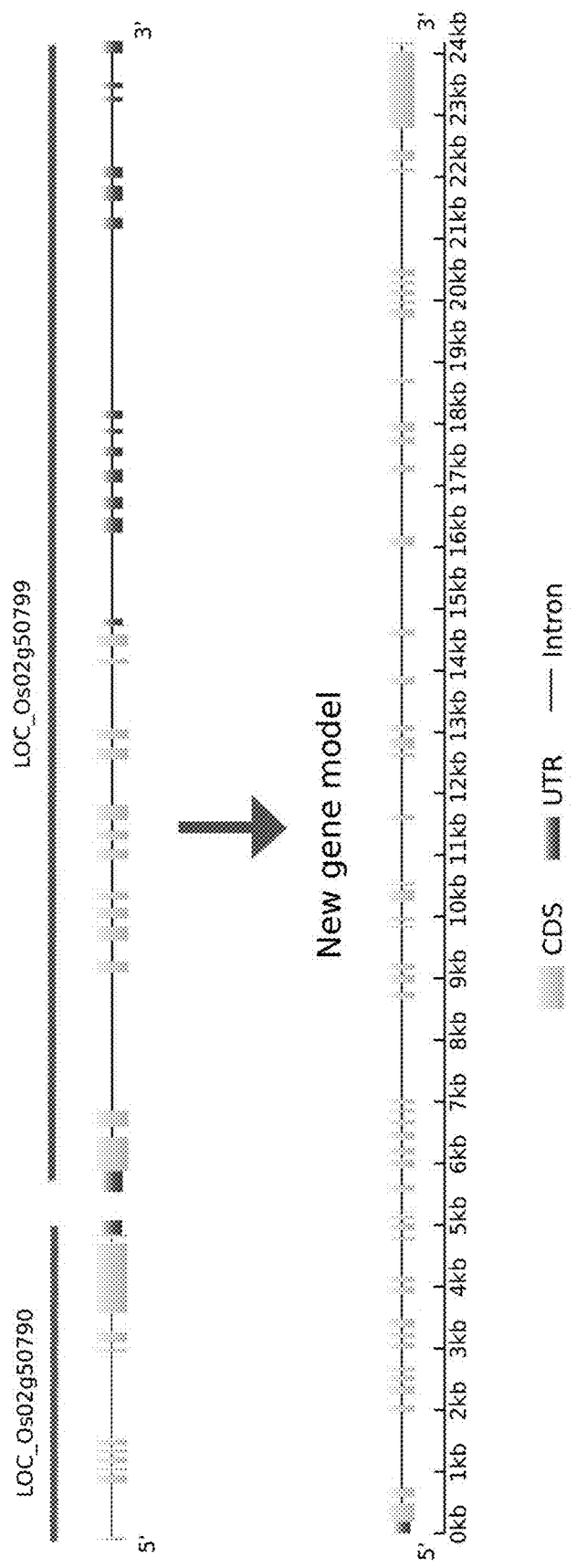
FIG. 9 shows the OsTPR gene structure. Gene model prediction revealed one long gene (24,444 bp) consisting of LOC_Os02g50790 (SEQ ID NO: 25) and LOC_Os02g50799 (SEQ ID NO: 27) which both encode nuclear-pore anchor proteins (SEQ ID NO: 26 and SEQ ID NO: 28, respectively).

To identify multi-marker cumulative effect, gene-set analysis was performed. Based on the gene level analysis, top 10 genes significantly associated to USRB with highest p-values were identified (not shown). The strongest association (p=0.013498) with USRB was detected in the gene set consisting of LOC_Os02g50700, LOC_Os02g50790 and LOC_Os02g50799. The two latter candidate genes (LOC_Os02g50790 and LOC_Os02g50799) were annotated in public databases as two separate genes with homology to nuclear pore anchor proteins. Both were related to flower development through gene ontology. However, gene model prediction using 'AUGUSTUS' with *indica* training set confirmed these to be a single gene of 24,444 bp encoding a protein of 2050 amino acids (FIG. 9). LOC_Os02g50790/LOC_Os02g50799 encodes an orthologue of the *Arabidopsis* translocated promoter region gene (AtTPR) belonging to nuclear pore complex (FIGS. 15-17). Therefore, it was called OsTPR. Interestingly, 60 SNPs were found in OsTPR. Among them, six SNPs were missense mutations causing amino acid changes. One such amino acid change was located in the TPR domain (c.3480A>C;p.Gln1160His; FIG. 16). In addition, one SNP was in the promoter region (snp_02_31035009) at a potential SPL3/SPL14 transcription factor binding motif of 5'-TNCGTACAA-3' (FIG. 3).

Example 3

Haplotype Analysis of OsTPR for Increased Panicle Branching and Yield

Haplotype analysis for OsTPR formed from the significant SNPs revealed that lines with high USRB contained the 'superior' haplotype1 (AGGATCA, SEQ ID NO: 1). In comparison, lines with low USRB were associated with 'inferior' haplotype2 (TATTCGG, SEQ ID NO: 2), haplotype3 (TATTCCG, SEQ ID NO: 3) and haplotype4 (TATACCG, SEQ ID NO: 4; FIG. 3). The direct proportionality between USRB and TSP reflected in that the superior haplotype had relatively high TSP, potentially leading to increased yield parameters. Haplotype3 had lowest USRB. The OsTPR promoter region in lines with high and low USRB contained binding motifs for SPL3 and SPL14 although lower p- and E-values were observed for latter (FIG. 3).

Importantly, lines of haplotype 1 had low chalk content and those with haplotype 3 had high chalk content. This result suggested an association of OsTPR with increased USRB and TSP without compromising the grain quality. Additionally, analysis of grain quality traits indicated that the amylose content, gel temperature, viscosity, retrogradation, and cooking traits such as the cooked grain length and width (FIG. 10), were better or maintained in the OsTPR haplotype 1 grains on USRB.

Figure 4A:
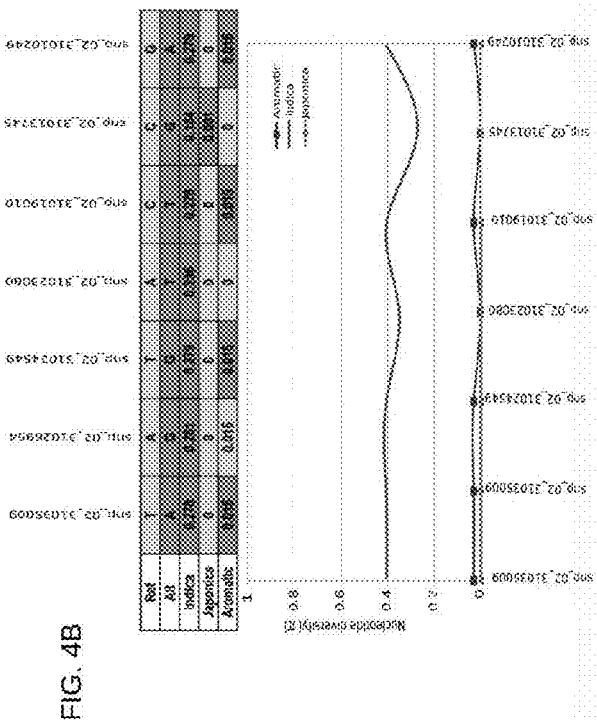
Figure 4B:
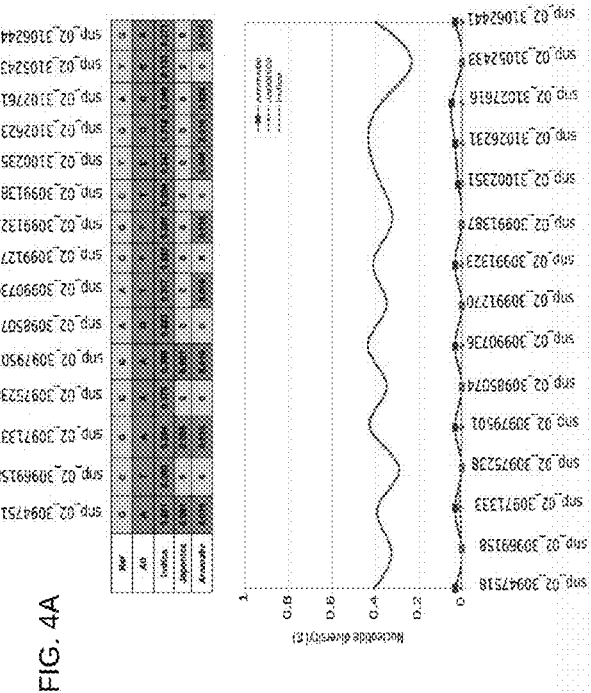
Figure 4C:
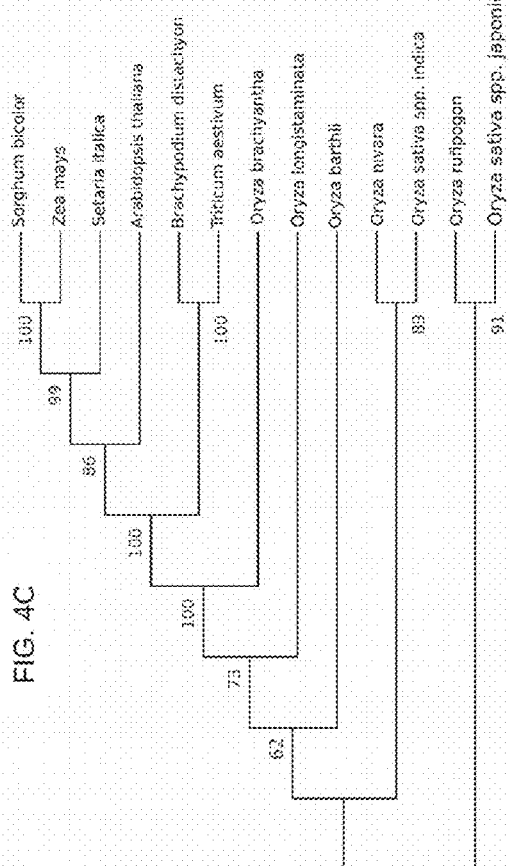

Allele mining using 3 k rice genomes revealed that within the *indica* subgroup the superior haplotype 1 was enriched while the inferior haplotype 3 was least represented (FIG. 3). The superior haplotype1 was not found in *japonica* subgroup suggesting its importance as an approach for improving the *japonica* rice lines. Phylogenetic analysis of 13 putative OsTPR homologues revealed that the *indica* haplotype was related to *O. nivara* while the *japonica* one was likely derived from *O. rufipogon* (FIGS. 11A-D). To test whether the 7 SNP haplotype, which is significantly associated with increased USRB, was differentially selected at the subgroup level, nucleotide diversity was calculated. It was found to be significantly higher in *indica* indicating its preferential selection compared to the aromatic and *japonica* sub-types (FIGS. 4A-C).

Example 4

Identification of Genetic Variants that are Associated with Primary and Secondary Rachis Branches Contributing to Increased Grain Number Since slGWAS does not account for small to medium effect loci, multi-locus GWAS (mlGWAS) analysis was used to identify the integrated effect of multiple markers on the phenotype and determine genomic regions of significant association with panicle branching traits and number of total spikelets. Additional 208 loci were identified across the 12 chromosomes for significant associations with different panicle architecture traits (not shown).

Figure 5:
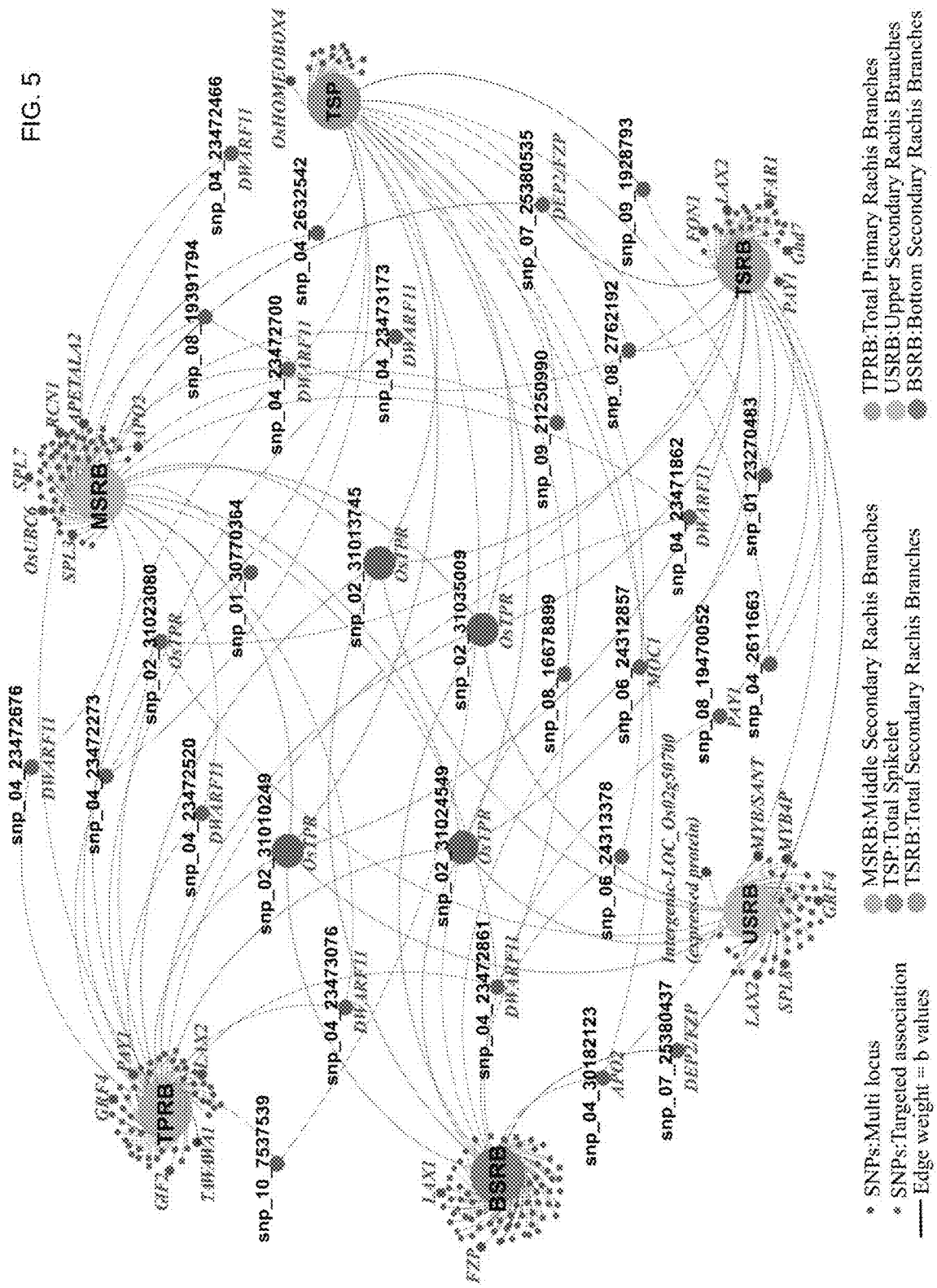

Among them were several important transcription factors and hormone responsive genes (FIG. 5). These included genetic variants in the upstream region of HOMEOBOX4 (HOX4), which strongly associated with TSP (LOD score 7.84); a SNP downstream of TAWAWA1 for TPRB (LOD score 7.79) and a non-synonymous SNP in FAR1-related gene for TSRB (LOD score 4.1). Additional SNP variants were identified among transcription factor genes (FIG. 5) encoding OsMYB4P and OsMYB/SANT (strongly associated for USRB); OsUBC6 and an APETALA2 (AP2) domain-containing protein (associated with MSRB); and OsFBOX75 and OsFBOX252 proteins (associated with BSRB). Among the genes identified in mlGWAS analysis only one was a cloned gene (TAWAWA1) validated to affect panicle architecture in rice.

Many SNPs found in the 37 genes (transcription factor and hormone responsive genes previously cloned useful in yield/flower/panicle traits) exhibited small to intermediate effect associations with primary and secondary rachis branching traits (not shown). To identify the association between sub-traits of branching with TSP, association networks for genetic variants identified from slGWAS, mlGWAS and targeted association approaches were delineated. Interestingly, DWARF11 and MOC1 contribute to increase in total spikelets due to increased number of rachis branches of MSRB, TPRB and BSRB (FIG. 5); Thus association network identified DWARF11 and MOC1 as central regulators to increase TSP by increasing secondary branching at the middle and bottom portion of panicles. The DWARF11 and MOC1 in such lines were thus the superior haplotypes. These lines also maintained superior grain quality (FIGS. 11A-D). Similarly, the superior haplotypes of OsTPR and OsMYB4P which associated with USRB contributed to increased total spikelets without impairing grain quality in terms of chalk content (FIGS. 12A-D). Interestingly however, lines that possessed superior haplotypes for all the four genes of DWARF11, MOC1, OsTPR and OsMYB4P exhibited additional total spikelet increase (median of 250) with higher number of filled spikelets per plant, due to recombined superior haplotypes of USRB, MSRB and BSRB (FIG. 6) and also exhibited slightly reduced number of panicle per plant. These naturally pyramided lines (IRIS_313-9472, IRIS_313-8903, IRIS_313-10396, IRIS_313-9832, IRIS_313-9605) with higher total spikelets (FIG. 6) had no trade-off with percentage of chalk and head rice yield (FIGS. 12A-D). When additional grain quality parameters and yield parameters were assessed, results demonstrated that when the superior allele of OsTPR was present, the increased number of spikelets (by virtue of increased upper secondary rachis branching) maintained superior grain quality (FIGS. 10, 12A-D). These results proposed that the novel gene identified, namely OsTPR, for the first time, enhance yield parameters without negative effect on grain quality.

Example 5

Figure 7A:
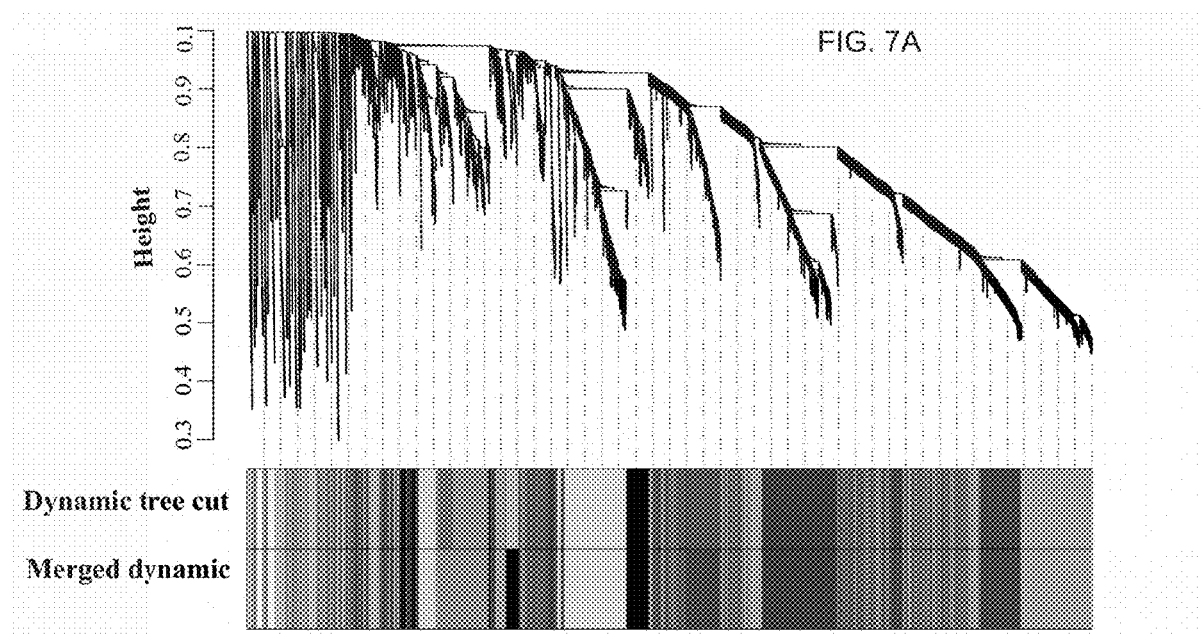
Figure 7B:
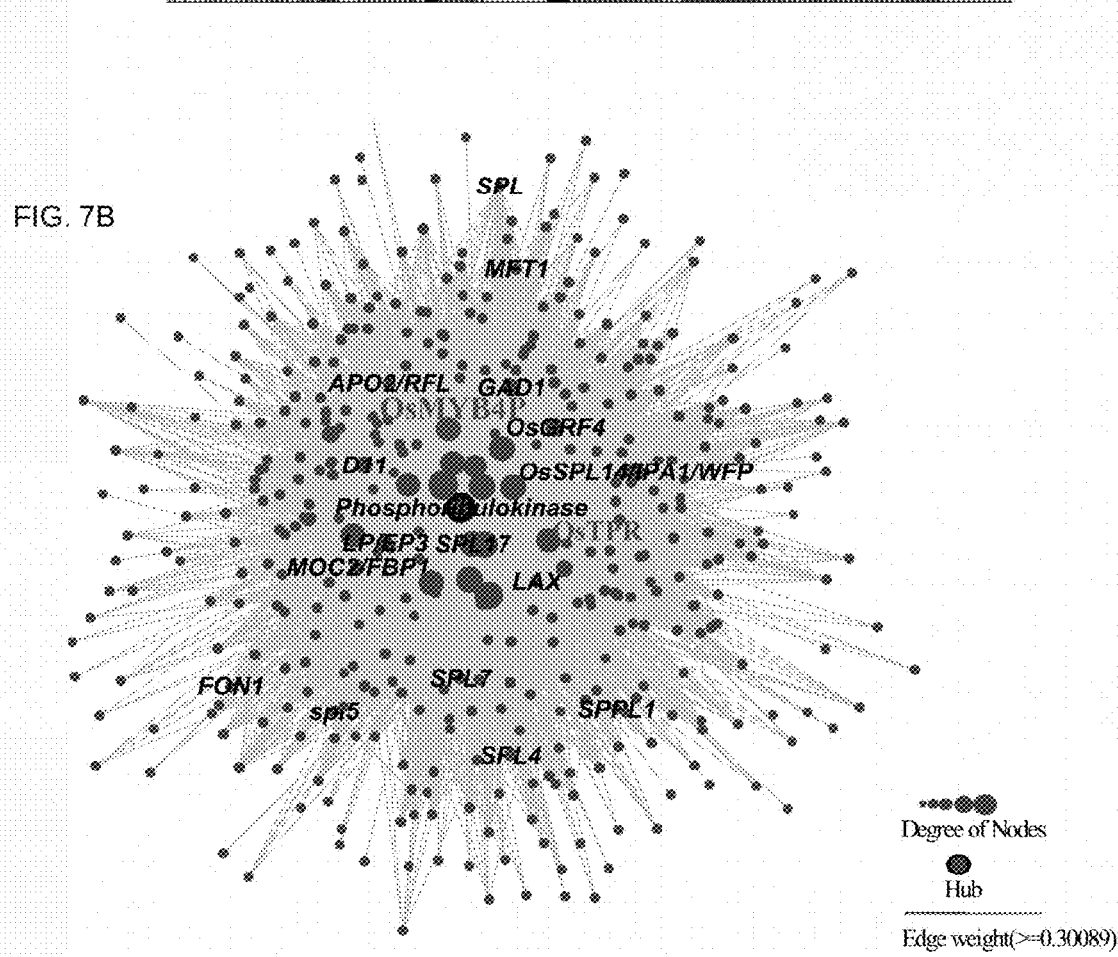

Integrating Genetic Variants Identified in GWAS with Coexpression Networks of Panicle Development To overcome any spurious association sometimes predicted by GWAS, genetic variants identified through slGWAS, mlGWAS, and targeted association approaches were linked to the transcriptome co-expression networks data at panicle development stage. This elucidated increased connectivity of nodal genes linked to key candidate genes as the central hub. The co-expression analysis of 5,041 genes, expressed during panicle development, clustered them into 17 modules (FIG. 7A). Among them, the blue module (FIG. 7B) possessing the phosphoribulokinase (LOC_Os02g47020) gene as central hub depicted high degree of connectivity with the 866 nodes with edge weight ≥0.3. Within this module, critical panicle architecture genes such as OsMyB4P and OsTPR displayed high to moderate degree of connectivity. Genetic variants of these two genes strongly associated with USRB phenotypes (FIGS. 12A-D). Further, analysis of the first neighbors of OsTPR identified 243 closely associated nodes (FIG. 14A). Major functional categories of genes coexpressed in the sub-module of OsTPR belong to cell cycle organization, photosynthesis, RNA regulation, developmental process, and protein synthesis. Important transcription factors such as G2-like, HB, MYB, bZIP, ARF, bHLH, C2C2(Zn)CO-like, zf-HD, GRF, $C_2C2(Zn)$GATA were found to be closely linked (FIG. 14A). Also, several genes involved in panicle branching linked with OsTPR at a higher degree of connectivity (FIG. 14A). These include OsGRF4 (LOC_Os02g47280) and LAX1 (LOC_Os01g61480) that associate with USRB; SPL7 (LOC_Os05g45410) associated with MSRB, andA PO2/RFL (LOC_Os04g51000) associated with BSRB. The genetic variants of these were validated in our targeted association analysis (not shown). In the same module, several SPL family members were found which includes SPL14/IPA1/WFP (LOC_Os08g39890), SPL5 (LOC_Os07g10390), SPL4 (LOC_Os02g07780), SPL (LOC_Os01g01080), SPPL1 (LOC_Os10g25360). Other key genes such as GAD1 (LOC_Os08g36320), Dwarf11 (LOC_Os04g39430), MOC2/FBP1 (LOC_Os01g64660), FON1 (LOC_Os06g50340), and MFT1 (LOC_Os06g30370) were linked with panicle architecture traits (FIG. 14A).

Further evidence for the importance of OsTPR protein came from protein-protein interactions (FIG. 14B). It suggested a role in positive activation of the nuclear pore protein (NPP, LOC_OSI1g42420). NPP binds with OsLIC, a transcriptional activator involved in rice plant architecture regulation. The NPP also interacts with a SAC3/GANP protein (LOC_Os07g45160) potentially involved in nuclear mRNA export. Two Ulpl proteases (LOC_Os03g29630 and LOC_Os03g22400 proteins), and a small ubiquitin-like modifier (SUMO) protease (LOC_Os01g25370), have gene ontology of flower development (GO:0009908) aside from hydrolase activity (GO:0016787) and protein modification process (GO:0006464). These three proteases are localized in the nucleus and potentially interact especially LOC_Os01g25370 and LOC_Os03g22400. Thus, OsTPR interacts with proteins involved in ubiquitination and SUMOylation pathway influencing plant architecture regulation (FIG. 14B). The *Arabidopsis* orthologue of TPR is also a SUMO interacting protein (Xu et al 2007).

Example 6

Breeding Proof of Concept to Increase the Upper Secondary Rachis Branching Methodology (Shown in FIG. 18)

The $F_5$-derived $F_6$ Recombinant Inbred lines (RILs) has been developed using single seed descent (SSD) method by employing the hybridization between high amylose mutant IR36ae (possess inferior haplotype of OsTPR TATTCGG haplotype SEQ ID NO: 2) and superior haplotype of OsMOC1 CG haplotype) and Samba Mahsuri (possess superior haplotype of OsTPR AGGATCA haplotype SEQ ID NO: 1) and inferior haplotype of OsMOC1 GA haplotpe). The Sambha Mahsuri parent is one of the most popular varieties consumed mainly across India due to its excellent cooking and eating qualities.

A total of 369 $F_3$ progenies were selected and eventually forwarded to advanced generation until $F_5$, utilizing single seed descent (SSD) method through rapid generation advancement. During the 2019 wet season a field experimental trial was conducted by growing a set of selected 298 $F_5$ progenies in randomized complete block design with 2 replications, which were eventually termed as $F_{5:6}$ RILs population. Out of them, a total of 280 samples from SM x IR36ae $F_5$ population was successfully phenotyped using GIMP and P-TRAP software. Genotype data for the candidate genes OsTPR and OsMOC1 identified previously using in silico approaches were obtained using the KASP genotyping assay technology. In the diversity panel GWAS analysis, AGGATCA (SEQ ID NO: 1) was the superior haplotype identified for TPR based on the reference genome Nipponbare. In the current genotype data generated using KASP genotyping assay technology, the complementary alleles of TPR haplotype TCCTAGT were generated since the TPR gene is in the negative strand (3' to 5'). Samples with missing genotyping data for the significant SNPs in each candidate gene were removed. In addition, lines containing heterozygotes were also removed when forming the haplotypes. Lines possessing haplotypes with homozygous alleles for OsTPR and OsMOC1 are 210 and 251 samples, respectively. A total of 195 samples have complete phenotype and genotype data for OsTPR and OsMOC1 haplotypes. Comparison of haplotype effects of OsTPR, OsMOC1, and combination of OsTPR and OsMOC1 with measured 21 panicle architecture phenotype data was done using t-test or Wilcoxon test. Boxplots were constructed using ggplot package in R after removing heterozygotes.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

It is the intent of the applicant(s) that all publications, patents and patent applications referred to in this specification are to be incorporated in their entirety by reference into the specification, as if each individual publication, patent or patent application was specifically and individually noted when referenced that it is to be incorporated herein by reference. In addition, citation or identification of any reference in this application shall not be construed as an admission that such reference is available as prior art to the present invention. To the extent that section headings are used, they should not be construed as necessarily limiting. In addition, any priority document(s) of this application is/are hereby incorporated herein by reference in its/their entirety.

REFERENCES

1. Zhu, Z. et al. Genetic control of inflorescence architecture during rice domestication. *Nature Communications* 4, 2200 (2013).
2. Sweeney, M. & McCouch, S. The complex history of the domestication of rice. *Annals of Botany* 100, 951-957 (2007).
3. Ikeda-Kawakatsu, K. et al. Expression level of ABERRANT PANICLE ORGANIZATION1 determines rice inflorescence form through control of cell proliferation in the meristem. *Plant Physiology* 150, 736-747 (2009).
4. Ikeda, K., Sunohara, H., & Nagato, Y. Developmental course of inflorescence and spikelet in rice. *Breeding Science* 54, 147-156 (2004).
5. Ying, J., Chen, Y., & Zhang, H. *Functional Characterization of Genes/QTLs for Increasing Rice Yield Potential, Rice: Germplasm, Genetics and Improvement* (ed. Yan, W.) DOI: 10.5772/51100 (InTech, 2014).
6. Xing, Y. & Zhang, Q. Genetic and molecular bases of rice yield. *Annual Review of Plant Biology* 61, 421-442 (2010).
7. Li, X. et al. Control of tillering in rice. *Nature* 442, 618-621 (2003).
8. Huang, X., et al. Natural variation at the DEP1 locus enhances grain yield in rice. *Nature Genetics* 41, 494-497 (2009).
9. Tabuchi, H. et al. LAX PANICLE2 of rice encodes a novel nuclear protein and regulates the formation of axillary meristems. *Plant Cell* 23, 3276-3287 (2011).
10. Ashikari, M. et al. Cytokinin oxidase regulates rice grain production. *Science* 309, 741-745 (2005).

11. Fujita, D. et al. NAL1 allele from a rice landrace greatly increases yield in modern *indica* cultivars. *Proceedings of the National Academy of Sciences*, USA 110, 20431-20436 (2013).
12. Komatsu, M., Chujo, A., Nagato, Y., Shimamoto, K., & Kyozuka, J. FRIZZY PANICLE is required to prevent the formation of axillary meristems and to establish floral meristem identity in rice spikelets. *Development* 130, 3841-3850 (2003).
13. Chen, J. et al. An evolutionarily conserved gene, FUWA, plays a role in determining panicle architecture, grain shape and grain weight in rice. *The Plant Journal* 83, 427-438 (2015).
14. Sun, P. et al. OsGRF4 controls grain shape, panicle length and seed shattering in rice. *Journal Integrative Plant Biology* 58, 836-847 (2016).
15. Wu, Y. et al. CLUSTERED PRIMARY BRANCH 1, a new allele of DWARF11, controls panicle architecture and seed size in rice. *Plant Biotechnology Journal* 14, 377-386 (2016).
16. Yoshida, A. et al. TAWAWA1, a regulator of rice inflorescence architecture, functions through the suppression of meristem phase transition. *Proceedings of the National Academy of Sciences, USA* 110, 767-772 (2013).
17. Lu, L. et al. Natural variation and artificial selection in four genes determine grain shape in rice. *New Phytologist* 200, 1269-1280 (2013).
18. Weng, X. et al. Grain number, plant height, and heading date7 Is a central regulator of growth, development, and stress response. *Plant Physiology* 164, 735-747 (2014).
19. Miura, K. et al. OsSPL14 promotes panicle branching and higher grain productivity in rice. *Nature Genetics* 42, 545-550 (2010).
20. Mohapatra, P. K. A *Physiological Approach to Design Rice Panicle Architecture in the Quest for High Grain Yield, International Dialogue on Perception and Prospects of Designer Rice* (eds. Muralidharan, K. & Siddiq, E. A.) 131-142 (Directorate of Rice Research, 2013).
21. Matsue, Y., Odahara, K., & Hiramatsu, M. Differences in protein content, amylose content and palatability in relation to location of grains within rice panicle. *Japanese Journal of Crop Science* 63, 271-277 (1994).
22. Matsue, Y., Odahara, K., & Hiramitsu, M. Differences in amylose content, amylographic characteristics and storage proteins of grains on primary and secondary rachis branches in rice. *Japanese Journal of Crop Science.* 64, 601-606 (1995).
23. Das, K. et al. Grain density and its impact on grain filling characteristic of rice: mechanistic testing of the concept in genetically related cultivars. *Nature Scientific Reports* 8, 4149 (2018).
24. Adriani et al. Rice panicle plasticity in Near Isogenic Lines carrying a QTL for larger panicle is genotype and environment dependent. *Rice* 9, 28 (2016).
25. Wang, F., Cheng, F., & Zhang, G. Impact of cultivar variation in grain density of rice panicle on grain weight and quality. *Journal of the Science of Food and Agriculture* 88, 897-903 (2008).
26. Nhung et al. A genome-wide association study using a Vietnamese landrace panel of rice (*Oryza sativa*) reveals new QTLs controlling panicle morphological traits. *BMC Plant Biology* 18, 828 (2018).
27. Crowell, S. et al. Genome-wide association and high-resolution phenotyping link *Oryza sativa* panicle traits to numerous trait-specific QTL clusters. *Nature Communications* 7, 10527 (2016).
28. Rebolledo, M. C. et al. Combining image analysis, genome wide association studies and different field trials to reveal stable genetic regions related to panicle architecture and the number of spikelets per panicle in rice. *Frontiers in Plant Science* 7, 1384 (2016).
29. Panda, B. B. et al. Compact panicle architecture is detrimental for growth as well as sucrose synthase activity of developing rice kernels. *Functional Plant Biology* 42, 875-887 (2015).
30. Krull, S., Thyberg, J., Bjorkroth, B., Rackwitz, H. R., & Cordes, V. C. Nucleoporins as components of the nuclear pore complex core structure and Tpr as the architectural element of the nuclear basket. *Molecular Biology of the Cell* 15, 4261-4277 (2004).
31. Jacob, Y., Mongkolsiriwatana, C., Veley, K. M., Kim, S. Y. &, Michaels, S. D. The nuclear pore protein AtTPR Is required for RNA homeostasis, flowering time, and auxin signaling. *Plant Physiology* 144, 1383-1390 (2007).
32. Tanya, Z. B. et al. The *Arabidopsis* Information Resource: Making and mining the "gold standard" annotated reference plant genome. *Genesis* 53, 474-485 (2015).
33. Yates, G., Srivastava, A. K., & Sadanandom, A. SUMO proteases: uncovering the roles of deSUMOylation in plants. *Journal of Experimental Botany* 67, 2541-2548 (2016).
34. Murtas, G. et al. A nuclear protease required for flowering-time regulation in *Arabidopsis* reduces the abundance of SMALL UBIQUITIN-RELATED MODIFIER conjugates. *The Plant Cell* 15, 2308-2319 (2003).
35. Wang, L. et al. OsLIC, a novel CCCH-type zinc finger protein with transcription activation, mediates rice architecture via brassinosteroids signaling. *PLOS One* 3, e3521 (2008).
36. Wolfe, C. J., Kohane, I. S., & Butte, A. J. Systematic survey reveals general applicability of "guilt-by-association" within gene coexpression networks. *BMC Bioinformatics* 6, 227 (2005).
37. Preston, J. C. & Hileman, L. C. Functional evolution in the plant *SQUAMOSA*-PROMOTER BINDING PROTEIN-LIKE (SPL) gene family. *Frontiers in Plant Science* 4, 80 (2013).
38. Cardon, G. H., Hohmann, S., Nettesheim, K., Saedler, H., & Huijser, P. Functional analysis of the *Arabidopsis thaliana* SBP-box gene SPL3: a novel gene involved in the floral transition. *The Plant Journal* 12, 367-377 (1997).
39. Wu, G. & Poethig, R. S. Temporal regulation of shoot development in *Arabidopsis thaliana* by miR156 and its target SPL3. *Development* 133, 3539-3547 (2006).
40. Stone, J. M., Liang, X., Nekl, E. R. & Stiers, J. J. *Arabidopsis* AtSPL14, a plant-specific SBP-domain transcription factor, participates in plant development and sensitivity to fumonisin Bl. *The Plant Journal* 41, 744-754 (2005).

41. Zhou et al. GNS4, a novel allele of DWARF11, regulates grain number and grain size in a high-yield rice variety. *Rice* 10, 1-15 (2017).
42. Xu et al. Developmental functions of miR156-regulated SQUAMOSA PROMOTER BINDING PROTEIN-LIKE (SPL) genes in *Arabidopsis thaliana*. *PLOS Genetics* 12, e1006263 (2016).
43. Al-Tam, F. M. et al. P-TRAP: A panicle trait phenotyping tool. *BMC Plant Biology* 13, 122 (2013).
44. Fusi, N., Lippert, C., Lawrence, N. D. & Stegle O. Warped linear mixed models for the genetic analysis of transformed phenotypes. *Nature Communications* 5, 4890 (2014).
45. Chang C. C. et al. Second-generation PLINK: rising to the challenge of larger and richer datasets. *Gigascience* 4, 7 (2015).
46. Tabangin, M. E., Woo, J. G., & Martin, L. J. The effect of minor allele frequency on the likelihood of obtaining false positives. *BMC Proceedings* 3, Suppl7 (2009).
47. Kang, H. M. et al. Variance component model to account for sample structure in genome-wide association studies. *Nature Genetics* 42, 348-354 (2010).
48. R Core Team. R: A language and environment for statistical computing (R Foundation for Statistical Computing, Vienna) Available at: www(dot)R-project(dot)org (2018).
49. Lin, Y. & Lee, W. Importance of presenting the variability of the false discovery rate control. *BMC Genetics* 16, 97 (2015).
50. Barrett, J. C., Fry, B., Maller, J., & Daly, M. J. Haploview: Analysis and visualization of LD and haplotype maps. *Bioinformatics* 21, 263-265 (2005).
51. de Leeuw, C. A., Mooij, J. M., Heskes, T., & Posthuma, D. MAGMA: Generalized gene-set analysis of GWAS data. *PLOS Computational Biology* 11, e1004219 (2015).
52. Kawahara, Y. et al. Improvement of the *Oryza sativa* Nipponbare reference genome using next generation sequence and optical map data. *Rice* 6, 4 (2013).
53. Misra et al. Deciphering the genetic architecture of cooked rice texture. *Frontiers in Plant Science* DOI: 10.3389/fpls.2018.01405 (2018).
54. Bradbury, P. J. et al. TASSEL: Software for association mapping of complex traits in diverse samples. *Bioinformatics* 23, 2633-2635 (2007).
55. Wickham, H. ggplot2: *Elegant Graphics for Data Analysis* (Springer-Verglag, New York) Available at www(dot)ggplot2(dot)org (2016).
56. Shannon, P. et al. Cytoscape: A software environment for integrated models of biomolecular interaction networks. *Genome Research* 13, 2498-2504 (2003).
57. Wu, R. I., MacDonald, J. & Gentry, J. gcrma: *Background Adjustment Using Sequence Information*. Available at: www(dot)bioconductor(dot)org/packages/release/bioc/html/gcrma(dot)html (2018).
58. Hassani-Pak, K. *KnetMiner-An integrated data platform for gene mining and biological knowledge discovery* (Universitat Bielefeld, Bielefeld) Available at: www(dot)pub(dot)uni-bielefeld(dot)de/publication/2915227 (2017).
59. Kudo, T. et al. UniVIO: A multiple omics database with hormonome and transcriptome data from rice. *Plant Cell Physiology* 54, e9 (2013).
60. Langfelder, P. & Horvath, S. WGCNA: an R package for weighted correlation network analysis. *BMC Bioinformatics* 9, 559 (2008).
61. Zhang, B., & Horvath, S. A general framework for weighted gene co-expression network analysis. *Statistical Applications in Genetics and Molecular Biology* 4, 17 (2005).
62. Gupta, S., Stamatoyannopoulos, J. A., Bailey, T. L., Noble, W. S. Quantifying similarity between motifs. *Genome Biology* 8, R24 (2007).
63. Khan, A. et al. JASPAR 2018: update of the open-access database of transcription factor binding profiles and its web framework. *Nucleic Acids Research* 46, 260-266 (2018).
64. Szklarczyk, D. et al. The STRING database in 2017: quality-controlled protein-protein association networks, made broadly accessible. *Nucleic Acids Research* 45, 362-368 (2017).
65. Solovyev, V., Kosarev, P., Seledsov, I., Vorobyev, D. Automatic annotation of eukaryotic genes, pseudogenes and promoters. *Genome Biology* 7, Suppl 1 (2006).
66. Stanke, M. & Waack, S. Gene prediction with a hidden Markov model and a new intron submodel. *Bioinformatics* 19, ii215-225 (2003).
67. Zhang, J. et al. Extensive sequence divergence between the reference genomes of two elite *indica* rice varieties Zhenshan 97 and Minghui 63. *Proceedings of the National Academy of Sciences, USA* 113, E5163-5171 (2016).
68. Altschul, S. F., Gish, W., Miller, W., Myers, E. W., & Lipman, D. *J. Basic* local alignment search tool. *Journal of Molecular Biology* 215, 403-410 (1990).
69. Thompson, J. D., Higgins, D. G. & Gibson, T. J. CLUSTAL W: improving the sensitivity of progressive multiple sequence alignment through sequence weighting, position-specific gap penalties and weight matrix choice. *Nucleic Acids Research* 11, 4673-4680 (1994).
70. Kumar, S., Stecher, G., Li, M., Knyaz, C., & Tamura, K. MEGA X: Molecular evolutionary genetics analysis across computing platforms. *Molecular Biology and Evolution* 35, 1547-1549 (2018).
71. Alexandrov, N. et al. SNP-Seek database of SNPs derived from 3000 rice genomes. *Nucleic Acids Research* 43, D1023-1027 (2015).
72. Danecek, P. et al. The variant call format and VCFtools. *Bioinformatics* 15, 2156-2158 (2011).
73. Yang, W. T., Baek, D., Yun, D. J., Hwang, W. H., Park, D. S., Nam, M. H., Chung, E. S., Chung, Y. S., Yi, Y. B., Kim, D. H. 2014. Overexpression of OsMYB4P, an R2R3-type MYB transcriptional activator, increases phosphate acquisition in rice. *Plant Physiol Biochem.* 80:259-67. doi: 10.1016/j.plaphy.2014.02.024.
74. Xu X. M., Rose A., Muthuswamy S., Jeong S. Y., Venkatakrishnan S., Zhao Q., et al. (2007). NUCLEAR PORE ANCHOR, the *Arabidopsis* homolog of Tpr/Mlpl/Mlp2/megator, is involved in mRNA export and SUMO homeostasis and affects diverse aspects of plant development. *Plant Cell* 19 1537-1548. 10.1105/tpc.106.049239.

SEQUENCE LISTING (34 sequences)

SEQ ID NO: 1 - DNA, 7 bp, Artificial sequence
  Haplotype 1 nucleic acid sequence
aggatca

SEQ ID NO: 2 - DNA, 7 bp, Artificial sequence
  Haplotype 2 nucleic acid sequence
tattcgg

SEQ ID NO: 3 - DNA, 7 bp, Artificial sequence
  Haplotype 3 nucleic acid sequence
tattccg

SEQ ID NO: 4 - DNA, 7 bp, Artificial sequence
  Haplotype 4 nucleic acid sequence
tataccg

SEQ ID NO: 5 - DNA, 31 bp, Artificial sequence
  HUSRB nucleic acid sequence
ttgatcgttccgtactaactaccaagtgagc

SEQ ID NO: 6 - DNA, 31 bp, Artificial sequence
  LUSRB nucleic acid sequence
ttgatcgttccgtaccaactaccaagtgagc

SEQ ID NO: 7 - DNA, 27944 bp, Oryza sativa
  misc_feature (1097)..(1097): snp_2_31035009
  misc_feature (9152)..(9152): snp_02_31026954( G>C): Glu>Gln
  misc_feature (11557)..(11557): snp_02_31024549(G>A):Glu>Lys
  misc_feature (13026)..(13026): snp_02_31023080 (T>A): Leu>Met
  misc_feature (17095)..(17095): snp_02_31019010 (A>C): Gln>His
  misc_feature (22361)..(22361): snp_02_31013745 (T>C): Val>Ala
  misc_feature (25857)..(25857): snp_02_31010249 (A>T): Met>Leu
atgcctgaaaaaaggggtaaaattgtggtttcctcaagattggatgtgggtgtagggatggtgcacgaatgtagacagatgtgagatttgtgattgcttccagcactgctttgaaatatctatgtattgtatctggactatgctgaaaccaatcttgaagtgtttcattggttgcattttttgccactgtatataagaatatagcaatatgctcttctactgaaacatatagtgccagttaggtactctttctcacgtaacttattgactagtgcatgaaaaatgtcgacctccatacggaagtttcttttgcataatctttcatgtcctgttaaaatctcatgtacacggcaaccccctgtaagttttgacgtgtgcattggtctcctaatacaagatgattgtgatgaatctcctaaagtaggcagaacaaaatgaatgaactcatcatcactttctgatatacgtcggtagcttggattcatggtgtgcagatgttaccaaactgatgctgtaaactcaaatagaagagagctaaaaatcaagacttttgctgaggaaaaaacaattttggtgcaccagatgaacaagtagtaccttgttgttacacgagcaagtaacgtccagctatggtggctagacgatgagtaaagcttctggaaaaattatgcagatagtgaagagaagagcaaaggatcagcaagcttcttccacagttgatgagcaaatagaaagaacaggggaaaatggtgcacaaggctaacgagggctatttatgcacttcaaagctaacggctagttgagggccgatgtcagttgatgcaaacttaaaaaaatatatttcaaacggcagatttcctacacttctcctgcggtatatccgaatgcacactttttttaaattcctgacgtttagcttcccataggattggactccacagctatccctattccttcatttttcctaatcctatgagtgaaaaaatcctttaaaacgagtaagcccttactgtgacgatcagtatttatcgggaacggggtctttccttttcttttggaggctttaacttcttccagcattttgaccgttccgtacnaactaccaagtgagcttctgatggttttgtctaagaaaaccatgatttggcgatggcagcctttattgaaagacataccaagcgctgggtggtcacatctcagggcttgtttggtagaactctaacttataaatttagcttcaagagttgggtctggagtgaagttgtggagctgtctaaacccagctttacctttctagttcattttatgagagaacactagctccgctcccatttcaggtggagctgaaacggtttggttgagctccagctccgggagaggtggagttggagctggagctgtgacaaacaggccctcagttcctagatttgcattgacgctccaacgggaatattcgtgcacaagtaatcgagttttgtatatttaccgacgaatggaatacgcatatttttttttctttacttgaactcccgtgcagtgcactggagatgacatcattagagcatcaccaagagattacatataacctctaaaaatttgtttttttttcataaactcaaaataggaaacaaaataagtaatatcttaaagaaaaacctaaattttattaaaaaaaatataaaagtgagaccttattaaactaccaaaagaatttccattttacttcgtcagcgcacactatctcctggcgctcccctgaagccgcgccaggagaggaggaaggtgggagcagctagattggaagtgggcaaggaagccgctttctcccgtatatcaacagagcaaatatttcgggaaagagaactccaaaaatcatgcaactgagtaagggactcgtttgagtgctttctttcactaaaatccctcaaaattgattttgagatgaaatagggataaaatagaaggactgttggtgatgcttatttattctcctgttttatagggttttaacgaattgagatcaaatacagtagctattaggactgcacacaatctgagccctctatgtctaaatctaacggccaaaaaggatttggcacagtacaattagaacagtacccttccacagtaaaatgctacagtgttttctacagtctcagatgtatctcggacgtccatttttaatcatgcgatgctagtgtgactgcttatcttgcatcacactagctactgcacctgaatcgggtccggtttaaacatgtgaaactcggaaacggctttttagacgaagacagcccacaaactcataggcctacacgccacagcccgagaaacagaagcccagcaatccggcccaaacaagtcactcagcagtcagcaggtctcacaggcccaccagatagtccatgggccttgggccgagcctatccgaccgccttcacgcgtccttccttccgacctatatttctgcctcgccctcctctcgccccttccccttcgcgtttgcgtttcctccgcctcctcactccaattccattcgccttccgccaccaccacccttggctcctcccctccccgcggggcgcgcgacaaaccctagaaccttctagaggctagagcggtagagccatccgcgagggccccgggcgggctaggggcgccgcctacccgaccccgcacgcggcggcgatgccgctcttcatgtcggaggaggagctgcggctcttgggcggtgacgtggccgccgtcgccgagcgggccgacgccgccatccgcgagctccggcagcaggtggacaccgtccgtgccgaggccgacgcggcggccatcgcggcggagcagacgtgcgccctcctcgagcagcgctacgacactctctccgccgaggccgatcgcttccgggccgagctagccgagctcgcggctgcctccgagcgccgcgccgccgatctcgcctcttcccagtccgagatacaccagctccgcatccaagccgtacgaaccctagtttttatttgggttcagctcagtttttcggcttagctgaggtcacactgatcactctgtgctgctgatggggtttgcagattgcgaaggatggcgagattgaacggctgaaagtagaaatctcggaggtgcacaagtccaagtcgcagtcactggaactaattgagcagagggatgcagagataagggagaaggatggcatcatccagaactacctcgataaaatagtaagccatcctgaccattttgtactcccacttctagtgatgcacagcatccagcaaaattggaactccatatctaaggtgatgtgcgaatataggatcatatggataagttgttatccagtgcaatgcctaggttgctactgtcgacaaacagaggacgggggttttatgatgttctaagacttgaagtagctttccttttaaccctagtcagagggtaggtcagttgcttgataggttttacaacagaaattttgtggcttcaataggccacaaaatttgttttcctcattttgcatgttacttggcagaagttgagttgcatgtgtatgagacacaactgcattttgtatgagttgttacccgaacgtcagacatgattttaactcgatttacctgtagttttacgtctgtctccatacttttttattttacatgtagtagcaagttgaatttttattttatttatgcatcagaggtcatccttatcggatacttcaaatgaaaaatacacatttaaattatttttcgtaatatcagttactggcattctatttcagttctttgggcattgcttagttgatatgccgtttcaataaataaaacgtaccatatgaattataatgactttgcaattttaaataagttgttgctttgttgtagtgttctgatcgtataactttacatgctactttttttttgtgcctatcatgaacattcatatcagtctagactgtttaagatactcaattgtgtatcgtaccttacatgttatgtatcattccttgcatgttgcgatcaacttttgagtgtcggacttattgtatgtaagatatctgcgatactgttagatctcattgcctagtttggagtattggagatttccccgattcgatgtaggaatattcatttatttccgtaaaattcatttgttccaattggacccatactttttcttaaaatttactctgtagtttttctgttggataattttgaccttattaatgtgtcactattgaaccttctgtataatcaaggaattcatgtgatttggtatgcttatattcaatatcattttattagcaatcgcaagcgctaggccttattcactctagttggtaagtcctttagtttttcgcatttttgagatatctatgccctttcatcctgggaactgggaagattttgttttgcattttgttgcataaattaactgtagttgttgaatcggtcttcctgtcaggtaaatctggcagactcttctgctagtaaaggggcaaggatacaagaagttgaagctaagtttactcatctgcaggccacatgtaaccgaattacgcaggtatgctataaacaatttggtgttattttgctgcgtaagattgtagtataaggtgatgcaaagtctttcttgagttgtagactactacctaatctgttatccatggagttttactttaattgtacctattccatatgtttgcacagagcaaccgttggttcttatttagtactttcctgtttaggagaaagatctgcttgaaaagcataatctctggcttgacgaggaacttaaagaaaaagtgaagaacttagctgaactaaggaaatcaaacatggatgaggaggctaggatgtcagcaaaggttgccgaggtgagtcctattccaaccttgacatgtgacataatgcaagcagaaagcaaaacctgattatgttggtttcagcttgaaagagagacttctgaatcatccagttccttgaggcgaagcaaagaacgggtttctgaattggagcaaagggtatcatatatggaaaaggtaaattgtcagatttgttagcttttgtattattgccatcatctaatttttgctttgctttgcttttatgatctaaaggagttgtgctcaacaaaggatgctgcagctgctaatgaacaacgcctggctgcagagctttcaactgtatggtttacctttattcccattaacccccccttgtttatttcacccttactgctcccactccctgcttgtttaaattttagaaaggaaatggaagaaaatgtgtgctgagctatttgtactagaccagcagatcagtccatcgttattgtatatgcacacggcacaccacaacttaacccatctagtgtatctaggatatttctttttttttaatggaatgcactgatgttcctctctataagccaagtcgatgacgcttttaattattgccttttgttctgtttcccttaaaaggtcatgaaacttgctgaacttcacaaagaaagttctgaggaatggtcaaaaaaagcgggggaacttgaaggtgttattaaagcattggaggtaatgcctttacttgtatttaattttgccccgctcatgaacatgaaaatctaattattcttattatttttttcggtgtaaaccagacacatttgacccaggttgaagatgaatacaaggaaaagcttgagaaggagacttcagccaagagggaccttgaaatggtatattgattattattttggatggttttcttattgaaaaatcagtttgatattgtgagtttcttagttgatcttttggctttcatgctattcaggaagctacctacttaaagcaaaagcttgaaaagtgtgaatctgatctggagaatacaaggaaatctagtgaattgagcttcactccattggttgcagcagacccttgtgatctagcaggctcaccgatgaaagaaatgtattatttctgaaactttatacttttagtctagcgagatatctaaagcaggcgctattagcatagctaagtaacactttctagagagcattgttcaaggctttttgatattaattgtgttttgctcattaaagcttatcttattgaatgatgttaacttctgtttgtgctgtaccgttgtaaacatgatattatctttgtcccaacaccaatagttcccaaacattttgtagtcattccttattgtgttgataagtcactgatcatatctagctggtgctagggaaaaccatgatatgcaatgttttacaaatcataacagaaacacaggaaggagtatgatccaattattaaacaagaccttaattttcatctattttgaaattctttttgtttcctatttggcagggcattttctgatccagcaaatcagaatgatctaatgattgtaccaaaagtacctactggtgtttctggaactgcattagctgcttctcttcttcgtgatggttggagtgtatgtccaatctcctctatactgtttaatctgtgcatttacgtttcaaatattacctgattaccttcactgtgtcagctcgctaagatctatgagaaataccaagaagctactgatgctttgcgccatgagaggtttggacgaaggcacgcggaagcagttctggagagggtacagttctgttctcgtcagtttatctcttaatttgtattaatctctactctctttcccatgatcccatcatttccactttcctaatagatgttttagacatcaaaagtcaaaacagctttaaatacaaactttcaaccgtgccatattctatctatgtaaccacatggaagtagtccctcctctgagaaggttgaaatgcagatttgctaagttttgattacaaactcaccataatatggatagtcaaaatttcaaataatcggattatacgcattctaaaatgacatttttttgagatggagggagtacatcaattttcgcagatttacatttatttgagatggagggtgaacattaattttcactgatattctccaaggtttcaaatttatgattaatagttgatggtgtgagaagtgtttgtaaagtgcatgaagtaaacgcacatgtagtcctgtatcatattttgtgctaaatgggtaatcgtacttgtgcagggatgctctgttgcttttctcattgattcatttctgaagtgtcctattcctgttggattactgaattatcttttgttcaacaggtcttgcatgaaattgaagagaaagctgagcttatcttggatgaacgaggtaatgtgaaatgcatacattgcttcattgcctgatagtacactgattatgcttaagtttggacatgtatgcaattattttgtgctcaagcatatctttgcatttgaccctttcagctgagcataggaggatggttgaagcttatgctctaatggatcagaagttgcaacaagcattgctggagcatgacaattttgaaaataccattaggaatctaaaggtgcgtacatcaattttctgttaagtatagtagtctcccatagtgaagttttaacaataatcttgtttttgcagtcagagttaaaaaggcgggaacgtgatcatagtattgctcagaaagaaatagatgatctgcaaaaacaagtgagtctttaagcatgacatctgcattttgttctttttgattgattcacagattaaattgtctatgtaaggaaaatagaaatgttaacctcttgcctactctctagatatttaagatctggtgcaacttgatgtgatactagttctcaccaacatcttttcaaggatgctattctaaaaggggtggagtccatttttggcacctaaatatttcttggactctaaatttacgctgaactaaaagatcggttttagttcaccttcaacttttatttataaaaccagacaagtaacacctcatacctgattccatggtggtttagttgagatgacatggttttcactgatgattagcttctattagctgagattaattgatgtttaaccagctatttgacattcgcaccaacacaagcttgcatattaggagtctgcactagcaaaaactattatgatatcaatggaaaccactgtggagcagtgttgaaggtattaatagtatttgtatggttttgaaagtcaaagggtggaaaacactagcttttcaatttgaagttaaaatggacctagaaaagagtccaagagccaaaaatagactatgccctttgaaaatatgtcgatgcttgtggtcctcacctgttcaaatataatttgaaggtggatattcattcttgcatgtcactactgacaagaacattgaatcaacatttcttttgtggtactgcagatgcttttgctaactatatgctgtgtctgccctctaaatatttgcagatagctgtccttttaaaggagtgccaagatatacagcttcgttgtggttctagccttccaaatgtaggagatggtgctctttctacaagcacaagcactggagtgcctgaagttgaaaacaatatccatgagcatgtgagtatgctagtccgttgtattctctttcagtttcactgtgttggtgcttgctttaactgttcgatactgtgtttcagatgacattcaatgatatcaatgggttagtacagcaaaatgtgcaactccggaatcaagttcatttgctctctgctgatcttgataaaagggacatggaactcagggtatatataaagtttgactttgttttttctatagtttcaaatgttttagtttgttcatacatcagtgtcagggcatacttttgtatccaatgacatgagtacgtgatgaaaaatatctcgtttctgtactttccaggagagcttccaaattgagttgaagaagattacagatgatgctgcgtccagggttgagaaagtgatgaaaaaatccgaagaacaagcaataatgattgaatcccttcacagatctgtatgtttttgtattctccttgccacgaagttggaaatcttcgttttgaaaccctgtctgcaaaatttcaattgcatgctgtatgtgataccagtcctaaaatagttctcttttttgtaggtagcgatgtataggaagctgtgtnaagaacaacagaagtcacgttccaatgttgaacacatacccaaaaatttggaaggtttgtccttctgatgttttcagttcaggcaaaatggttaaatgtctaaccatgatggtttcaactgcatgttactgctataagaaataacctacatgtgatggttttattttgttctctagatgatggcagaaaagacctgatggttctatttgaaggatcacaggtaatttttttgatgatggaaggcttattgaggctttagaataccatagatgttgtggtgtcttttttcaaatttcaatctattttgaccaggaggtttcaaggaaagcttatgagcaagtttcagagcgtgccaaaagccttgatgaagagctgactaagttgaggtggtgttttcctccccttttaaatcttattggcatgatagaataacagctacgggaagaagtcatttgaataattttcattccgatgtatcattggacaagatgaatactgattacgaagcaatgtaacaacatccctttgctaaaaaaaaagtaatatgaacgactaaggccctgtttgtttcagcttaaaattattataatctagattattaagacatattactataggctggattataataagccgacatagaataagttgttagttgtttgttgctctagattattagctggttgttaggtgttagcaacccaataatctaaaaaaagcacctttagagtggattactagattatagtaatctggcttatagattgtaataatctatcataataagctatctgtttgtttcaacttactcctaatagtccagattataataatcctaagctgaaacaaacagggcctaaagcattaaggttaactttctatggtcttttcaaactatagaagtttatgtcatgaaaaataatttgcaagcaatccaacgtacttattttacgtagttagtccatatacttttgcaatatgaacgactaaagcgttaaggttaactttctatggtgagctacacttggaaatgcacagatcctatgctggcctacatatgtagacaaagggagtactggagtactatgaaacggatatcttgaaatgttgttagtgcccagctctgttgaggtcgtgtcgttataactaagcatgctgacggaagtgtgaatgtagcactccctccatctgaaaatataacaccttttagcattcaaactttccccacaatataataacttcacctattcactcatctcaaccaatcacaacaatctctcgggtaaatctaatgggcgggtgatcgctgggagcgatcaacccgcccctcccccctatacgctcttcctctcccccttcctcctccccttcttctcttcctactacagtacaccataaattttttaaaaaataaaaaaacaaagttggaaaaatttatgtatagaaatactatatataaaaaacatttgaattcaaattcaaattgaaacgggtatgtaaacttttgacttaaaactttaggtgtataaactttagatgtgtaaacttgaggtgtacaaactttaggtgcataaatttactaaaataggaaagtaatgcggtgccaaaaaaggaaaccacgtggagggagggggggatccgaatcctgatcgctaggggcgcttagcaatctcgcaatctcccacttaatttctcgacctactttctcatctcaactaataacaattttccccatttaatttctcctgctttcttaataccttgtacaactctagaaatccttatattttgtgatggagggagtagtatatagacgcacatctaagttatctgtgtcacggttggtttttaacttaccatgtatctgtgctgttaagggttccatttcttgttggttcttcatttttacatgattttggatggccctacttattgtggtatttggactgttgttgattatgttatattatatttgatcttgcatagaatttctgatcaatactgattactattcattaggactgagcttctatctttgcgttctgagcgtgataaggcggttcttgaagcagaatttgctcgagaacgacttaatggatttacagcagagcttgaacaccaggttctttctttgatgtgttatatcatgatttgttaatatttatgtttgttacactgaaatggacataataatgtccataacagtcttttggaagaagatagcatttattacatgctgtatccttatttactttgtacatgtaaaaaacagaggaaggaagctaattctatttcgctaagaaatgcggaattgatgcatttagtagttgattacgaaaaaagattgcgtgagaactcagaatctatgaaggctgtagaggagaactcacggaagctattaatgnaggtttgttgatatttttacattcctcaaataatattaagacccagagtcctgacatgatttccatttctctagatgtctattctaaagaatgaaaaagagatcttagcaaagtcagagaaaaaagctttggaggaagttcatgatttgaccacgagggtgcatcgcctgcaggtatttcccttgctgccatatcttttcattactttggagtttcaatattgtcttgtaccccctccatccaataaaaaaagcgtgtccatgatcgtagctagggttggtctttttttgggacggagtagtatgtattgcagtttctgttagtttgttatgtttccaaaacagttgtaaaactgttatcgtcaattatattctatacttatgaatatatactccttctgtcccaaaaagaattaatttctaggtaagaatctgggcatagactatatgtccagattcatagtcagaaattggttcttgttgggacagagggagtatattattgttatgctctttttgaaaggataatttagtacttttcgtagctctgccctatatttctcatgacaaatttggagctgtcagtttcgcacaactgtatggtctactcaagcatgaacaagcaagatcttttagctatttgtgtttttaatttgcgatctcaaataagttaaatgttcgtgaaacaaataaaacatgtcaattactttgtcttgaggcttttataaacttgcactgacttgtatatatgatgcattgcaggcgaccattgacacaatacatgccaccgaggaggttcaagaggtacaatatgtctagatgagtcacattaatacttgaaattcttctctgtctatctcttaatctgtgaataatttagaatgcaaggtctattgaaaggagaaatcaagaggagtacatcaagagactagaagtaagactcctatttggcatcacatatgctttagtattttgtgcttatgtagcttcgtcattgcctctcctctcacattcaagctgttcttagctttaaaatgtaatttcctgtactgataccttgaacattgagaatactactgtgactctgtgagatttgttctctttctgcatgctcattgtggggatatattgctccatgtattccttctgtatcttatcttggttgagcttattctaatttgaaatgcatccatagagggactgggctgaagtgaaaaaagagcttcaagagcaaagggatcatgtccgcgtcctgacgcttgataagaaaaatgcctttgacggatgtctgaagcaggtagaggatatgagaaaagagttacaaaattcatggaaagctgctactgatgctgaatctagggctgctgttgcagaggtttgttcaagtaattcatttttctatagttaatcgcaaacatattatctaactggtaactattttgacatttctgtaggcaaagtgttctgatntggagacaaaactaaaatcaagaaaggtagatacttataaaactaatacactgttatattgtatatctaatacaatgatgttgaaagcaccatacatcataaaactgtctgtatgtaatttcctattgataatctctcgcaattcctggttttgtcatgagtaaatgattttcggtacaattatttctaagctgtttaatagtctgttctgtaaaggaagcacatgatttcagctgaattacataatcttcatatctttgtacgattgtcaaattctgctttggatgttgtctgatcattgaaatagtcatatcgtttttaattgaaatgtcattcatggatatccatgaaaaatagtggaatgatgcatcacgtttagttttagcattagtgcatgtttaaaattttctttacaaatcaacatcaaatttgttgtctatattatccgtttgtagggagctaatttcattgctcttgttaattagctataggtgtacactgcatctaaatatctctgtactttctaccttctctcctatatactgtatcacccttaattgagctggtgtaacaattctgattataattatgcattcacgcggtaacttgtaaagcatccatggatgcgtgtagttgctgtacaatttgttcattaccatgattgaattgagtagcatgtttctttgatgaaagcatggatattctggtaaatgtactttatttcttgggcattgatctgaaacaaaattaatcctacaaaagcaaatggtgggagtacaactaaaagcatgtagtattcttaataccttttcattgtattgtacatgctatttagctttcagctgactgctgttattctgctagaccatttttagggatggtggtcgtgatatcttatcagcaactgaggtgagctagttttttcctgctatttggacaatatcatatgcttctacatattttatatggttaaagatcctatggtcttaaaatttctggataatttcaatgctcagttgttaaaaatttgccctgtaggagaatgatgagcttttccagctgaaagaggagttggaaaagtacaaagaggaagctcaagcaaataaaagctacatgcttcaggtcagtttgccccatcaccttgaaaggctaaattgtttaattacattgtggagtcatcaagctcttttaccattagaaacattgtcactagctacatttattagtttatcatttgacatcaccaaggagtaatattctgaatttcctcaacaactatctatcgctgtgcacaagagatattttaggtttggcactcccattagagaaagattacccctttacttataggaagttattgttcatggtgatagtgacatcaccattagggagcagatgctgacccttgagaagttgaggttgtagccatcccatccctcttgcttaatacatatcttgtaagcctgacgaggttatgatcaatcattctgaggtcaagtcgatgccatgctggatgcaactttgataattttgttcccctaattgatcaccttagctcataatatgcaacagttttctagttatctatgatcggtgtggtccatggagctggtttgaagtggattaattattttgtcattctttgctcctttttcactcaatgattctatgcattacaccaatttctgaaatgctagtgatatacagatcatatccatatctggtattctggttccaagcatgagaggaccgtgcaacataaacaacaatggattgttatgataatgaagatgtgatgtaatagagttattttcctctcttgaaggcccatgcatgaataatatatctagcatagccacctttgtcataatcagaaagcacaccatatttccttttgaaaggtcattataatggcttagttgttctgtagagtaggtgaactgaattcattggtgcttgcgtagtgtggcctgtgtttctattttgccttgtagaagtcaattatttgctgacctctttaagtcatattataactctaattacttgacagtacaaagaaattgcaaactcaaatgaatctgcattgaagcaaatggagtctgcacttcaggatttcaaaaccgaggtactgaaatgctttctgtatccttatctacctatgcttgatatttacatgaatttctatttaattttcagtctgagactatcaagaaaagcttggaagatgagattacaaagttgaggaccaagatatctgaactggagaagtgttatataatgaagtgtgaagaagctgccagtgcaattgaagctaaagagaaggataccacttctctcatgaaggaaatctcagttttgagaaatgaagtttccgagaaagtgtaagcaatttatataccctatagaggcaggcatatgcttttctcaatttggagatgcttcttcgattgatgttatctcttttattttctcattcctcaaaacagaatacagattgaaaaattagaaactgaactggcttcctcgaagagggctcttgacgagcagtataagcgttggcgtagcgctcaggacaactatgagcgtcaggtactttggggcactaacaattttgtcaaacaacacataatgttattatgctttctacttatatcttggtgcttgcggtgctgatgcttcattacaattgatgtgcaatcacaacttgcagtgatactaatgttatatggagcatgttgctaaatgttttcaccattttacttgaactgtagctgctattctaggctactataaaagacaccagtggtggtggtggctgcaccttttacaaactagtccctgataatttcagatattatgcgagtctaatatttgtttgaatcaagtcaataccatatattcaaataaggaaacaagtaatactagcatatttgttaaaaaaatattttgtctatgacatatactttcttttacccatagcaaagcatggtcattttgctagtgtatgcaacttagttcatagcatcaccatcaaagatcagatggcatgtacatgatacaataaagtaactgaagtatatcaagttcagattgatttatccttcttacttattacttgcaattcttataatgaatctccttggtgtttatatacaattattttttttgtacatactgtgttatcctagaatgaggctgtgaaagcacttattgtgtgtgtgtgtgtgtgtgtatctcttctgtatcttctgtaggttattctgcaatcggaaacaatacaggagctgacaagtgcttctaaggagctatcttctttgcagcaggaaatcatagtgcttcgtcaaacagtagaaacacagaaggctgaaaatgtaaattaaaactgctccactgaccctcttgtctgaacttctattcatttggcgtgtaagagtagaagtctttgtgtcttggacagatctaaagggatgtgttatttgtggctgaactacccttaaattaggagaaataaaccttaccagctaatgcttaatttatgacgctaggtctgctaggtgtggcgttacacgcttctgtggtgcttgccccagttgtcatagcctcacattttagctaaagtgttgtgcttgatctggctgctgcaagccccaggcaaggaaccaaataacgtcaagaagtcttttaaaagttacaccttgtaccttcccacttgttgatccaacctttttgtggataaaaatggtcttatggcatctaaaattcaaagcacacagattagcgattaccactagttctttgctggtgttcaataaaacctttgcaatttttgacaaatcgggtgaatcagtcgaggaatagttcaatgtgtctacctttctgatatttctattctgtgcataacagcagtaatctggctatacctatactacttatgttgcttttggaatagattcatgattagtgataacttatcctgatcgagctgttcataggaactaatcatcatttgttgtaactaatcgacactgcaaatactttttcaggatggtctaagaacccttggagagcnagaaaagatagagctggtgaaaggaaaggatgaggccttgcagaaatacaatgagctaaatgatcaggtttaaaagcttgtagctatcgatatccagttattcttaaaacattcacgtttttagaatgttatctgatctccatgtttcactaccaagagcaaaagtgggattttacaaacctaagggagctgcttatatagcattgacattaaacaactcaaacatgaaacaaaatcctggcaatagcaacaaaagaaaaagggtggatactccagagacttcacatcctgattgttgttccttccttccagccatgactgaacctcactttcgacttgttctagtagctttgctccacctgctgcgcgcttctgttttcttctgacttctgcaagaagtaccagttagtaacccagaaactaacaggaaaactcatttcaaatagccccactaaatggctgaaatccccgcgacaaagtatctgctttctgttttgaaatggaatacccatttctctttaaagaataaaatgaaacacccattcttctagcacctgcagcacatatcgaagaatattgttaaaaccacgggaacagcttaagacacccccatttttggcatttatgatcttttccaatccttttctacacagcgatctttggttatatactctttttagcgttaacaaaacacaaattttgatttgagaggaatcctgattttccacaaaatattgtgtgcaaattccactactatcaattccaaccacaatttcggaattactgggattagtttggcataggaaccagaattgattggtttgattactataatgcttaattgattatgggatgggtgtcgaatttatggacttctacatgcacattttgaggggtatgtattttatacctacctattgagaacatacatatgaatattttttaatgatacaaataaaatttaataaggcacttgtctacatggtgctttacactagggtttcatgggcttattttttgttttttttaacatgcttgataactattttcataacagttgcctgtttcgactttcgagccttaatataaacactgccttacaaaatcagtatatcactacagtaactgattgtactagtatatgcttaattcgttggcaagataatgctggattaatcttgtttttctggtctaaaagatgttcagcatatttaaaccataatctagaatggttactggttgtagttggttgccattcatattttttgtttgcttccattgcatgtccttccgttctgtatataaacacgggtggtcgttagttgccattcgtgaagatcacatgaatatacattcttgctattttctgtacttgatgacagtgggttaccatgaatcacatattttcttcaaatgctgaatgcagaataaaattctacacaatcaactagaagctttgcacattagattagctgaaaaagaacgcaatattgctggtctttcatcgcaacgcattgattcacatggtgaagatgatttgcatagcgtcattggctacctgcgcagatcgaaagaaatagtgagtataagattcagtgtcctcttcttctttattattcctctacttggaatgggatgttatttatgtagtctgatggtaatttcactatttcaggcagaaaccgagatatctttgcttaaacaggagaagtcacggcttcagatagaagtatgatctgcttgctcttgcatattgttatttgttcaaatacccataattgtgccacgtcaactactgtactcctccatccacaaaagttacacattttacttttgtcaccaagaccatgaagaaattaaattatcttggatgctacaacatcaaggagtgaatgcaagcatgcaaccaatgagtatttagatgactacttgggttctcatcaaacatttaatttatctcttcatttaagtcttaaatacataaagattacaaataggtacaacttatttggaaaaactcaaatgtgaaatatgtctaacttttgtggatggagtaaaacagaactctacctatgcttacttgaattgtatgtaattataaaggaactgttctgtttcttttgttttatgtagtatggtgactgcgaatattgaactgccacctgccagactttgttgttttgtcattttgttccatgctcccatttaatctgcccataggacaattccatgaagtttccactgtttgacccatcatatttggcatttggtatcatcatggaaccaatccatatggccttgtctcctttgtgtgattgcttgccaagcttgtctcatttaacttgatcctatggctccactctggtcttgtatgaacatgtcatgtgcctctgtactttcaacacataactgaaagttatgcattattgttcaatctgtttgtcttgcatgatttgagaacttgttttcactcctcattttgactatatgatttcctattatgtgtttttgtctgatgtagttttatctgtgtgccttccatgatattagaaccgtttccgtgcttgattttgtgggggcagcttaaggtgtttctaatctgctataatttttttcatgcttatatagttggaaagtgcattgaagtccacaaaggaggcacaggacttgctccgcagtcaaactgatagtgcaagaacatcaatgctcaaggatgaagaattcaagtcactgcaattccaggtgccattcttgtcgactccctcctcaaaatatcgctatttctagtgcttaaattttgtcccagaatatagctatttctatagtcctactttccccaccaaacactcgtctgcttttcactcacctccattcctccaactatccctcatttatttatttatttatttatttattttttgggggggggggcatcatagtcttttccgttgatcgttaaatctctccaaaaaagccacaagttatattttagggcggagagtgtattgggtatctgtcatgactgctccctttctcttgattttactgttgctctcttattccttttttgtagcttgttttcttttgtattaaaaatgctttacctcaggtgagagagcttaatttgcttcgtgaaagcaatatacagcttagagaggagaacaagcataatttcgaagaatgccaggtaagtttattgatgttgtcttgtttatttcttttatggtgcatgttttgatgtgcttcattgttctttttttttctctcctgggttcagaaattccatgatgaggctcaaaaggctaaaatggaagctgaaaggttgcataatcttttactggaaaagcaggtagatgctgaaatatgtaaaaaagaaatagagatgcagaagaccgaaatagctaatctaaatcaaaagatttccgaggtatgttatttacccattatcattatgcaacgcatcatgaatataattggtttatttatatgcggttagcatttccttaaggtagctgacatttgatacatgaccttttctaataaataataaataagaattaaaatatagcactgtagcagctaatgttgtactagtacattagatagagaccatgccaggtcaaaaaatattttcttgaactggaggaagcaaaccctcaaatgctgatgctagttttttttaggaaacttacatctaagctaggcagcgcttgtgtggaaatgtgcgtttgtgtacatctgacttgatattcttggtgctacttgtgtcttcactttctgtcattggttttgttatgaatggagggactttaggattagttgcccagtgcatgtgcacagaaaagggtgtctgaacagcagaccggtgtgccggtgtgtacatcgagcaggggttcttgcattgtgtataaattcagtttatgttttacctcttcatcagttagtcttgaatagaatttgtctagtgtttcccaaagttctaacattattattaacattgttataagcttgctattatcattgttctatcaggtattttgttttgactcttatgtcaactttattcttctgcagttggttgaaaatagtagaggcgttgatttgagcacatatgagaccatgaaggatgaacttcaaaacataaaagttagtggttttttttattatttttatcttttcaaatcattttgataagtatttttagttattatgttatacttattcttttggtgattgaatttggtctgaacatattttttgttctataaattgtactctgatccaagatataagaacttctggtattcttggggattaaggaaagaggtgaaattgaattggggatggttgcgattagttgagatgaggaaacaagtagagaaattagatgagaaatggttgtgattagttgggatgggggagtaggtgaagttgctatattttgggacattgagagtactgataaaataatactacatttgttcttttgtatgctggtttgactagagatcaactgtttaatgaagcattcggttctgaacctagttcaagcttggaatcagatagctacggtaaagaatagggaaaatgaccattggtgagacaattagagggaggggacagacaatatagtctggaataagaacttttgaagcgaaacatactttctaattattatcggctatcgctggtattggacttgttatgccctttcatgcgcatatgctgctcgttttctaattattgatggcagttgagttagtttcccacttttctcaacttctaatcgctcgttttccacacgcacacttttcaaactgctaaacagtgtgtttttgaaaaaaaaacatatatatcgattttcaactttttttttaaataatacttaattaatcatgctctaatgagtagcccagttttccatgcaggagggataagttctcaacctgtattaacgaacacagccttagtgatatataacactgatactgatgtacatcccttaattagcatggatggctggcttaaatttcattatttggtcaatacgactgaacttaatgagtttgtaaggttgagttttgtgataaacgattatcacatgtatttcttaaatacaacaggcaaccttgagagagaattcggcagagctagagcgcacaaaaaaacttctttctgagaaggattctgtaataagaaatttggaggaaaagcttgctggatgtcagtctgaattggatgctagggaaaagaagctgaatgatgntgaggtctgatataatttccagtaacattctcctggccatttttactttagttgtattagtaatgcctttccttttgcaggctagccttaaatctgaaattgacagacataggaagattaatatcaacataaaggttaggatctttcccttgttcttctattgcaagatcgaaagttcattgctgttttcatgtgcttatatcatcctattaaataatgtagaggaagcttgatgcatcagcaaaagagaaggaggaactgacgaaagaaaaacaaagcctttcaaagcaattggaagatctcaaatcaagtacttaattaatcttattactttcacacaaccacctgaattatatattttgtatgatcactcatgttttaaatttgatatactttagcaggtcagaaaactacaacagaaaattcaaatgaacaggccatcaaagaaaaggacttcaggatacaggtcaggaggttgtgatttttatgaacatgaactccttcaggtttcttacataaacatatattaacagacattggaaaaagtcttggagaaagagagagatgataataagaaagaaaaagcattccgcagaaggaatgagaaagtatttactaccgccattcaaaatatgaatcaggtatttcttcctcaactagcctgagtacagtcttgtcttaaaaatttttttgtttatcgtcagttgggtttagattgagcaccaaatttatcatggaactactgatttaatacagattgtcacaaagctacacattaagtagcaaatttgtcacaaagctactggtttattgccaatttaatcccaaaactacaacgtctatatcttcaacataactgtagtgctagggattgaaaatctaaaatctgtagtttttttataacttgagcaataaatctgtagttttgtgatacttctccctaaatctgtacctgatagctttgggggagtggattctaatcccttgaggggatgtcccgtcgtgtacctttttctttcaaattcgatacaaatagttgtaaaaatttatgaaaaaaattcgacctactatttatatctctcgacgtgtgcgttgcgtttggacctaagattttatggagttgtatacttatgttgtatgagtgttgtcgatcttttccagaatttttcataaccatttggatggtttttaagcaaacaaggggacatccctcgagggatcaaaatagtttccctagttttggcactaaatgtatagttttgtgatttgtcttaaatccgtagtttgtgaaattttctccttttttttaaccgatgcagtagattttctaataagaaaagccaaggaagtagacattaagataatgaaagattgatatgttgacatgttcacagatgaacttagaaaaatgaaaaacttaatgtgttctgggatatacaagatgaaacttttaagtaggatgttttagtgtattctagagttggaaagttggcatcattatgaatgttctaaagaataagtgccattttaaaccttaccaaaaaattggcaagccaaattttggtaaagtttgagtgtttggtttataaccaagtttttgtcaatgttgcttgtgatgtattgattgtttttgccaaaatattggcaacacaaaatctatggcaacaaaccaaacacacacattttcttgcccttgccaatttttttgtatagtttgtttgggctataaaccaaatgctaagtgttcatgtccattgccaaaccaaccctgagtattaagcctatcattatgatctacacttttcgttacattttcttctattgaatgatttcttagaatatgaaatttcactgtttaaagcttgcaaatgtagcatcatttgagtttgctaatggttaatgtttagcatgatcacaggcaattatagtacactatagtaaattattgtctggggtttgcttattggcttttcaggccatgtcccattcctgtgatagcccttaatgatcagttagcatgcattgcagcttgctccaacctgtttccttagtatttactcgtatttgttacctaatgatacatgatgtgtacctattaaaaatgcaacataacaacttcatagttgcttgtttctccaataattaatctgtcctgcctggttagtgtgtggtatatgcgcaccctctaatccacttgttgctttcgaaaattaattgcaggaaaggaaacaagtagaggaatcaattgagaagcataggcaggctgtgaaagaggtgattgaggtacagtttatctgctcccatagatttcatgtttcattattgctgctgcaaatgaaagttcctagtatattttatttagagctttgctacagctgatgtgcgttctctgcagcattatactggaatatcctctcaaatcccatctggatctgcaatcgatgagcagctgcgttcatatttccttgccatcaaagctgttgaggagtctccgagtcccttccaagatggtgcagcaagccagacaccatctgttgaaagtgccgatgtggatgcatctgcagctactgcaggttcctttctgttcaatttttcattccacgctgctagtgtatatttaatgatctctattagttaatcatagtatctgttaatgacatgtgatacttactagttcagaaattatattagatctgatctattacatgtactcttgaactcgatgtgaatttggttttgaatgatttggcatgtcagatattgttcggacttcggaatgtgatatgatattggatttctaatgcatcattttcttgcattggttccatcgcgtggatctgaataatgtgtttttcctttgctttaccgtcacttgatcaatatggtagttcataaggctgctgcttttttttttttctaatctcagggagacaggtagctactccaccaaggcctgctcaagttaaagtggtggaggagagagcagtttctactttgcccaaaccaagcactgaagtacgtagaccaggaggaaggagaccacttgttcgaccttcacttgaacgagttgaagaaccccaagctgatattgatacaacagtagttgaaggttccacagagaaaggcggcttgttgatggagcgtgaaactcctggtggtgtatctgcgttacagccatcaagtcgtaaacgtctaattccatcaccacaaacgagagatgatgcttcacaaggagagacaacggatgccaatccaccactgaagaaacccaaagaaggatcttcacaatgtactagtgagctaaaaactgaacagtcacctcatgaagatgtcatggcacctgttcctgtgctaccatctacagagttagatgagcaacagcctggagaagagatggacaccgatcagtcttccttgccagttgaagaggttgaggaaacaagggaggatgacttgggtgataaggatgacatggaaacacatatagacgcttcantggacatccaaggacaagatgcagaaactggtattgataatgatgcaactactgtggaagatgtgccagtcaagtcagaagcggttatggaatcactggaggaagacctgaaaactgaggatgggaaggaagagggtcagtttactgcaaccactgatgttgaagatgagagggaggagggagagttgccagatgaaccagaacaaccagacagcactccccctgtgctggatgttggtgagcaagccggtgattctttcagggcggcatctccagcaggaccaactgaaaagagtgatgttgacatgccagaagaaactggagaaggtgatggtaccatggaatcagaccaaagccctgtaccacaatctggtggagcagatgcgtcaccgagccaaatggctgatgcgtcaccaagccctgcacgtgaaccttctcctaacccagtccaagctggtgcacctcctgaacagcagaatcccacccctcctaacccagtccaagctggtgcatcttctgaacagcagaatcccgccactgcagcagaaggtgttgaaactcgtagtaccagaacaatcaacctaactgagagagcgaggcaaaaccggcaagccaggattcttcgctcagccactcaacagaatgcaaggggccgtggcaaccagtctcttacatacagggtatggttttatactacaagactactgagtttatttctgttgtgttctatttttgttatatccagtgttaattctgatggagaacaatgttttctatgtgcagaaagatggcggccgaggaacacggggtcgtggtgggcgtggtcagtcgtagagaatttaggtttgtctttgctcaagcgcggagactagttttttgcaaaggacatactgaatcagggcggcatcatattcattttgtagcactatcagaattgcgagcgtacatgttactctgcttagacaaattcatgtggctaagcagcgcttattaaaatgttctcattgcccgtgcggattgccagatgacctatatttaaattgaactctagttgacaaagatgatataagcattcgtagcgcgtaagctgatttttatttttctttttgattcgctgcgtaagttgatactgagttgtaaatgcgtacaaggtttgctaacgaatgtcggttataatttgactgtagaaaactgaacatttctgaatgttagtcggagtaaatgattttgaaccggacgataataagatgaaggctacagtttcacgattgctcatagctaagcagagctagtagactcggggtcaaaagatgaatagattaaagccaataattagatctgaacaatgaaaaatagcctataatcccctacatttgagataagtttgcacccaggatctacaaaagccgcgtcgatctacagcctctagtttggttgtaaaagtaaaatcggatgagacgagccagacacatcagtgtattattaataaatcgaagttctctttcaaaaaaaatccaagttttttttaaaagcatggcaaaagaattttgcctaatatatttatggagtggaagattgataataaatcaaaagattacatcagcaaagaatacattaggagaatttgcatacatgtttcattctgcgctaacaactgggacaacgactttgctactatcattctgttcgattagctatatatattctaatgtacagaagtaacaggccgaggccgtccagtaacgttcacttttttgtgctttaaagaatgggaaacagtataatctccacagaaaaaaaaaagctaataaacccccagccacaagccgcagtagccagccatactgcaagttcttctcctgcatgatacggcctccactccacagtcatcatcggtcctgcatctgtgggtaggtaacacgtctggtacatggcatgcactctcccacggggagccaacgctttgccggaaaatcgtttctggacaaacttgagacgacaatgcgctcacacggaagggttggctgtcatcctgaagataagtttttggtatcattgttcatgcaagtaaggaggaactgggaaca

SEQ ID NO: 8 - protein, 2050 aa, Oryza sativa
MPLFMSEEELRLLGGDVAAVAERADAAIRELRQQVDTVRAEADAAAIAAEQTCALLEQRYDTLSAEADRFRAELAELAAASERRAADLASSQSEIHQLRIQAIAKDGEIERLKVEISEVHKSKSQSLELIEQRDAEIREKDGIIQNYLDKIVNLADSSASKGARIQEVEAKFTHLQATCNRITQEKDLLEKHNLWLDEELKEKVKNLAELRKSNMDEEARMSAKVAELERETSESSSSLRRSKERVSELEQRVSYMEKELCSTKDAAAANEQRLAAELSTVMKLAELHKESSEEWSKKAGELEGVIKALETHLTQVEDEYKEKLEKETSAKRDLEMEATYLKQKLEKCESDLENTRKSSELSFTPLVAADPCDLAGSPMKEMAFSDPANQNDLMIVPKVPTGVSGTALAASLLRDGWSLAKIYEKYQEATDALRHERFGRRHAEAVLERVLHEIEEKAELILDERAEHRRMVEAYALMDQKLQQALLEHDNFENTIRNLKSELKRRERDHSIAQKEIDDLQKQIKLSIYLTFAPTQACILGVCTSKNYYDINGNHCGAVLKIAVLLKECQDIQLRCGSSLPNVGDGALSTSTSTGVPEVENNIHEHMTFNDINGLVQQNVQLRNQVHLLSADLDKRDMELRESFQIELKKITDDAASRVEKVMKKSEEQAIMIESLHRSVAMYRKLCEEQQKSRSNVEHIPKNLEDDGRKDLMVLFEGSQEVSRKAYEQVSERAKSLDEELTKLRTELLSLRSERDKAVLEAEFARERLNGFTAELEHQRKEANSISLRNAELMHLVVDYEKRLRENSESMKAVEENSRKLLMEMSILKNEKEILAKSEKKALEEVHDLTTRVHRLQATIDTIHATEEVQENARSIERRNQEEYIKRLERDWAEVKKELQEQRDHVRVLTLDKKNAFDGCLKQVEDMRKELQNSWKAATDAESRAAVAEAKCSDLETKLKSRKENDELFQLKEELEKYKEEAQANKSYMLQYKEIANSNESALKQMESALQDFKTESETIKKSLEDEITKLRTKISELEKCYIMKCEEAASAIEAKEKDTTSLMKEISVLRNEVSEKVIQIEKLETELASSKRALDEQYKRWRSAQDNYERQVILQSETIQELTSASKELSSLQQEIIVLRQTVETQKAENDGLRTLGEQEKIELVKGKDEALQKYNELNDQNKILHNQLEALHIRLAEKERNIAGLSSQRIDSHGEDDLHSVIGYLRRSKEILESALKSTKEAQDLLRSQTDSARTSMLKDEEFKSLQFQLVFFCIKNALPQVRELNLLRESNIQLREENKHNFEECQKFHDEAQKAKMEAERLHNLLLEKQVDAEICKKEIEMQKTEIANLNQKISELVENSRGVDLSTYETMKDELQNIKATLRENSAELERTKKLLSEKDSVIRNLEEKLAGCQSELDAREKKLNDVEASLKSEIDRHRKININIKRKLDASAKEKEELTKEKQSLSKQLEDLKSSQKTTTENSNEQAIKEKDFRIQTLEKVLEKERDDNKKEKAFRRRNEKVFTTAIQNMNQERKQVEESIEKHRQAVKEVIEHYTGISSQIPSGSAIDEQLRSYFLAIKAVEESPSPFQDGAASQTPSVESADVDASAATAGRQVATPPRPAQVKVVEERAVSTLPKPSTEVRRPGGRRPLVRPSLERVEEPQADIDTTVVEGSTEKGGLLMERETPGGVSALQPSSRKRLIPSPQTRDDASQGETTDANPPLKKPKEGSSQCTSELKTEQSPHEDVMAPVPVLPSTELDEQQPGEEMDTDQSSLPVEEVEETREDDLGDKDDMETHIDASMDIQGQDAETGIDNDATTVEDVPVKSEAVMESLEEDLKTEDGKEEGQFTATTDVEDEREEGELPDEPEQPDSTPPVLDVGEQAGDSFRAASPAGPTEKSDVDMPEETGEGDGTMESDQSPVPQSGGADASPSQMADASPSPAREPSPNPVQAGAPPEQQNPTPPNPVQAGASSEQQNPATAAEGVETRSTRTINLTERARQNRQARILRSATQQNARGRGNQSLTYRKDGGRGTRGRGGRGQS

SEQ ID NO: 9 - DNA, 6589 bp, Arabidopsis thaliana
aacaacgacgtttaattgacgcctggggttttctgtctccggcatagcataatttttcgtcctcccgaagcgctttttcatcttcctttgttctgggtttctctccaaaaatcgccggagaaattcaaatcgtcatctctaattcgtcggagaatccaccgttaggtatataaacacggtttgtttctgaaattagggtacgaaaaaatgcccttgtttatgcctgacgaagagctggcgcggctatctagcgacgccgcgtcggtggttgcggagagagccgacgagtacatacgaaagatatacgccgagctggatagtgttcgagccaaggctgacgctgcttccatcacggcggagcagacgtgttcgcttctcgagcagaagtacctctcgctgtctcaggatttctcttcccttgaatctcagaacgcgaagcttcagtctgatttcgatgatcgtttagctgagcttgcacagtctcaagcgcagaagcaccagcttcatttgcaatcgattgagaaggatggagaggtagagaggatgtcgacggagatgtcagagcttcataagtctaagaggcaactgatggagttattggagcagaaagatgccgagattagcgagaagaattccactatcaagagctacttagataaaattgttaagctgacggatactagttcggagaaggaagcccgactagctgaagccaccgcagaattggcccgttctcaagctatgtgtagtcggttatctcaggagaaagaactcactgaaaggcatgccaaatggctagatgaggagttgacagccaaagtcgacagttacgctgaactccgtagaaggcattctgatcttgaatctgaaatgtcagcaaagcttgtagatgttgagaaaaattatattgagtgctctagttcgttaaattggcataaggaaagattgagggagctcgaaacgaaaatcggttcattacaagaggacctcagctcttgcaaagatgcagcaacgaccactgaagagcaatacactgctgaacttttcactgcgaacaagcttgttgatctgtacaaggaaagttccgaggaatggtctagaaaggctggtgaacttgagggtgttattaaggccttagaggcacgcttgagccaagtcgagagtagttacaaggagagacttgataaagaagtgtctacaaaacagctgttagagaaggagaacggagaccttaaacaaaaacttgagaagtgtgaagcagaaattgagaaaactaggaaaacagatgagctaaatctgatacctttcagcaatttcacaagacgggttgacaattctgggaccagcaacatgatagaggaaagccaagcagttatttctaaggttcctgctggtgtgtcaggaactgcactagcagcttcactcttacgtgatggatggagtctggccaaaatttatgagaagtatcaggaggctgttgatgccatgaggcatgagcaattaggtagaaaggaagctgagatgatacttcaacgggtgttatccgaattagaagagaaagccggatttatccaagaagaaagaggggagtatgagagggtggttgaagcttattgtctagttaatcaaaaactccaggattctgtatctgaacaatcaaatatggagaagttcattatggagctaaaggctgacttgaggagacgggaacgtgaaaacacactattgcagaaagatatatctgacctacagaaacaggttacgatactactgaaggaatgtcgtgacgtccaacttcgatgtggagctgccagggatgatgatgaagatgattatcctctgctctctgatgtggagatggaaatggaatctgaagctgataaaatcatttctgagcatcttctaaagttcaaagatataaatggactagttgagcagaatgttaagctgagaaaccttgttcgtagtctttcagagcagattgaaagtagggaaacagagctgaaggaaacgtttgaggtagacctgaagaataagactgatgaagcttctgccaaggtagctaccgtgctaaaaagagctgaagagcagggacaaatgattgaatccctgcacacatctgttgcaatgtataagcggttatatgaagaggaacagaaacttcattcatctgattctcgttcttcagatttgtctccagctgtagtgccaggaaggaagaacttcttacatctgcttgaggattcagaggaagctactaaaagagcccaagaaaaagcttttgaacgcatccggattctcgaagaagattttgcgaaggctaggagtgaagtaattgcaataaggtctgaacgggataagttggcgatggaggcaaattttgctagggaaaaattagagggcatcatgaaagaatctgaacgcaagagagaagaaatgaatagcgttttggcaagaaacatagagttctcacagctaatcattgaccaccagaggaaattgcgcgagagctccgagtctctgcacgcagcggaagagatctccagaaaattatctatggaggtctcagttctaaaacaagaaaaagagctgttatcaaatgctgaaaaaagagcgtctgatgaagtctctgctctatctcaaagagtttaccgtcttcaggctaccttggatactgtacaaagtacagaggaagttcgtgaggaaacaagagctgccgagagaaggaaacaagaggagcatattaagcaacttcagagagaatgggctgaagccaaaaaagaattgcaagaagaaaggagcaatgcacgggattttacttcggaccggaatcaaactttgaacaatgctgtaatgcaggtagaagaaatgggaaaagaattggctaatgccttgaaggctgtctcagtggcagagtccagggcttctgtcgctgaggctagactttctgatttggagaagaagatacgatcttcagatcctaagactcttgatatggatagtggtggaattgtctctctttcggataaggaggctgctcttgttattattctggatgttgtacataagattcaggcaggatttaggataggatctgcaatgtccatcgaactgcgtaccgcaaaggaagaaattgaaaaattgaggggagaagtagaatctagtaaaagccacatgctccagtacaagagtatagctcaggtgaatgaaactgcattaaagcagatggagtctgctcatgagaacttcagacttgaggctgaaaagagacaacgatcattggaagcagaacttgtttctcttagggagagggtgtcagaacttgaaaacgactgtattcagaaatccgagcaactagccactgctgctgcaggaaaagaagatgctcttctatcagcatcggctgaaattgcaagtctgagagaagaaaacttagttaaaaagtcccaaattgaagcaatgaatatccaaatgtccactttgaagaatgacctggagactgaacatgagaaatggcgtgttgctcagagaaattatgaaagacaggttattctgctgtctgaaactattcaggagcttacgaaaacatcacaagccttagcagcccttcaagaggaggcatctgaactacgtaaattggctgatgcacggggaattgaaaattctgagcttaatgccaagtggagtgaagagaaattgatgctagagcagcaaaagaatctggctgagaaaaagtatcatgaacttaatgaacagaacaaattactccatagcagacttgaagctaagcatcttaactcggctgagaagaacagccgttctggcacaatatcatctggaagcactgactcggatcaccttgaagattcgggtttgcaaagagtagttcattatctacgcagaaccaaggaaatagctgaaacagagatctcactaatgagacaggagaaacttcggttgcagtcgcaacttgagagtgcattgaagatggcagaatctgcccggggttcacttactgctgagcgcgccagtacgagagcctcattattgaccgacgatggaatcaaatctcttcagcttcaggttagtgagatgaacttgctccgtgaaagcaacatgcaactcagggaggaaaacaaacacaattttgagaagtgtcaggaaatgcgtgaggtagctcaaaaggctaggatggaatctgaaaatttcgaaaatctattaaagacaaagcaaacagagttggacttgtgtatgaaagagatggaaaagctaaggatggagacagatcttcacaaaaagagggttgatgagttgcgggagacatacagaaacattgatattgctgactacaaccgcctcaaagatgaagtgcggcaattagaggagaaactgaaagcaaaagatgctcatgctgaagattgtaagaaagttctgttagagaagcagaataagatatctcttttggagaaggagctaactaactgcaaaaaagatctgagtgagagggagaagaggctagatgatgctcagcaagcacaggctactatgcagtcagagttcaataagcagaaacaagagttagagaagaacaagaaaattcactatactctgaatatgaccaagagaaaatacgaaaaagagaaggatgaattgagcaaacaaaaccagtcactcgctaaacagttggaagaagccaaagaagaggctggaaagagaacaacaacagatgctgtggtggagcagtccgttaaggagagagaggaaaaagaaaaaagaattcagattttggataagtatgttcatcaactgaaagacgaggtaaggaaaaaaaccgaagatttgaagaaaaaggatgaggagttaactaaagagagatcagaacgcaagtctgttgagaaggaagttggagactccttgaccaaaattaaaaaggagaaaacaaaagtggacgaagagcttgctaagctcgagaggtatcagacagcattgacccatctctctgaagaactggaaaaattgaagcacgcggatggcaatctccctgagggtacttcagctgtccaggttctatctggaagcatactgaatgaccaagccgctgcttacgtgtcagctgtagagtactttgaacgtgtggctcgttctattgccagcaattctcaagtcagcactaagcctactgatatggtgactgaaccttcctctggcattcctgctgctgagccttcaaccatgacgagagtcccttcttcaacacctttaataaaatctccggtggcaactacccagcagctacccaaagtagcgtcagacaacaaagagaagagattgatttcacagaaaccaagcactgagttccgtagaccaagtggtaggaggattgttcgtccccaacttgtcaaacctgaggaatctcccaaagttgatgttgatatgccagaagctgagggaactggtgatgaaggaaaacagcctgcagcccatgaaccagagagccaagtgactacatctgtacggcctgttcaaacacttgtccgtaaacgccaggctgattcgttggtttctgagccacaacaagatagtctgactcaaggggaaaccagttctgagattgcacctcctgcatcgaagaaggcaaaaggatctgagtctcatcctgatacttccgaaggtgaaaaccttgcaaaagagccagccatagacgaattgatggatgctacaactacaactgatggtgacaatgaagaaacagaagccgagaatgcagaggagaaaacagaggaatatgtggaagcacaacaagacaatgaagctgatgaaccagtggaagaaagtccaactgagacagaaaccattcctaccgaagaagagtctagggatcagaccgaagaagaaaaccaagagcctcttacagatatggaatccgataaggaagaaggagagctcgatctagatacacttgaagatctggaagagggtacagatgtagcaagcatgatgaggagcccagagaaagaagaagtgcaacctgagacgctagctacacccacacagtcaccttctaggatggagacagcaatggaggaagctgaaacaaccattgagacgccggttgaagatgataagaccgacgaaggaggtgatgcagctgaagaagccgctgatatacctaacaatgctaatgatcaacaagaagcaccagaaactgacatcaagccagagacctcagcagctacaacctcccctgtttctaccgctccaacaacttcctctactctagcttctgctattacttcaagcggagctccagaaacagaagatccaaaaagagcaccgtcaccaggtggtggaagttcaactattgtgacactagctgatagagcacagatgaaaagacgagaaagaatagccaatatagtagtaagtcgagctcctaatccagccaccagaggagctcgtggtcgaactgtaaaccttcgaggaggaggccgattgttgcctcgtggtggtcgagccccacgtggtggacgtggacaatccccgagcccaccatgatttttagtgggtatggttgaacaattagacttat

SEQ ID NO: 10 - protein, 2115 aa, Arabidopsis thaliana
MPLFMPDEELARLSSDAASVVAERADEYIRKIYAELDSVRAKADAASITAEQTCSLLEQKYLSLSQDFSSLESQNAKLQSDFDDRLAELAQSQAQKHQLHLQSIEKDGEVERMSTEMSELHKSKRQLMELLEQKDAEISEKNSTIKSYLDKIVKLTDTSSEKEARLAEATAELARSQAMCSRLSQEKELTERHAKWLDEELTAKVDSYAELRRRHSDLESEMSAKLVDVEKNYIECSSSLNWHKERLRELETKIGSLQEDLSSCKDAATTTEEQYTAELFTANKLVDLYKESSEEWSRKAGELEGVIKALEARLSQVESSYKERLDKEVSTKQLLEKENGDLKQKLEKCEAEIEKTRKTDELNLIPFSNFTRRVDNSGTSNMIEESQAVISKVPAGVSGTALAASLLRDGWSLAKIYEKYQEAVDAMRHEQLGRKEAEMILQRVLSELEEKAGFIQEERGEYERVVEAYCLVNQKLQDSVSEQSNMEKFIMELKADLRRRERENTLLQKDISDLQKQVTILLKECRDVQLRCGAARDDDEDDYPLLSDVEMEMESEADKIISEHLLKFKDINGLVEQNVKLRNLVRSLSEQIESRETELKETFEVDLKNKTDEASAKVATVLKRAEEQGQMIESLHTSVAMYKRLYEEEQKLHSSDSRSSDLSPAVVPGRKNFLHLLEDSEEATKRAQEKAFERIRILEEDFAKARSEVIAIRSERDKLAMEANFAREKLEGIMKESERKREEMNSVLARNIEFSQLIIDHQRKLRESSESLHAAEEISRKLSMEVSVLKQEKELLSNAEKRASDEVSALSQRVYRLQATLDTVQSTEEVREETRAAERRKQEEHIKQLQREWAEAKKELQEERSNARDFTSDRNQTLNNAVMQVEEMGKELANALKAVSVAESRASVAEARLSDLEKKIRSSDPKTLDMDSGGIVSLSDKEAALVIILDVVHKIQAGFRIGSAMSIELRTAKEEIEKLRGEVESSKSHMLQYKSIAQVNETALKQMESAHENFRLEAEKRQRSLEAELVSLRERVSELENDCIQKSEQLATAAAGKEDALLSASAEIASLREENLVKKSQIEAMNIQMSTLKNDLETEHEKWRVAQRNYERQVILLSETIQELTKTSQALAALQEEASELRKLADARGIENSELNAKWSEEKLMLEQQKNLAEKKYHELNEQNKLLHSRLEAKHLNSAEKNSRSGTISSGSTDSDHLEDSGLQRVVHYLRRTKEIAETEISLMRQEKLRLQSQLESALKMAESARGSLTAERASTRASLLTDDGIKSLQLQVSEMNLLRESNMQLREENKHNFEKCQEMREVAQKARMESENFENLLKTKQTELDLCMKEMEKLRMETDLHKKRVDELRETYRNIDIADYNRLKDEVRQLEEKLKAKDAHAEDCKKVLLEKQNKISLLEKELTNCKKDLSEREKRLDDAQQAQATMQSEFNKQKQELEKNKKIHYTLNMTKRKYEKEKDELSKQNQSLAKQLEEAKEEAGKRTTTDAVVEQSVKEREEKEKRIQILDKYVHQLKDEVRKKTEDLKKKDEELTKERSERKSVEKEVGDSLTKIKKEKTKVDEELAKLERYQTALTHLSEELEKLKHADGNLPEGTSAVQVLSGSILNDQAAAYVSAVEYFERVARSIASNSQVSTKPTDMVTEPSSGIPAAEPSTMTRVPSSTPLIKSPVATTQQLPKVASDNKEKRLISQKPSTEFRRPSGRRIVRPQLVKPEESPKVDVDMPEAEGTGDEGKQPAAHEPESQVTTSVRPVQTLVRKRQADSLVSEPQQDSLTQGETSSEIAPPASKKAKGSESHPDTSEGENLAKEPAIDELMDATTTTDGDNEETEAENAEEKTEEYVEAQQDNEADEPVEESPTETETIPTEEESRDQTEEENQEPLTDMESDKEEGELDLDTLEDLEEGTDVASMMRSPEKEEVQPETLATPTQSPSRMETAMEEAETTIETPVEDDKTDEGGDAAEEAADIPNNANDQQEAPETDIKPETSAATTSPVSTAPTTSSTLASAITSSGAPETEDPKRAPSPGGGSSTIVTLADRAQMKRRERIANIVVSRAPNPATRGARGRTVNLRGGGRLLPRGGRAPRGGRGQSPSPP

SEQ ID NO: 11 - DNA, 7966 bp, Oryza sativa
tgtacaattgtagctaacaaaacagaatagtaagtgtaagtactctctccatctcattttaaatatatttgtgaaatttttgttaaacgtttatctgtctgtctgatttatttttttatgattaatatttttattgttattatatgataaaaacataaataatactttatgtatgacttttttattttttcataaaattttcaaataagatggacggtcaaatgctggatacatatacccataaatacactttaaatgagacggaggaagtactcttcttgcggtgggcataagtaacaaatgcgaaaatatataagagagtcaagtcaggacatctggttgtgatagtgatacgacgatgaatgcagcagtcaaggtcctaggtgcgaggacaacaccaagtttttctcctttcgtttgatagcatcagggcatcctcaatccacttatatgcatatcttcaattcatatgtgcttagttttccttatccacctatccacttagaatttttctgatttagtgaactaaagatggcacaaagccattgtatatgtcctcataaattcgatcacatattctagttacaatagaataggagtagaagcaaatggtatttataactgagacttgaagtttaatccagtggattctttttaaagtcctactcaaagaaagttaattgttggtgcttggtgttgggtacattttggtggccattgtaggagtaggtctaataattgccagtagaggtaagattatacagggcggggagggtggcagtggttgtcggagttcccctgttagcaagagaccagttcctgtttggtgtaaaatttatactttggcaaaactaaaaatatcggtaaaaaaatgtattactgtagagttttagaggataactatctttaatgacaagttaaaaatgaataactattttctcggtggttttctaccgttagtgctactataatcaccggtagaagaaatctctcagttgttgatttataaattctaccaccaatagataaaaaacattatactaatagttagggtggcagtataaatagataggatccagtaaaaaaaagtctagatatctattatcaatagagaccatagtaaaacacctacttccttcatcccaaaatgttgctagacagatgatgtccagattcattgttctaggatggagcaacattttgagatggaggaagtataatgtattaccccgcaaccacttgttatacgaatgatttgtagtatatatctagttgagttaacttgacacactaaaacttgagccatgcgcatatgcaatgtttatacatattatagcgtcgcaggattttgattatgttttaatgtgactttcttttcatgtttcttatgagattggattgtttgcactttcattcttcgtacacgtttttcgaactactaaatgatgcgtgttttttataaaaaaaatataggacagttgctttggaaaaaaatgtattaatctatttttaaactttaaatagttaatacccattttctttaatggcttatctcgtattctgtacttcacaatcttctcattttccttctctcaaatactccatccgtccaaaaaaaaaacccacttctgggtttgaatatggacataagtggtttttttttgggagagttacatgttgacctaggacgacgagattgtgcatgcatggggagacgtttgacttttgagcatagctcggcaaaggccggccagattgctagggagaaacagggccaggggagacatgacatatgttgtacactatacaacatcttcagaattatgacaaagcacacacaagtcaccataaaaaacacagacaaactgaagtgaacaaggccaaatcgacccctgttgctgtaatttttgtcatgaaaaagaagggctttaggaaatgacacagatatgagtcatcgaagcaggggatccccaagaacagattgcaaaggcaaggtgtgtgcgcgcgcgcgcataagcttcatcagattcagagagagcttaattatcaccgatgtcccatgcatcgatctgcacctggctgtgcatgtactaccccaatgcatttctctctctacctgcgtgtttgactgcaccttgagcagcagcagcagcctagatgctagctactctgcattggaccatcctcctagtcctaggctgtaggctcatagccctccttgataaaagctactactggcacagtatatgcatgcagccaattcacttcactgcagtaaaaaaaaaaagaaaacagagagaaacagagatcaaacaatgcaagaaagaaatacccctacttctactttaaaacaaggccaaagcaaggaaacaaaaggcagcctctattttttttccctcccccccctgctcatcacccctttccatcactccctccctttgcaaagatccttcctgcctttgcttctactgctatatagcctcccccctcaccttccattccagagaaaaatagagggagggagagggagagaagcagagtgttgagcacaagctagtgaaagggttagatagaaacttggtagaatagacagataggcagagagagagagagagcttagcaagctaaggcttagctgctgcaaggctccatccatgcttcttgttgtgagatgagattgagataagatgagcagggggtggtggtgcctggtgtgaggctataggtaagatggtgggaggagagcttgtgctggctgctctggtgatcctgcttgctttgctgctgaccctggtgctgagccacttcctgcctttgctcctgaatcccaaggctcccaagggaagctttgggtggcctctccttggtgagacgctgaggttcctcagtcctcatgctagcaacaccctgggcagcttcctggaggatcactgctccaggtaaattaaaatcatatgcagtaaacatttctatcagtatcaccaccacaaccacacaggagcaacaagtgtcatcttaccatgcaattaagtactgtaccattatttcatgtgacagcacaaggtaatgctgctgtcctgtcccagcagctttatcacgcccttttttttcctccctgatgaggggggtgctgtaacatgaattggacagtgtttagcatcttgttaaagagttgtgcaaaccttttcttccgatgaacaagcgagagaaaaggaatgtaaaggttgcacaacacttaactagctagcatgcatggtggtagtaacactgatgatggtgtgatgatgatgatgcaggtatgggagggtgtttaagtcccatctgttctgcacccccaccatagtgtcctgtgaccaggagctgaaccacttcatccttcagaatgaggagaggctgtttcagtgcagctaccccaggccaattcatggcattctgggcaagtcctccatgttagtggtcctaggggaggaccacaagaggctcaggaaccttgctctagcactggtcacctccacaaagctcaagcccagctaccttggcgacattgagaagattgcactgcatatagttgggtcatggcatggcaagagcaaggacaaggggatggtcaatgtcatcgccttctgcgaggaggcaagaaaggttagcaagtgtactaacttgaaaccagagccatatcaccacaaggacatgatcccttgaaacaagggagggaaaactttgcacatgttagctacataccatcatcatcatgttgttacttgctgctgcatgaatctttgtcccaaggtcactttgacttaccatggtcttttttaccttttctttttttttctctctctggtgtgctctctttccttgagaaccacagtttgcattcagtgtaatagtgaagcaggtgctggggctatcaccagaggagccggtcactgccatgatacttgaagatttcctcgccttcatgaagggtctcatctctttccctctctacatcccagggacgccctatgccaaagctgtgcaggcatgcaactcaacatctcatttacacaagtcgttaaactgtcaataaaattttcaggccattttatttttgtatacttaccataataacttcatccttttgtccgcgaatcctcacaggccagagcgaggatatcaagcactgtgaagggtattattgaggagaggaggaatgctggctccagcaacaagggtgatttccttgatgtgctgctttcaagcaatgagctctctgatgaggagaaagtgagctttgtgctggattccttactgggaggatatgagaccacctcactcttgatctccatggttgtgtatttccttgggcagtcagctcaagatctggaactagtgaaggtatacagacttctcatgctgaaaaagacagagcagtactggtaaataagtacttaattaagtggccatcaataaaatatatattaacatgtttgcatgcagagggagcatgaaggcataagatcgaagaaagagaaggacgagttcttgagctctgaagactataagaagatggaatatacccaacatgtaagatgatcgttcaatacatgctttaggattagttagtaagccaggggtacctttttttcctattatcagcaactacacaaatatgtgaccctccgaatatgaggtttactcatattcagaacgattctcctatgcctacccatatatgcaatttttgaattaagcaaaaaaaagaaaaagaaacagagagagaaagaatctcattacaatagagtgaaaagggcggaagggacatgttcttcaataatggaaactgtatgatgatgcatatgctatgcccttacaggttatcaatgaggcactgagatgtggcaacattgtcaagtttgtccacaggaaggctctcaaagatgtcagatacaaaggtaattaaccctacttgaggctttccttgaagattccattgtgctcatcacatgataatggatcaggcaaagtggatggttgcacctttattactgatttttaagcattgttattcctaaaatacctcagcttttcatagaagatgctcaaaagcaagtggctcttttttctttgctctgttgcagagtatctgattccttctggttggaaggtcctacctgttttcagtgctgttcatttgaaccccttacttcatggaaatgcccaacaatttcagccctgcagatgggaggtacgtttgtttccataatctgtgaatgctccgcaatacttactaaatgtttattgttaatgacctaatgaaaaatgttttggaccagctaggccacgaagcttagctttcacgtagtatacttttctataatacaaatttataaaatgaaaagttcagagcacctatcaagagagcttatctggagccttgaaagaatcttctttaaagggtgttctctaactaattgctacctttaattagtgagcgcccaactatgacataattactcgcaactattctggtgtcttcagatgccaaacaagctccctgtggctgcaatgccttttgtgcatggtcctaaccatgattcctctcattcaaagccagcattcttggctttgcttccttttcttagtttctgtgatgaagctaatggtctgattcatgtgtgttcctaatctgattgatgcaacagggtgcaagccaagggacaagcaagaagtttacgccgttcggcggtggcccccggctctgccctggatcagagcttgcaaaagtagaggctgctttcttcctccatcaccttgtgctcaattataggtaaaacaaaagggtatatttgtcctacccgagtagaagatgcatggatcaaagttgactggcttaaacagcaatgaacaaaatacgttcagaagtaatatttaagaagctggtgcagagtagttggtgtttaaataggccatagaaaactgttgaggcaaacatgaacaggaaaacatactgatgcagttaccactctcatactgataatacacactacactagaccactagtaagtaatggcaagaaggccatgacagcaactaggcaaattatttatgcttttgtctgtaaggaccgcaagtctgaactcagctatcttgtgcattttcataagtggcactgtagagcatagaatcagacgacaacacacagaacaaacatgacagcatggagttttcgataggtaggctatgcaagttgagttgagggctgccatacaagataaaatatactaccacgatatgatcaaactcttttttttaaaaaaaaaactaggttcattagcaacaatctatacgtgacaactgacaagaacaggcagatttatgtaaattatgcggttgtttcagagtagagtctacatgtacttactgaatatccatgccagagaaaggctgatcatcgttcttcgtttctttcgtttcttgaaaacctgtgcagatggagaatcgatggcgatgacattccgatggcatacccgtacgtggagttccagagaggtctgcccatagaaatcgagccactttgctctgaatcctgacaggtttgcagttgcagccacggtgagcgagttcatcaaatcatccccgcaagcgagggggagatgcgggcgagaacgacggactgagaggattagtcagtgaaacaaaaaaaaggagagaaaatatttcaagaactgaagaatgcactgagcattagctagtagtacctatcaatgagccaagctgagattgtaatttgctgtacatggtgtagatatattttgtccatgccgattgcttgcggtggtggtggtgcggtgcttcaccctgtaacatcctccactgtttcaactttcatctgctattctatagaagaaaaaaaaaagaagaaaattgggctattgggctattgaaaagattttggatgaagccaaagatcttcaaaaacaaatcattgaaactttgaaagagtactcctatcctttaataatatgaacatgaacatgaacatgtatggactgtactctgcactacttctcagggaatttcggagcagacaaattcgatcgtggataatccctatcaatcggagatggctggtcccgtttggattggaggaatttctgaaggaatcctttcctgcaggggaaatcttagtttcagtgtttctggactgaaggaaaaaaccggacgaacagcagcattattccataagagtgggagttcccccccccccccccctcacatcgctagacgatttcacgggataacagtccccgaatccaccacgcgtaacctcgcccaggatcgaggccgaattccagccgaagccgcgccgcgccgtcgtccccgtatccaatccaccgcggcgtcgactctcccgccgttgcgcccggcccaacgccggcggcggtcccgcctctagcggcgcccgcaggatcatctgcacacccccgcgcgacaccgccgcccgccatgcccgccgctcgagctcaacgtgagaaggggaaggggagagagatcatagtatgagaggtttactggagaggataagttaaagagaaaaaaggtataaaaaagaaagaaagagaaagatcataatatgatttttctatgttttttttaccaaaattttcgatgtttattttttaccagaattttctatgtttattttttaccagaattttctatgtttattttttaccaaaattttctatgtttggtggagtaatcctcagtttttgcagtcgtgttgctgtgttttcttttttgcgcctatattcctgtgtaatttgtatagggcataaagtttgtcggaacttgggattatgtggaacatagcatcgcattgttcaggaatgaggactgcaattttgatcttcggggatttgatcttgaaaaacatacgcacatacaaaattgtatcacattgttcaggactcaggattgc

SEQ ID NO: 12 - protein, 480 aa, Oryza sativa
MVGGELVLAALVILLALLLTLVLSHFLPLLLNPKAPKGSFGWPLLGETLRFLSPHASNTLGSFLEDHCSRYGRVFKSHLFCTPTIVSCDQELNHFILQNEERLFQCSYPRPIHGILGKSSMLVVLGEDHKRLRNLALALVTSTKLKPSYLGDIEKIALHIVGSWHGKSKDKGMVNVIAFCEEARKFAFSVIVKQVLGLSPEEPVTAMILEDFLAFMKGLISFPLYIPGTPYAKAVQARARISSTVKGIIEERRNAGSSNKGDFLDVLLSSNELSDEEKVSFVLDSLLGGYETTSLLISMVVYFLGQSAQDLELVKREHEGIRSKKEKDEFLSSEDYKKMEYTQHVINEALRCGNIVKFVHRKALKDVRYKEYLIPSGWKVLPVFSAVHLNPLLHGNAQQFQPCRWEGASQGTSKKFTPFGGGPRLCPGSELAKVEAAFFLHHLVLNYRWRIDGDDIPMAYPYVEFQRGLPIEIEPLCSES

SEQ ID NO: 13 - DNA, 4963 bp, Oryza sativa
atgtagtatatttttattctactggctcttgtactggatgttgctgctgcaagtgatcgatgcatgcatgagagtgatgagctgcttctgcttgttgccttcctcactttgggcatttctctctcgccttcctgtccattgctggccttatgtgaggttttgccaatacctctaatcatctcctctctcactttctctctctcttgatgctactactgccttgcagaggcagcaacaggagagagtagcagattcctttgttgttctgcccacaagagagaactcacaactcacaagtagtagcagtaacaacatcagcagcaggtactactagacccacacacatgcaagcacagatatgagtatatgatctttctcccatgccacaagtgaaaagatttctccctctccattatcctttgtttccttttgccttttgtattgttctgaatgcatgctgctagctactccagctactggttgctctctctacacatgtgtgtatacaactacacatactatgcttatttgtacaaaattttgtgcagggttggaagcaagggatctctgcatgctgtggttgcatgacacagatgcacatgtcccttttggtgggtaatgatggggtgcaggtggaggtgatgatagattgcctcatctggggactgagacattccatccaagggtgcccaatgccatgccctcacattcactcacagctagtagagctatccccctcccctcccctctttgcaatattccatttgtttgctaatgtgttgtatcaagatgcccttgatgtgagtgttcactgccctctctgtccctcattttttgcatctctcattctcatgcattgcataccatgtacaactactgcttcagctagaattgcatgtgatgtatatatatgatagtatatcctttgcatctcgggaaaatatgtagtgcaaatcacatatatagtggaaacttgaaaactaccgttgaatcgagaaatggacgtccgagattcgtccacgtcatcatgagttaaaatttaactcgcagattcactcatgagttaaaattttactcggagttaaattttaactcatgatgacgtaaacgaatctcggacgtccatttctcgatccaatggtagttttcaagttttcactacatatgtggtttgtactgtatattttcccttgcatctccatgtatctcaaaagttacatgagtggcacttgctactgtgcatgtagtatgtgtagcagctaggttataaatttctttatgtgtaacatgtgtgtgatgcatagtatatgcaatgtgaaacactgacacagctagaccaggtgtggggggtgtgcttgttcttgttgcaaggaagttatctggaggccatcatcaatgaagatcccaccaagggacaaaacatgagatggttggagacttgggtctgtctagtctctattcaaccatttaaagcattgcgtgtgtaggctacactcggagagagaacacagagcagccgtccaaaccgtctgaaatgataacttactctaagctagtaggagtgctagtagtaccctctatatgtgcaattttattcgttaaaaaggtttccatgcatgcttttttagtttatcaatagcctaaaccttttgaattattaagagttaattagtcccaagtgtgtatgattactcccccaaattctctttgttttcttcgaaaaatttgcagttatttaagtgaggtcctctctctctctctctctctctctctctttgataaactgaggttctcaagtttcatgttttaccaattaatcaatcccaagtaggttttatttttgttgatttaagtcctcggacctcaagccctgaacattcaataatttatcaaattcaaggacctgcagttagataatttttagttaatagaaaaaaatatcgcatttgttgcaacgggtgaagactattttaatcttattattgttatacggtttagctagggtaaaatttactctaaaaattcgtttgaactttttttaaaaatgtcatgagctacaattaggagtttgactttcgtcacaagttagcatgcaagtttttttaaatatatttcttatacgactccttttgtattttcaaaagtgaacaaacataaaagctaactcaaacacaaatctatatttgcaaaagcgaacgaaattaaaaaccagctcaaacaagaatgacatacaaagtactgacaaaaacatatttaatttttataatagtagagatatgagtaaaagggaccaaaatcaacaaagcaaatagtggagagccggaatcaacactgtctgacttggtgaagatctcaattacacaaaaatgaatgctttaaaaggatcatttaattaaagaaataccaaatatataataatagctagtaccatcatattatatatactccctttgtccctgaaagagtattatccagattcattcatagctaaaaatacactcttttagagatggccggagtatcattatatgtctatagcatatacttctacttaacatatataaatacatactccctccgccctaaaataagtgcagttttgcactattcacgttcaacgtttgaccgtccgtcttatttgaaaattttttatgattagtatttttattgctattagatgataaaacatgaatagtactttatgtgtgactaaatgtttttaattttttataaatttttcaaataagacggacggtcaaacgttgaacgtgaatagtgcaaaactgcacttattttgggacggagttagtacatatatatacacattacacattgcatacataaacatacaaccacactgccctctagctatacacatgccatgatgccaagagccaatgatcaccacccaaatccttctagcaatagctccctatggcacaaacagtcacagctgcacaaacacacacacacacacacatatcacccattcatctactctagctaatctaaaggcactagcatagtactacaatcaaccagtagtagtagccctcatttgcatgtttttatttcgcccaccaatccttggaatgttttagattcccccctctcactctctcatcaaggaatgagcatcccccattctcccccaacccctcatattttcagtttctcactctacctttcccctcctcccctagctaacccctctctctttctctctctaaagctccaatctttctacctttctctctctaaaagctggagtagcttaatttctttctttctttttctttctcagctgggattgcacagtgaagctagggagaggctatagctatgggggtgatgtagctgggcagtgaggctagtgacaatctctctctcacacacacacacacaaaaacacttgtgtatttttggcagatgatgtcctgtcaaggaagctgcaattgcaagcccagatgttggacgtgcacgctcgccctccctattaaacccgccctcctccgatgctccctctcctcctcccccctcgccgccgccgccgccaccttctccggcagctcaccgtcgttgtagtagctctggtggtggtggtggtgacgacgacggctacggcggcggcgacggcatgctccggtcactccactcctcgtcgtcttctgacacggataacaacagcggtggctgcaagaacaatggcggcggcggtggcgaggccgccgccgccgttgagggtggcggtgatcagcgtgccgttgcggcggcggcgccgtcgacgcgggacttgctgctggcgtgcgcggacctgctgcagaggggggacctgccggcggcgaggcgagcggcggagatcgtcttggcggcggcggcgtcgccgcggggcgacgcggcggaccgcctggcgtaccacttcgcccgcgcgctggcgctccgggtggacgccaaggccggccatggccacgtcgtcgtcggcggcggcgcggcgcggccggcgtcgtccggggcgtacctggcgttcaaccagatcgcgccgttcctgcgtttcgcgcacctcacggcgaaccaggccatcctcgaggccgtcgacggcgcgcgccgcgtccacatcctcgacctcgacgccgtccacggcgtgcagtggccgccgctgctgcaggccatcgccgagcgcgcggacccggcgctcggcccgcccgaggtccgcgtcaccggcgccggcgccgaccgcgacaccctcctccgcaccggcaaccgcctccgcgccttcgcccgctccatccacctccccttccacttcaccccgctcctcctctcctgcgccaccacggcgccccaccacgtcgccggcacgagcaccggcgccgccgccgccgcctcgaccgccgccgccgccactggcctcgagtttcacccggacgagacgctcgccgtgaactgcgtcatgttcttgcacaacctggccggccacgacgagctcgccgcgttcttgaagtgggtgaaggccatgtcgcccgccgtggtgaccatcgccgagagggaagcaggcggcggcggcggcggcggcgaccacatcgacgacctgccgcggcgggtcggggtggccatggatcactactcggcggtgttcgaggcgctggaggcgacggtgccgccggggagccgggagcgcctcgccgtggagcaggaggtgctgggccgggagatcgaggccgcggtggggccctccggcggccggtggtggcgcggcatcgagcggtggggcggcgccgcccgcgccgcggggttcgcggcgcggccgctcagcgcgttcgccgtgtcgcaggcgcggctgctgctccggctgcactacccgtcggagggctacctcgtgcaggaggcgcgcggcgcctgcttcctcgggtggcagacgcgcccgctgctctccgtctcagcgtggcagccgtcgtcgtcgtag

SEQ ID NO: 14 - protein, 666 aa, Oryza sativa
MHESDELLLLVAFLTLGISLSPSCPLLALCEGWKQGISACCGCMTQMHMSLLVGNDGVQVEVMIDCLIWGLRHSIQGCPMPCPHIHSQLVELSPSPPLFAIFHLFANVLYQDALDYMQCETLTQLDQVWGVCLFLLQGSYLEAIINEDPTKGQNMRWLETWEAAIASPDVGRARSPSLLNPPSSDAPSPPPPSPPPPPPSPAAHRRCSSSGGGGGDDDGYGGGDGMLRSLHSSSSSDTDNNSGGCKNNGGGGGEAAAAVEGGGDQRAVAAAAPSTRDLLLACADLLQRGDLPAARRAAEIVLAAAASPRGDAADRLAYHFARALALRVDAKAGHGHVVVGGGAARPASSGAYLAFNQIAPFLRFAHLTANQAILEAVDGARRVHILDLDAVHGVQWPPLLQAIAERADPALGPPEVRVTGAGADRDTLLRTGNRLRAFARSIHLPFHFTPLLLSCATTAPHHVAGTSTGAAAAASTAAAATGLEFHPDETLAVNCVMFLHNLAGHDELAAFLKWVKAMSPAVVTIAEREAGGGGGGGDHIDDLPRRVGVAMDHYSAVFEALEATVPPGSRERLAVEQEVLGREIEAAVGPSGGRWWRGIERWGGAARAAGFAARPLSAFAVSQARLLLRLHYPSEGYLVQEARGACFLGWQTRPLLSVSAWQPSSS

SEQ ID NO: 15 - DNA, 2588 bp, Oryza sativa
agtttcagtttcagagagaggagtcagtggctgtatgctgccatggctctcaaggtggctagatagacagacatgttgcccatcaacttaagaagcaactagctgctgctgctgctaagggagagctataggcttagctgtggtaggctatagatattactattaggtagctactagcctataggcagacatggggagacctccatgctgcgacaatggcgtcggcgtcaagaaagggccatggacgccagaggaggacatcatcctcgtctcctacatccagcagcatggccccgggaactggcgctccgtgcccgagaacaccggttagccccccccccctccccctggctctcgcgttttcgatccattcgtcgtcgaatgatcgatattgcatgtgtttgatttttgcatggttgatatcagaagctgttttagttatgcttctgttgttgtttaggagttgatgataagtttgtttctgttgtgttttttgtatgtgtttaggattgatgaggtgcagcaagagctgcaggctgcggtggacgaactacttgagaccggggatcaagcgtggcaacttcacccctcatgaggaggggatcatcatccacctccaggcattgcttggcaacaagtaatcacgtacataactcaatttaaataaattgttgtatcatatacatgagcatcaaaatctaatgggatgtttttagtttattttctatccttgaagagatatatatacatccgtaccactccgagataaaaaaaactgtaaatcaattgaactgattagaattgacattgttagaattttcctggttcttgggatgaataaaatgtttacttttatatgtgaatctagatgtagattatgtccagattcatttaaaaaatagacttattttataacggagggagcatataacctcatagttttacacgtaaggtacatacctcctaactaatactcatacctcttaaagattgaagaaaacgccaacaaatatataggtgaactcccaatcctactctcatttgttatgatattggttttggtacatcacttcacagatcttatatacctctgaactctagtccaagaatgaaagaaaacctctatgcactcctatatattgtttatagtttaagcttagttttatgataactcaagcaaaccctgactttctgatgatcatctgaactttttcaaaatcatattgtctttaccttaatcatgctttaccttttgcatatattacatgacaggttataacatacgccctccgtcccaaaaaactcaacttctagagattgaattttgtctaaaaaaaacaacttctatcatcctacctactctcagtacgtaaaacgagaagttttatcccttcaataccctttacctatctatctctcttactactttttttcaatgattatgggtattttagtcaatcttcatctccactatttttgtcttgggatgttaggattgacatttttatgggacggagagagtagtgcctaaatatttatctattgtgcatgcaggtgggcagcaatagcctcctacctcccccaaagaacagacaacgacatcaagaactactggaacacacacctcaagaagaaggtgaagaggctgcaacaacaacaacaatcacaccctgatcatcatcaccaccattccttccaaaccaccccttcttcctccaatgcagcagcagtagcaacaaccagcccaaactactacaaccctaacaacagcaacagcaacagcagcaattacctccataacaacaaccacaatcttgaatccatgcaatccatggccactgcacctagcaatgaggccaccaccatccccaagctcttccagttccagacatggatgaagccatcaccagcaacaacatcatcagcagcaacagctgctgcaggtagctgctacaagcaggccatggccatgcaggagctccaagaggagcaagagggctctgctgctgctgctgcaatggcttcttccattgatggcgtctccaaggaccaggattatcacatgtgtgctgtgatcagtggtgatgacaagtcgtcgtcgtcggagatgatgacggctgcggcaatggccggccatggcgaggcggccacgacgaccttctcgctgctcgagaactggctgctcgacgacatgccggggcaggcggccatgagcgccgccatggatgggttcttggagatctctgctggatactgctgtgcagaccctatcatgttctgaactttctgaacttctgatgatcatctcagccttaatttcccatatgagtctctctttgctataggtttcttaatttcactgagttaatttgcacttgtactagctgtttgatgctctctctctctcgatgatcttgtgtttccggtaataaaccgttggtttaatttcctcaagaaaaagcaatccacctggaaataatctggttggtttggagaaatattgtcagttctcaaggatgtaataaaaggattaaagctgccataattcgttgcctgatatgcaatgttcttgttgtttttggagatgg

SEQ ID NO: 16 - protein, 330 aa, Oryza sativa
MGRPPCCDNGVGVKKGPWTPEEDIILVSYIQQHGPGNWRSVPENTGLMRCSKSCRLRWTNYLRPGIKRGNFTPHEEGIIIHLQALLGNKWAAIASYLPQRTDNDIKNYWNTHLKKKVKRLQQQQQSHPDHHHHHSFQTTPSSSNAAAVATTSPNYYNPNNSNSNSSNYLHNNNHNLESMQSMATAPSNEATTIPKLFQFQTWMKPSPATTSSAATAAAGSCYKQAMAMQELQEEQEGSAAAAAMASSIDGVSKDQDYHMCAVISGDDKSSSSEMMTAAAMAGHGEAATTTFSLLENWLLDDMPGQAAMSAAMDGFLEISAGYCCADPIMF

SEQ ID NO: 17 - protein, 2038 aa, Oryza sativa
MPLFMSEEELRLLGGDVAAVAERADAAIRELRQQVDTVRAEADAAAIAAEQTCALLEQRYDTLSAEADRFRAELAELAAASERRAADLASSQSEIHQLRIQAIAKDGEIERLKVEISEVHKSKSQSLELIEQRDAEIREKDGIIQNYHDKIVNLADSSASKGARIQEVEAKFTHLQATCNRITQEKDLLEKHNLWLDEELKEKVKNLAELRKSNMDEEARMSAKVAELERETSESSSSLRRSKERVSELEQRVSYMEKELCSTKDAAAANEQRLAAELSTVMKLAELHKESSEEWSKKAGELEGVIKALETHLTQVEDEYKEKLEKETSAKRDLEMEATYLKQKLEKCESDLENTRKSSELSFTPLVAADPCDLAGSPMKEMAFSDPANQNDLMIVPKVPTGVSGTALAASLLRDGWSLAKIYEKYQEATDALRHERFGRRHAEAVLERVLHEIEEKAELILDERAEHRRMVEAYALMDQKLQQALLEHDNFENTIRNLKSELKRRERDHSIAQKEIDDLQKQIKLSIYLTFAPTQACILGVCTSKNYYDINGNHCGAVLKIAVLLKECQDIQLRCGSSLPNVGDGALSTSTSTGVPEVENNIHEHMTFNDINGLVQQNVQLRNQVHLLSADLDKRDMELRESFQIELKKITDDAASRVEKVMKKSEEQAIMIESLHRSVAMYRKLCQEQQKSRSNVEHIPKNLEDDGRKDLMVLFEGSQEVSRKAYEQVSERAKSLDEELTKLRTELLSLRSERDKAVLEAEFARERLNGFTAELEHQRKEANSISLRNAELMHLVVDYEKRLRENSESMKAVEENSRKLLMEMSILKNEKEILAKSEKKALEEVHDLTTRVHRLQATIDTIHATEEVQENARSIERRNQEEYIKRLERDWAEVKKELQEQRDHVRVLTLDKKNAFDGCLKQVEDMRKELQNSWKAATDAESRAAVAEAKCSDMETKLKSRKENDELFQLKEELEKYKEEAQANKSYMLQYKEIANSNESALKQMESALQDFKTESETIKKSLEDEITKLRTKISELEKCYIMKCEEAASAIEAKEKDTTSLMKEISVLRNEVSEKVIQIEKLETELASSKRALDEQYKRWRSAQDNYERQVILQSETIQELTSASKELSSLQQEIIVLRQTVETQKAENDGLRTLGEQEKIELVKGKDEALQKYNELNDQNKILHNQLEALHIRLAEKERNIAGLSSQRIDSHGEDDLHSVIGYLRRSKEILESALKSTKEAQDLLRSQTDSARTSMLKDEEFKSLQFQVRELNLLRESNIQLREENKHNFEECQKFHDEAQKAKMEAERLHNLLLEKQVDAEICKKEIEMQKTEIANLNQKISELVENSRGVDLSTYETMKDELQNIKATLRENSAELERTKKLLSEKDSVIRNLEEKLAGCLSELDAREKKLNDVEASLKSEIDRHRKININIKRKLDASAKEKEELTKEKQSLSKQLEDLKSSQKTTTENSNEQAIKEKDFRIQTLEKVLEKERDDNKKEKAFRRRNEKVFTTAIQNMNQERKQVEESIEKHRQAVKEVIEHYTGISSQIPSGSAIDEQLRSYFLAIKAVEESPSPFQDGAASQTPSVESADVDASAATAGRQVATPPRPAQVKVVEERAVSTLPKPSTEVRRPGGRRPLVRPSLERVEEPQADIDTTVVEGSTEKGGLLMERETPGGVSALQPSSRKRLIPSPQMRDDASQGETTDANPPLKKPKEGSSQGTSELKTEQSPHEDVMAPVPVLPSTELDEQQPGEEMDTDQSSLPVEEVEETREDDLGDKDDMETHMDASMDIQGQDAETGIDNDATTVEDVPVKSEAVMESLEEDLKTEDGKEEGQFTATTDVEDEREEGELPDEPEQPDSTPPVLDVGEQAGDSFRAASPAGPTEKSDVDMPEETGEGDGTMESDQSPVPQSGGADASPSQMADASPSPAREPSPNPVQAGAPPEQQNPTPPNPVQAGASSEQQNPATAAEGVETRSTRTINLTERARQNRQARILRSATQQNARGRGNQSLTYRKDGGRGTRGRGGRGQS

SEQ ID NO: 18 - protein, 1978 aa, Oryza sativa
MPLFMSEEELRLLGGDVAAVAERADAAIRELRQQVDTVRAEADAAAIAAEQTCALLEQRYDTLSAEADRFRAELAELAAASERRAADLASSQSEIHQLRIQAIAKDGEIERLKVEISEVHKSKSQSLELIEQRDAEIREKDGIIQNYHDKIVNLADSSASKGARIQEVEAKFTHLQATCNRITQEKDLLEKHNLWLDEELKEKVKNLAELRKSNMDEEARMSAKVAELERETSESSSSLRRSKERVSELEQRVSYMEKELCSTKDAAAANEQRLAAELSTVMKLAELHKESSEEWSKKAGELEGVIKALETHLTQVEDEYKEKLEKETSAKRDLEMEATYLKQKLEKCESDLENTRKSSELSFTPLVAADPCDLAGSPMKEMAFSDPANQNDLMIVPKVPTGVSGTALAASLLRDGWSLAKIYEKYQEATDALRHERFGRRHAEAVLERVLHEIEEKAELILDERAEHRRMVEAYALMDQGVCTSKNYYDINGNHCGAVLKIAVLLKECQDIQLRCGSSLPNVGDGALSTSTSTGVPEVENNIHEHMTFNDINGLVQQNVQLRNQVHLLSADLDKRDMELRESFQIELKKITDDAASRVEKVMKKSEEQAIMIESLHRSVAMYRKLCQEQQKSRSNVEHIPKNLEDDGRKDLMVLFEGSQEVSRKAYEQVSERAKSLDEELTKLRTELLSLRSERDKAVLEAEFARERLNGFTAELEHQRKEANSISLRNAELMHLVVDYEKRLRENSESMKAVEENSRKLLMEMSILKNEKEILAKSEKKALEEVHDLTTRVHRLQATIDTIHATEEVQENARSIERRNQEEYIKRLERDWAEVKKELQEQRDHVRVLTLDKKNAFDGCLKQVEDMRKELQNSWKAATDAESRAAVAEAKCSDMETKLKSRKENDELFQLKEELEKYKEEAQANKSYMLQYKEIANSNESALKQMESALQDFKTESETIKKSLEDEITKLRTKISELEKCYIMKCEEAASAIEAKEKDTTSLMKEISVLRNEVSEKVIQIEKLETELASSKRALDEQYKRWRSAQDNYERQVILQSETIQELTSASKELSSLQQEIIVLRQTVETQKAENDGLRTLGEQEKIELVKGKDEALQKYNELNDQNKILHNQLEALHIRLAEKERNIAGLSSQRIDSHGEDDLHSVIGYLRRSKEILESALKSTKEAQDLLRSQTDSARTSMLKDEEFKSLQFQVRELNLLRESNIQLREENKHNFEECQKFHDEAQKAKMEAERLHNLLLEKQVDAEICKKEIEMQKTEIANLNQKISELVENSRGVDLSTYETMKDELQNIKATLRENSAELERTKKLLSEKDSVIRNLEEKLAGCLSELDAREKKLNDVEASLKSEIDRHRKININIKRKLDASAKEKEELTKEKQSLSKQLEDLKSSQKTTTENSNEQAIKEKDFRIQTLEKVLEKERDDNKKEKAFRRRNEKVFTTAIQNMNQERKQVEESIEKHRQAVKEVIEHYTGISSQIPSGSAIDEQLRSYFLAIKAVEESPSPFQDGAASQTPSVESADVDASAATAGRQVATPPRPAQVKVVEERAVSTLPKPSTEVRRPGGRRPLVRPSLERVEEPQADIDTTVVEGSTEKGGLLMERETPGGVSALQPSSRKRLIPSPQMRDDASQGETTDANPPLKKPKEGSSQGTSELKTEQSPHEDVMAPVPVLPSTELDEQQPGEEMDTDQSSLPVEEVEETREDDLGDKDDMETHMDASMDIQGQDAETGIDNDATTVEDVPVKSEAVMESLEEDLKTEDGKEEGQFTATTDVEDEREEGELPDEPEQPDSTPPVLDVGEQAGDSFRAASPAGPTEKSDVDMPEETGEGDGTMESDQSPVPQSGGADASPSQMADASPSPAREPSPNPVQAGAPPEQQNPTPPNPVQAGASSEQQNPATAAEGVETRSTRTINLTERARQNRQARILRSATQQNARGRGNQSLTYRKDGGRGTRGRGGRGQS

SEQ ID NO: 19 - protein, 1978 aa, Oryza sativa; identical to SEQ ID NO: 18

SEQ ID NO: 20 - protein, 1978 aa, Oryza sativa; identical to SEQ ID NO: 18

SEQ ID NO: 21 - protein, 1978 aa, Oryza sativa
MPLFMSEEELRLLGGDVAAVAERADAAIRELRQQVDTVRAEADAAAIAAEQTCALLEQRYDTLSAEADRFRAELAELAAASERRAADLASSQSEIHQLRIQAIAKDGEIERLKVEISEVHKSKSQSLELIEQRDAEIREKDGIIQNYHDKIVNLADSSASKGARIQEVEAKFTHLQATCNRITQEKDLLEKHNLWLDEELKEKVKNLAELRKSNMDEEARMSAKVAELERETSESSSSLRRSKERVSELEQRVSYMEKELCSTKDAAAANEQRLAAELSTVMKLAELHKESSEEWSKKAGELEGVIKALETHLTQVEDEYKEKLEKETSAKRDLEMEATYLKQKLEKCESDLENTRKSSELSFTPLVAADPCDLAGSPMKEMAFSDPANQNDLMIVPKVPTGVSGTALAASLLRDGWSLAKIYEKYQEATDALRHERFGRRHAEAVLERVLHEIEEKAELILDERAEHRRMVEAYALMDQGVCTSKNYYDINGNHCGAVLKIAVLLKECQDIQLRCGSILPNVGDGALSTSTSTGVPEVENNIHEHMTFNDINGLVQQNVQLRNQVHLLSADLDKRDMELRESFQIELKKITDDAASRVEKVMKKSEEQAIMIESLHRSVAMYRKLCEEQQKSRSNVEHIPKNLEDDGRKDLMVLFEGSQEVSRKAYEQVSERAKSLDEELTKLRTELLSLRSERDKAVLEAEFARERLNGFTAELEHQRKEANSISLRNAELMHLVVDYEKRLRENSESMKAVEENSRKLLMKMSILKNEKEILAKSEKKALEEVHDLTTRVHRLQATIDTIHATEEVQENARSIERRNQEEYIKRLERDWAEVKKELQEQRDHVRVLTLDKKNAFDGCLKQVEDMRKELQNSWKAATDAESRAAVAEAKCSDLETKLKSRKENDELFQLKEELEKYKEEAQANKSYMLQYKEIANSNESALKQMESALQDFKTESETIKKSLEDEITKLRTKISELEKCYIMKCEEAASAIEAKEKDTTSLMKEISVLRNEVSEKVIQIEKLETELASSKRALDEQYKRWRSAQDNYERQVILQSETIQELTSASKELSSLQQEIIVLRQTVETQKAENDGLRTLGEHEKIELVKGKDEALQKYNELNDQNKILHNQLEALHIRLAEKERNIAGLSSQRIDSHGEDDLHSVIGYLRRSKEILESALKSTKEAQDLLRSQTDSARTSMLKDEEFKSLQFQVRELNLLRESNIQLREENKHNFEECQKFHDEAQKAKMEAERLHNLLLEKQVDAEICKKEIEMQKTEIANLNQKISELVENSRGVDLSTYETMKDELQNIKATLRENSAELERTKKLLSEKDSVIRNLEEKLAGCLSELDAREKKLNDAEASLKSEIDRHRKININIKRKLDASAKEKEELTKEKQSLSKQLEDLKSSQKTTTENSNEQAIKEKDFRIQTLEKVLEKERDDNKKEKAFRRRNEKVFTTAIQNMNQERKQVEESIEKHRQAVKEVIEHYTGISSQIPSGSAIDEQLRSYFLAIKAVEESPSPFQDGAASQTPSVESADVDASAATAGRQVATPPRPAQVKVVEERAVSTLPKPSTEVRRPGGRRPLVRPSLERVEEPQADIDTTVVEGSTEKGGLLMERETPGGVSALQPSSRKRLIPSPQMRDDASQGETTDANPPLKKPKEGSSQGTSELKTEQSPHEDVMAPVPVLPSTELDEQQPGEEMDTDQSSLPVEEVEETREDDLGDKDDMETHMDASLDIQGQDAETGIDNDATTVEDVPVKSEAVMESLEEDLKTEDGKEEGQFTATTDVEDEREEGELPDEPEQPDSTPPVLDVGEQAGDSFRAASPAGPTEKSDVDMPEETGEGDGTMESDQSPVPQSGGADASPSQMADASPSPAREPSPNPVQAGAPPEQQNPTPPNPVQAGASSEQQNPATAAEGVETRSTRTINLTERARQNRQARILRSATQQNARGRGNQSLTYRKDGGRGTRGRGGRGQS

SEQ ID NO: 22 - protein, 1978 aa, Oryza sativa; identical to SEQ ID NO: 21

SEQ ID NO: 23 - protein, 1978 aa, Oryza sativa; identical to SEQ ID NO: 21

SEQ ID NO: 24 - protein, 1978 aa, Oryza sativa
MPLFMSEEELRLLGGDVAAVAERADAAIRELRQQVDTVRAEADAAAIAAEQTCALLEQRYDTLSAEADRFRAELAELAAASERRAADLASSQSEIHQLRIQAIAKDGEIERLKVEISEVHKSKSQSLELIEQRDAEIREKDGIIQNYHDKIVNLADSSASKGARIQEVEAKFTHLQATCNRITQEKDLLEKHNLWLDEELKEKVKNLAELRKSNMDEEARMSAKVAELERETSESSSSLRRSKKRVSELEQRVSYMEKELCSTKDAAAANEQRLAAELSTVMKLAELHKESSEEWSKKAGELEGVIKALETHLTQVEDEYKEKLEKETSAKRDLEMEATYLKQKLEKCESDLENTRKSSELSFTPLVAADPCDLAGSPMKEMAFSDPANQNDLMIVPKVPTGVSGTALAASLLRDGWSLAKIYEKYQEATDALRHERFGRRHAEAVLERVLHEIEEKAELILDERAEHRRMVEAYALMDQGVCTSKNYYDINGNHCGAVLKIAVLLKECQDIQLRCGSILPNVGDGALSTSTSTGVPEVENNIHEHMTFNDINGLVQQNVQLRNQVHLLSADLDKRDMELRESFQIELKKITDDAASRVEKVMKKSEEQAIMIESLHRSVAMYRKLCEEQQKSRSNVEHIPKNLEDDGRKDLMVLFEGSQEVSRKAYEQVSERAKSLDEELTKLRTELLSLRSERDKAVLEAEFARERLNGFTAELEHQRKEANSISLRNAELMHLVVDYEKRLRENSESMKAVEENSRKLLMKMSILKNEKEILAKSEKKALEEVHDLTTRVHRLQATIDTIHATEEVQENARSIERRNQEEYIKRLERDWAEVKKELQEQRDHVRVLTLDKKNAFDGCLKQVEDMRKELQNSWKAATDAESRAAVAEAKCSDLETKLKSRKENDELFQLKEELEKYKEEAQANKSYMLQYKEIANSNESALKQMESALQDFKTESETIKKSLEDEITKLRTKISELEKCYIMKCEEAASAIEAKEKDTTSLMKEISVLRNEVSEKVIQIEKLETELASSKRALDEQYKRWRSAQDNYERQVILQSETIQELTSASKELSSLQQEIIVLRQTVETQKAENDGLRTLGEHEKIELVKGKDEALQKYNELNDQNKILHNQLEALHIRLAEKERNIAGLSSQRIDSHGEDDLHSVIGYLRRSKEILESALKSTKEAQDLLRSQTDSARTSMLKDEEFKSLQFQVRELNLLRESNIQLREENKHNFEECQKFHDEAQKAKMEAERLHNLLLEKQVDAEICKKEIEMQKTEIANLNQKISELVENSRGVDLSTYETMKDELQNIKATLRENSAELERTKKLLSEKDSVIRNLEEKLAGCLSELDAREKKLNDAEASLKSEIDRHRKININIKRKLDASAKEKEELTKEKQSLSKQLEDLKSSQKTTTENSNEQAIKEKDFRIQTLEKVLEKERDDNKKEKAFRRRNEKVFTTAIQNMNQERKQVEESIEKHRQAVKEVIEHYTGISSQIPSGSAIDEQLRSYFLAIKAVEESPSPFQDGAASQTPSVESADVDASAATAGRQVATPPRPAQVKVVEERAVSTLPKPSTEVRRPGGRRPLVRPSLERVEEPQADIDTTVVEGSTEKGGLLMERETPGGVSALQPSSRKRLIPSPQMRDDASQGETTDANPPLKKPKEGSSQGTSELKTEQSPHEDVMAPVPVLPSTELDEQQPGEEMDTDQSSLPVEEVEETREDDLGDKDDMETHMDASLDIQGQDAETGIDNDATTVEDVPVKSEAVMESLEEDLKTEDGKEEGQFTATTDVEDEREEGELPDEPEQPDSTPPVLDVGEQAGDSFRAASPAGPTEKSDVDMPEETGEGDGTMESDQSPVPQSGGADASPSQMADASPSPAREPSPNPVQAGAPPEQQNPTPPNPVQAGASSEQQNPATAAEGVETRSTRTINLTERARQNRQARILRSATQQNARGRGNQSLTYRKDGGRGTRGRGGRGQS

SEQ ID NO: 25 - DNA, 5745 bp, Oryza sativa
gcacatatgagaccatgaaggatgaacttcaaaacataaaagttagtggttttttttattatttttatcttttcaaatcattttgataagtatttttagttattatgttatacttattcttttggtgattgaatttggtctgaacatattttttgttctataaattgtactctgatccaagatataagaacttctggtattcttggggattaaggaaagaggtgaaattgaattggggatggttgcgattagttgagatgaggaaacaagtagagaaattagatgagaaatggttgtgattagttgggatgggggagtaggtgaagttgctatattttgggacattgagagtactgataaaataatactacatttgttcttttgtatgctggtttgactagagatcaactgtttaatgaagcattcggttctgaacctagttcaagcttggaatcagatagctacggtaaagaatagggaaaatgaccattggtgagacaattagagggaggggacagacaatatagtctggaataagaacttttgaagcgaaacatactttctaattattatcggctatcgctggtattggacttgttatgccctttcatgcgcatatgctgctcgttttctaattattgatggcagttgagttagtttcccacttttctcaacttctaatcgctcgttttccacacgcacacttttcaaactgctaaacagtgtgtttttgaaaaaaaaacatatatatcgattttcaactttttttttaaataatacttaattaatcatgctctaatgagtagcccagttttccatgcaggagggataagttctcaacctgtattaacgaacacagccttagtgatatataacactgatactgatgtacatcccttaattagcatggatggctggcttaaatttcattatttggtcaatacgactgaacttaatgagtttgtaaggttgagttttgtgataaacgattatcacatgtatttcttaaatacaacaggcaaccttgagagagaattcggcagagctagagcgcacaaaaaaacttctttctgagaaggattctgtaataagaaatttggaggaaaagcttgctggatgtcagtctgaattggatgctagggaaaagaagctgaatgatgttgaggtctgatataatttccagtaacattctcctggccatttttactttagttgtattagtaatgcctttccttttgcaggctagccttaaatctgaaattgacagacataggaagattaatatcaacataaaggttaggatctttcccttgttcttctattgcaagatcgaaagttcattgctgttttcatgtgcttatatcatcctattaaataatgtagaggaagcttgatgcatcagcaaaagagaaggaggaactgacgaaagaaaaacaaagcctttcaaagcaattggaagatctcaaatcaagtacttaattaatcttattactttcacacaaccacctgaattatatattttgtatgatcactcatgttttaaatttgatatactttagcaggtcagaaaactacaacagaaaattcaaatgaacaggccatcaaagaaaaggacttcaggatacaggtcaggaggttgtgatttttatgaacatgaactccttcaggtttcttacataaacatatattaacagacattggaaaaagtcttggagaaagagagagatgataataagaaagaaaaagcattccgcagaaggaatgagaaagtatttactaccgccattcaaaatatgaatcaggtatttcttcctcaactagcctgagtacagtcttgtcttaaaaatttttttgtttatcgtcagttgggtttagattgagcaccaaatttatcatggaactactgatttaatacagattgtcacaaagctacacattaagtagcaaatttgtcacaaagctactggtttattgccaatttaatcccaaaactacaacgtctatatcttcaacataactgtagtgctagggattgaaaatctaaaatctgtagtttttttataacttgagcaataaatctgtagttttgtgatacttctccctaaatctgtacctgatagctttgggggagtggattctaatcccttgaggggatgtcccgtcgtgtacctttttctttcaaattcgatacaaatagttgtaaaaatttatgaaaaaaattcgacctactatttatatctctcgacgtgtgcgttgcgtttggacctaagattttatggagttgtatacttatgttgtatgagtgttgtcgatcttttccagaatttttcataaccatttggatggtttttaagcaaacaaggggacatccctcgagggatcaaaatagtttccctagttttggcactaaatgtatagttttgtgatttgtcttaaatccgtagtttgtgaaattttctccttttttttaaccgatgcagtagattttctaataagaaaagccaaggaagtagacattaagataatgaaagattgatatgttgacatgttcacagatgaacttagaaaaatgaaaaacttaatgtgttctgggatatacaagatgaaacttttaagtaggatgttttagtgtattctagagttggaaagttggcatcattatgaatgttctaaagaataagtgccattttaaaccttaccaaaaaattggcaagccaaattttggtaaagtttgagtgtttggtttataaccaagtttttgtcaatgttgcttgtgatgtattgattgtttttgccaaaatattggcaacacaaaatctatggcaacaaaccaaacacacacattttcttgcccttgccaatttttttgtatagtttgtttgggctataaaccaaatgctaagtgttcatgtccattgccaaaccaaccctgagtattaagcctatcattatgatctacacttttcgttacattttcttctattgaatgatttcttagaatatgaaatttcactgtttaaagcttgcaaatgtagcatcatttgagtttgctaatggttaatgtttagcatgatcacaggcaattatagtacactatagtaaattattgtctggggtttgcttattggcttttcaggccatgtcccattcctgtgatagcccttaatgatcagttagcatgcattgcagcttgctccaacctgtttccttagtatttactcgtatttgttacctaatgatacatgatgtgtacctattaaaaatgcaacataacaacttcatagttgcttgtttctccaataattaatctgtcctgcctggttagtgtgtggtatatgcgcaccctctaatccacttgttgctttcgaaaattaattgcaggaaaggaaacaagtagaggaatcaattgagaagcataggcaggctgtgaaagaggtgattgaggtacagtttatctgctcccatagatttcatgtttcattattgctgctgcaaatgaaagttcctagtatattttatttagagctttgctacagctgatgtgcgttctctgcagcattatactggaatatcctctcaaatcccatctggatctgcaatcgatgagcagctgcgttcatatttccttgccatcaaagctgttgaggagtctccgagtcccttccaagatggtgcagcaagccagacaccatctgttgaaagtgccgatgtggatgcatctgcagctactgcaggttcctttctgttcaatttttcattccacgctgctagtgtatatttaatgatctctattagttaatcatagtatctgttaatgacatgtgatacttactagttcagaaattatattagatctgatctattacatgtactcttgaactcgatgtgaatttggttttgaatgatttggcatgtcagatattgttcggacttcggaatgtgatatgatattggatttctaatgcatcattttcttgcattggttccatcgcgtggatctgaataatgtgtttttcctttgctttaccgtcacttgatcaatatggtagttcataaggctgctgcttttttttttttctaatctcagggagacaggtagctactccaccaaggcctgctcaagttaaagtggtggaggagagagcagtttctactttgcccaaaccaagcactgaagtacgtagaccaggaggaaggagaccacttgttcgaccttcacttgaacgagttgaagaaccccaagctgatattgatacaacagtagttgaaggttccacagagaaaggcggcttgttgatggagcgtgaaactcctggtggtgtatctgcgttacagccatcaagtcgtaaacgtctaattccatcaccacaaacgagagatgatgcttcacaaggagagacaacggatgccaatccaccactgaagaaacccaaagaaggatcttcacaatgtactagtgagctaaaaactgaacagtcacctcatgaagatgtcatggcacctgttcctgtgctaccatctacagagttagatgagcaacagcctggagaagagatggacaccgatcagtcttccttgccagttgaagaggttgaggaaacaagggaggatgacttgggtgataaggatgacatggaaacacatatagacgcttcaatggacatccaaggacaagatgcagaaactggtattgataatgatgcaactactgtggaagatgtgccagtcaagtcagaagcggttatggaatcactggaggaagacctgaaaactgaggatgggaaggaagagggtcagtttactgcaaccactgatgttgaagatgagagggaggagggagagttgccagatgaaccagaacaaccagacagcactccccctgtgctggatgttggtgagcaagccggtgattctttcagggcggcatctccagcaggaccaactgaaaagagtgatgttgacatgccagaagaaactggagaaggtgatggtaccatggaatcagaccaaagccctgtaccacaatctggtggagcagatgcgtcaccgagccaaatggctgatgcgtcaccaagccctgcacgtgaaccttctcctaacccagtccaagctggtgcacctcctgaacagcagaatcccacccctcctaacccagtccaagctggtgcatcttctgaacagcagaatcccgccactgcagcagaaggtgttgaaactcgtagtaccagaacaatcaacctaactgagagagcgaggcaaaaccggcaagccaggattcttcgctcagccactcaacagaatgcaaggggccgtggcaaccagtctcttacatacagggtatggttttatactacaagactactgagtttatttctgttgtgttctatttttgttatatccagtgttaattctgatggagaacaatgttttctatgtgcagaaagatggcggccgaggaacacggggtcgtggtgggcgtggtcagtcgtagagaatttaggtttgtctttgctcaagcgcggagactagttttttgcaaaggacatactgaatcagggcggcatcatattcattttgtagcactatcagaattgcgagcgtacatgttactctgcttagacaaattcatgtggctaagcagcgcttattaaaatgttctcattgcccgtgcggattgccagatgacctatatttaaattgaactctagttgacaaagatgatataagcattcgtagcgcgtaagc

SEQ ID NO: 26 - protein, 677 aa, Oryza sativa
MKDELQNIKATLRENSAELERTKKLLSEKDSVIRNLEEKLAGCQSELDAREKKLNDVEASLKSEIDRHRKININIKRKLDASAKEKEELTKEKQSLSKQLEDLKSTGQKTTTENSNEQAIKEKDFRIQTLEKVLEKERDDNKKEKAFRRRNEKVFTTAIQNMNQERKQVEESIEKHRQAVKEVIEHYTGISSQIPSGSAIDEQLRSYFLAIKAVEESPSPFQDGAASQTPSVESADVDASAATAGRQVATPPRPAQVKVVEERAVSTLPKPSTEVRRPGGRRPLVRPSLERVEEPQADIDTTVVEGSTEKGGLLMERETPGGVSALQPSSRKRLIPSPQTRDDASQGETTDANPPLKKPKEGSSQCTSELKTEQSPHEDVMAPVPVLPSTELDEQQPGEEMDTDQSSLPVEEVEETREDDLGDKDDMETHIDASMDIQGQDAETGIDNDATTVEDVPVKSEAVMESLEEDLKTEDGKEEGQFTATTDVEDEREEGELPDEPEQPDSTPPVLDVGEQAGDSFRAASPAGPTEKSDVDMPEETGEGDGTMESDQSPVPQSGGADASPSQMADASPSPAREPSPNPVQAGAPPEQQNPTPPNPVQAGASSEQQNPATAAEGVETRSTRTINLTERARQNRQARILRSATQQNARGRGNQSLTYRKDGGRGTRGRGGRGQS

SEQ ID NO: 27 - DNA, 10365 bp, Oryza sativa
gtttgcgtttcctccgcctcctcactccaattccattcgccttccgccaccaccacccttggctcctcccctccccgcggggcgcgcgacaaaccctagaaccttctagaggctagagcggtagagccatccgcgagggccccgggcgggctaggggcgccgcctacccgaccccgcacgcggcggcgatgccgctcttcatgtcggaggaggagctgcggctcttgggcggtgacgtggccgccgtcgccgagcgggccgacgccgccatccgcgagctccggcagcaggtggacaccgtccgtgccgaggccgacgcggcggccatcgcggcggagcagacgtgcgccctcctcgagcagcgctacgacactctctccgccgaggccgatcgcttccgggccgagctagccgagctcgcggctgcctccgagcgccgcgccgccgatctcgcctcttcccagtccgagatacaccagctccgcatccaagccgtacgaaccctagtttttatttgggttcagctcagtttttcggcttagctgaggtcacactgatcactctgtgctgctgatggggtttgcagattgcgaaggatggcgagattgaacggctgaaagtagaaatctcggaggtgcacaagtccaagtcgcagtcactggaactaattgagcagagggatgcagagataagggagaaggatggcatcatccagaactacctcgataaaatagtaagccatcctgaccattttgtactcccacttctagtgatgcacagcatccagcaaaattggaactccatatctaaggtgatgtgcgaatataggatcatatggataagttgttatccagtgcaatgcctaggttgctactgtcgacaaacagaggacgggggttttatgatgttctaagacttgaagtagctttccttttaaccctagtcagagggtaggtcagttgcttgataggttttacaacagaaattttgtggcttcaataggccacaaaatttgttttcctcattttgcatgttacttggcagaagttgagttgcatgtgtatgagacacaactgcattttgtatgagttgttacccgaacgtcagacatgattttaactcgatttacctgtagttttacgtctgtctccatacttttttattttacatgtagtagcaagttgaatttttattttatttatgcatcagaggtcatccttatcggatacttcaaatgaaaaatacacatttaaattatttttcgtaatatcagttactggcattctatttcagttctttgggcattgcttagttgatatgccgtttcaataaataaaacgtaccatatgaattataatgactttgcaattttaaataagttgttgctttgttgtagtgttctgatcgtataactttacatgctactttttttttgtgcctatcatgaacattcatatcagtctagactgtttaagatactcaattgtgtatcgtaccttacatgttatgtatcattccttgcatgttgcgatcaacttttgagtgtcggacttattgtatgtaagatatctgcgatactgttagatctcattgcctagtttggagtattggagatttccccgattcgatgtaggaatattcatttatttccgtaaaattcatttgttccaattggacccatactttttcttaaaatttactctgtagtttttctgttggataattttgaccttattaatgtgtcactattgaaccttctgtataatcaaggaattcatgtgatttggtatgcttatattcaatatcattttattagcaatcgcaagcgctaggccttattcactctagttggtaagtcctttagtttttcgcatttttgagatatctatgccctttcatcctgggaactgggaagattttgttttgcattttgttgcataaattaactgtagttgttgaatcggtcttcctgtcaggtaaatctggcagactcttctgctagtaaaggggcaaggatacaagaagttgaagctaagtttactcatctgcaggccacatgtaaccgaattacgcaggtatgctataaacaatttggtgttattttgctgcgtaagattgtagtataaggtgatgcaaagtctttcttgagttgtagactactacctaatctgttatccatggagttttactttaattgtacctattccatatgtttgcacagagcaaccgttggttcttatttagtactttcctgtttaggagaaagatctgcttgaaaagcataatctctggcttgacgaggaacttaaagaaaaagtgaagaacttagctgaactaaggaaatcaaacatggatgaggaggctaggatgtcagcaaaggttgccgaggtgagtcctattccaaccttgacatgtgacataatgcaagcagaaagcaaaacctgattatgttggtttcagcttgaaagagagacttctgaatcatccagttccttgaggcgaagcaaagaacgggtttctgaattggagcaaagggtatcatatatggaaaaggtaaattgtcagatttgttagcttttgtattattgccatcatctaatttttgctttgctttgcttttatgatctaaaggagttgtgctcaacaaaggatgctgcagctgctaatgaacaacgcctggctgcagagctttcaactgtatggtttacctttattcccattaacccccccttgtttatttcacccttactgctcccactccctgcttgtttaaattttagaaaggaaatggaagaaaatgtgtgctgagctatttgtactagaccagcagatcagtccatcgttattgtatatgcacacggcacaccacaacttaacccatctagtgtatctaggatatttctttttttttaatggaatgcactgatgttcctctctataagccaagtcgatgacgcttttaattattgccttttgttctgtttcccttaaaaggtcatgaaacttgctgaacttcacaaagaaagttctgaggaatggtcaaaaaaagcgggggaacttgaaggtgttattaaagcattggaggtaatgcctttacttgtatttaattttgccccgctcatgaacatgaaaatctaattattcttattatttttttcggtgtaaaccagacacatttgacccaggttgaagatgaatacaaggaaaagcttgagaaggagacttcagccaagagggaccttgaaatggtatattgattattattttggatggttttcttattgaaaaatcagtttgatattgtgagtttcttagttgatcttttggctttcatgctattcaggaagctacctacttaaagcaaaagcttgaaaagtgtgaatctgatctggagaatacaaggaaatctagtgaattgagcttcactccattggttgcagcagacccttgtgatctagcaggctcaccgatgaaagaaatgtattatttctgaaactttatacttttagtctagcgagatatctaaagcaggcgctattagcatagctaagtaacactttctagagagcattgttcaaggctttttgatattaattgtgttttgctcattaaagcttatcttattgaatgatgttaacttctgtttgtgctgtaccgttgtaaacatgatattatctttgtcccaacaccaatagttcccaaacattttgtagtcattccttattgtgttgataagtcactgatcatatctagctggtgctagggaaaaccatgatatgcaatgttttacaaatcataacagaaacacaggaaggagtatgatccaattattaaacaagaccttaattttcatctattttgaaattctttttgtttcctatttggcagggcattttctgatccagcaaatcagaatgatctaatgattgtaccaaaagtacctactggtgtttctggaactgcattagctgcttctcttcttcgtgatggttggagtgtatgtccaatctcctctatactgtttaatctgtgcatttacgtttcaaatattacctgattaccttcactgtgtcagctcgctaagatctatgagaaataccaagaagctactgatgctttgcgccatgagaggtttggacgaaggcacgcggaagcagttctggagagggtacagttctgttctcgtcagtttatctcttaatttgtattaatctctactctctttcccatgatcccatcatttccactttcctaatagatgttttagacatcaaaagtcaaaacagctttaaatacaaactttcaaccgtgccatattctatctatgtaaccacatggaagtagtccctcctctgagaaggttgaaatgcagatttgctaagttttgattacaaactcaccataatatggatagtcaaaatttcaaataatcggattatacgcattctaaaatgacatttttttgagatggagggagtacatcaattttcgcagatttacatttatttgagatggagggtgaacattaattttcactgatattctccaaggtttcaaatttatgattaatagttgatggtgtgagaagtgtttgtaaagtgcatgaagtaaacgcacatgtagtcctgtatcatattttgtgctaaatgggtaatcgtacttgtgcagggatgctctgttgcttttctcattgattcatttctgaagtgtcctattcctgttggattactgaattatcttttgttcaacaggtcttgcatgaaattgaagagaaagctgagcttatcttggatgaacgaggtaatgtgaaatgcatacattgcttcattgcctgatagtacactgattatgcttaagtttggacatgtatgcaattattttgtgctcaagcatatctttgcatttgaccctttcagctgagcataggaggatggttgaagcttatgctctaatggatcagaagttgcaacaagcattgctggagcatgacaattttgaaaataccattaggaatctaaaggtgcgtacatcaattttctgttaagtatagtagtctcccatagtgaagttttaacaataatcttgtttttgcagtcagagttaaaaaggcgggaacgtgatcatagtattgctcagaaagaaatagatgatctgcaaaaacaagtgagtctttaagcatgacatctgcattttgttctttttgattgattcacagattaaattgtctatgtaaggaaaatagaaatgttaacctcttgcctactctctagatatttaagatctggtgcaacttgatgtgatactagttctcaccaacatcttttcaaggatgctattctaaaaggggtggagtccatttttggcacctaaatatttcttggactctaaatttacgctgaactaaaagatcggttttagttcaccttcaacttttatttataaaaccagacaagtaacacctcatacctgattccatggtggtttagttgagatgacatggttttcactgatgattagcttctattagctgagattaattgatgtttaaccagctatttgacattcgcaccaacacaagcttgcatattaggagtctgcactagcaaaaactattatgatatcaatggaaaccactgtggagcagtgttgaaggtattaatagtatttgtatggttttgaaagtcaaagggtggaaaacactagcttttcaatttgaagttaaaatggacctagaaaagagtccaagagccaaaaatagactatgccctttgaaaatatgtcgatgcttgtggtcctcacctgttcaaatataatttgaaggtggatattcattcttgcatgtcactactgacaagaacattgaatcaacatttcttttgtggtactgcagatgcttttgctaactatatgctgtgtctgccctctaaatatttgcagatagctgtccttttaaaggagtgccaagatatacagcttcgttgtggttctagccttccaaatgtaggagatggtgctctttctacaagcacaagcactggagtgcctgaagttgaaaacaatatccatgagcatgtgagtatgctagtccgttgtattctctttcagtttcactgtgttggtgcttgctttaactgttcgatactgtgtttcagatgacattcaatgatatcaatgggttagtacagcaaaatgtgcaactccggaatcaagttcatttgctctctgctgatcttgataaaagggacatggaactcagggtatatataaagtttgactttgttttttctatagtttcaaatgttttagtttgttcatacatcagtgtcagggcatacttttgtatccaatgacatgagtacgtgatgaaaaatatctcgtttctgtactttccaggagagcttccaaattgagttgaagaagattacagatgatgctgcgtccagggttgagaaagtgatgaaaaaatccgaagaacaagcaataatgattgaatcccttcacagatctgtatgtttttgtattctccttgccacgaagttggaaatcttcgttttgaaaccctgtctgcaaaatttcaattgcatgctgtatgtgataccagtcctaaaatagttctcttttttgtaggtagcgatgtataggaagctgtgtgaagaacaacagaagtcacgttccaatgttgaacacatacccaaaaatttggaaggtttgtccttctgatgttttcagttcaggcaaaatggttaaatgtctaaccatgatggtttcaactgcatgttactgctataagaaataacctacatgtgatggttttattttgttctctagatgatggcagaaaagacctgatggttctatttgaaggatcacaggtaatttttttgatgatggaaggcttattgaggctttagaataccatagatgttgtggtgtcttttttcaaatttcaatctattttgaccaggaggtttcaaggaaagcttatgagcaagtttcagagcgtgccaaaagccttgatgaagagctgactaagttgaggtggtgttttcctccccttttaaatcttattggcatgatagaataacagctacgggaagaagtcatttgaataattttcattccgatgtatcattggacaagatgaatactgattacgaagcaatgtaacaacatccctttgctaaaaaaaaagtaatatgaacgactaaggccctgtttgtttcagcttaaaattattataatctagattattaagacatattactataggctggattataataagccgacatagaataagttgttagttgtttgttgctctagattattagctggttgttaggtgttagcaacccaataatctaaaaaaagcacctttagagtggattactagattatagtaatctggcttatagattgtaataatctatcataataagctatctgtttgtttcaacttactcctaatagtccagattataataatcctaagctgaaacaaacagggcctaaagcattaaggttaactttctatggtcttttcaaactatagaagtttatgtcatgaaaaataatttgcaagcaatccaacgtacttattttacgtagttagtccatatacttttgcaatatgaacgactaaagcgttaaggttaactttctatggtgagctacacttggaaatgcacagatcctatgctggcctacatatgtagacaaagggagtactggagtactatgaaacggatatcttgaaatgttgttagtgcccagctctgttgaggtcgtgtcgttataactaagcatgctgacggaagtgtgaatgtagcactccctccatctgaaaatataacaccttttagcattcaaactttccccacaatataataacttcacctattcactcatctcaaccaatcacaacaatctctcgggtaaatctaatgggcgggtgatcgctgggagcgatcaacccgcccctcccccctatacgctcttcctctcccccttcctcctccccttcttctcttcctactacagtacaccataaattttttaaaaaataaaaaaacaaagttggaaaaatttatgtatagaaatactatatataaaaaacatttgaattcaaattcaaattgaaacgggtatgtaaacttttgacttaaaactttaggtgtataaactttagatgtgtaaacttgaggtgtacaaactttaggtgcataaatttactaaaataggaaagtaatgcggtgccaaaaaaggaaaccacgtggagggagggggggatccgaatcctgatcgctaggggcgcttagcaatctcgcaatctcccacttaatttctcgacctactttctcatctcaactaataacaattttccccatttaatttctcctgctttcttaataccttgtacaactctagaaatccttatattttgtgatggagggagtagtatatagacgcacatctaagttatctgtgtcacggttggtttttaacttaccatgtatctgtgctgttaagggttccatttcttgttggttcttcatttttacatgattttggatggccctacttattgtggtatttggactgttgttgattatgttatattatatttgatcttgcatagaatttctgatcaatactgattactattcattaggactgagcttctatctttgcgttctgagcgtgataaggcggttcttgaagcagaatttgctcgagaacgacttaatggatttacagcagagcttgaacaccaggttctttctttgatgtgttatatcatgatttgttaatatttatgtttgttacactgaaatggacataataatgtccataacagtcttttggaagaagatagcatttattacatgctgtatccttatttactttgtacatgtaaaaaacagaggaaggaagctaattctatttcgctaagaaatgcggaattgatgcatttagtagttgattacgaaaaaagattgcgtgagaactcagaatctatgaaggctgtagaggagaactcacggaagctattaatggaggtttgttgatatttttacattcctcaaataatattaagacccagagtcctgacatgatttccatttctctagatgtctattctaaagaatgaaaaagagatcttagcaaagtcagagaaaaaagctttggaggaagttcatgatttgaccacgagggtgcatcgcctgcaggtatttcccttgctgccatatcttttcattactttggagtttcaatattgtcttgtaccccctccatccaataaaaaaagcgtgtccatgatcgtagctagggttggtctttttttgggacggagtagtatgtattgcagtttctgttagtttgttatgtttccaaaacagttgtaaaactgttatcgtcaattatattctatacttatgaatatatactccttctgtcccaaaaagaattaatttctaggtaagaatctgggcatagactatatgtccagattcatagtcagaaattggttcttgttgggacagagggagtatattattgttatgctctttttgaaaggataatttagtacttttcgtagctctgccctatatttctcatgacaaatttggagctgtcagtttcgcacaactgtatggtctactcaagcatgaacaagcaagatcttttagctatttgtgtttttaatttgcgatctcaaataagttaaatgttcgtgaaacaaataaaacatgtcaattactttgtcttgaggcttttataaacttgcactgacttgtatatatgatgcattgcaggcgaccattgacacaatacatgccaccgaggaggttcaagaggtacaatatgtctagatgagtcacattaatacttgaaattcttctctgtctatctcttaatctgtgaataatttagaatgcaaggtctattgaaaggagaaatcaagaggagtacatcaagagactagaagtaagactcctatttggcatcacatatgctttagtattttgtgcttatgtagcttcgtcattgcctctcctctcacattcaagctgttcttagctttaaaatgtaatttcctgtactgataccttgaacattgagaatactactgtgactctgtgagatttgttctctttctgcatgctcattgtggggatatattgctccatgtattccttctgtatcttatcttggttgagcttattctaatttgaaatgcatccatagagggactgggctgaagtgaaaaaagagcttcaagagcaaagggatcatgtccgcgtcctgacgcttgataagaaaaatgcctttgacggatgtctgaagcaggtagaggatatg

SEQ ID NO: 28 - protein, 501 aa, Oryza sativa
MPLFMSEEELRLLGGDVAAVAERADAAIRELRQQVDTVRAEADAAAIAAEQTCALLEQRYDTLSAEADRFRAELAELAAASERRAADLASSQSEIHQLRIQAIAKDGEIERLKVEISEVHKSKSQSLELIEQRDAEIREKDGIIQNYLDKIVNLADSSASKGARIQEVEAKFTHLQATCNRITQEKDLLEKHNLWLDEELKEKVKNLAELRKSNMDEEARMSAKVAELERETSESSSSLRRSKERVSELEQRVSYMEKELCSTKDAAAANEQRLAAELSTVMKLAELHKESSEEWSKKAGELEGVIKALETHLTQVEDEYKEKLEKETSAKRDLEMEATYLKQKLEKCESDLENTRKSSELSFTPLVAADPCDLAGSPMKEMAFSDPANQNDLMIVPKVPTGVSGTALAASLLRDGWSLAKIYEKYQEATDALRHERFGRRHAEAVLERVLHEIEEKAELILDERAEHRRMVEAYALMDQKLQQALLEHDNFENTIRNLKS

SEQ ID NO: 29 - DNA, 9 bp, Artificial sequence
  potential SPL3/SPL14 transcription factor binding motif nucleic acid sequence
  misc_feature (2)..(2): n is a, c, g, or t
tncgtacaa

SEQ ID NO: 30 - DNA, 35937250 bp, Oryza sativa (residues 1-2,113,956 of 35,937,250)
  misc_feature (5969519)..(5970518): n is a, c, g, or t
  misc_feature (13681864)..(13682863): n is a, c, g, or t
  misc_feature (13684155)..(13684254): n is a, c, g, or t
  misc_feature (18795366)..(18796365): n is a, c, g, or t
  misc_feature (24815509)..(24816508): n is a, c, g, or t
  misc_feature (35936251)..(35937250): n is a, c, g, or t
accctaaaccctaaaccctaaaccctaaaccctaaaccctaaccctaaacccctaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaaccctaaaccctaaaccctaaaccctaaaccctaaaccctaaaccctaaaccctaaaccctaaccctaaaccctaaaccctaaaccctaaaccctaaaccctaaaccctaaaccctaaaccctaaccctaaaccctaaaccctaaaccctaaaccctaaccccaaccttaatgaagcaatgcacttgtcttggctcaatcaaccctcccgacaccaacaatggatgaacaaaagctcaagtggtgtgagagtggatgcaaggggtgtatgcaagtgaagcaagtgccaagagggtccccttcctactcgttggggagtatttatacccccacccaccaaaactagtcgttggggtcgaaatcgccaaccttagttgccgcctgccagtcagatcacccaaggctagaaactagcctttactgtgcacttaatgcacgggcagcagctagccagtcagatcgccatcggctccagtcaagccgtcggcggcccggtcagaccggcgtcggctctagcggctctagatcgtcaagccaagacacacatcccggctcaccaaccgcccggtcagaccagccaagaaatgccagtcaggccggcatgaagccctcggtcagaccggcctcaagcagaaaatgatgtatgaaatgaactcgaacgaagtgacaatgcaagtgacctaatgtggcattttgatcaactctttacctaggtcattacctctcttgatagtacggcaaagctagaaataaacctagcaaaatttgatcacctaacacttcaatcaatttaaaacaaaacgctagatttaccatctttgttccattgctttgtgccattaattttaatccgcggtgatcatccatggcatgtacatcatgtggtcctaactcaaatatatcgcttaaatagaatagttagtccacaattagagcttgtcattaactaccaaaattaacaacgggggctatgatgcttcaatgtgctatatataatatgactgtagtacattgaatattttatttcattgcactcaaatataatcaatgttggcctattttacaaatttattattctggcatatcactacaagatctaagtaatactgacattttgatccatgtctgctttgcagacaatttttgtaaattggtatgatctaagaaattaattatacttgacctcagggtctaaagaaattaagccttaacaacattgtgaaatgcagtgagactgaatcttggagataaattaccgaagaactgaacttttattgtgagtataatttacttttgatcttttaacaaataaggatattgtttgttagtggttctagatttggttaccctggccttttctcatgagcgcaattagggccgaacttttgtgtggccttgtcagagtgataaaaaaaacataggcagtgcatcacttatctgaaaaattggttctgaattttccttctctatatccctcaggaatgatactaaaatctgatttgtgtactgacttatttcagtcatttgaatttgctatgtcaatacagtccatttttaataaaatctggaatacattttgaggttaagataatccagttgtttatagactcaaaaacagtatatgtgctctagaaacatcgaaactattttatcatatcaaaacacatatgttcgtatggtataatttttaactctccaaaatttaccatctttaattataatttaaattgcatccacatgtttaataaaaatatttgagcatccattttgctattttgcacacttgcagttaagttctgagatatataatgatatttggctgacatgctcattggacctttttccttaagctatacttctgtgtcttttaactgaagttgctttctgtttcgtaagatcagccctccagcaagtggaggtaatccagtaggagtcctccatttctctatatatctctttgattgctttaaaaccgaacaaaaaggtttaaagaaagcaaaagaagcaaatgtgtccatttatctttcgaaacaatatacttctttcttggtgcatggagggccagacaaccagatagagaaatggagactctatcagagttgtatgttcagcaaagatgaggtggctgattaagagttgtctaattacaaccagtgcattgttgacaatcttgatttttttttaatccttttgtgcatctggggcaaagttatttggtaaatttgaatatgattttagaatttggtgaagatatctgatttttaactgatttcggatgctacatgcaatgcattgtgcttctgtaatatcaaaattcacgattgtatatttttattttggtgatatatatgccctcaatagacttaaactttgacatgttgatcactccgtaataattgtgtgccattctatttcttttatattatgtttttccaccgttcatgttactaatatgtgaaaaccatagaaatggaatatagctattgtctgtgttaacaatgatgtttatgtttgcaacgggggttcattttttatcatcccacccattaagatttaaagttgctctaattatttccaattgcaacgcatgggcacccagctagtaattatgaaagcaagagacaagtgctaaaggatatttgaaaactaaaactggctcattcacagctggcagcaccactggaaattcaagcaaggacaaacaacaatacagacacatgaagatagaagatagaaaatagaaaataagcgttcagagcaggaagttcccaccaacatcgctcctctatcctgtacaaaacaaaacaaggatagccggccaaatataaaactagccggctacacttcacaaaatcacaaccaaaaaaggcactataaacatagctaccatcatccatccaggacgacagaatgcgtctgctttggcatagctaacttcaagtcgctatataccataacaattcctcctaaaggagatagataagggagagcaaggaggaagaagcgaagagcgaagaagagaggatgacatgtgggcctaacatgtcagtgggtcccatattttgtgtgaatgatagataggttccacacgtattttttaattctaacgccacgaagcgtcacgtcagcaaaaccatcctccaaaaccatggagggagttaaattacaccgactccaaaaccatggaggaagtcaaattacaccgattttaatagttagagaatcgagatgtccgttattgtagtttagggatacgaatcaaattcggtcctgctagttgggccaaatgggcctcacaacaccatgcaatctagtctagaccatctcaaatcgatcgttttgcctttttactgagattatgccctgatatgggacaaccagtagtccagtacaatcaacaaatatcgaagttgtttcaaaaagaaaaaaaacaaatatcgaagccgtttcgtttgcttttattccattcgattcgattcaattcgttcatctcaacatgcacatcgtccaagctaactccttaccggaatactctctatagaaagtagaaaccaactttggattcctttctgctgcccctcaggccctcgcatacataaaaagaaacagccttttctagagagcgtcgttgccttgttcaaaggttgcaccaatgccgctctacaagactacaactcatccttgaaatttgtaccggaactcctctcccccctcaaattagttgaagctgtgctctgatccttctctgttttcgttgctgacgaatccggccgcttcagtttgaaagggatgctagcgtgcttcttgataaacttgtacatctccaccaccgtacggtccccctcaaaagtaatctgcacacaataacgcacagccaaattaaataaggccctgtttggttcccacacaaaaattttacaccctatcacatcgaacgtttgaacaactacataaaatattaaatatagactaaaaaaataactaattgcatagattgtgactaatttgcgagatggatttttaagcctaattgccccatgatttgacaatgtggtgctacagtaaacatttactaatgatagattaattaggcttaataaattcatctcgtggtttactgacggattctgtaattagtttttttattagtgcgcaaacaccctatgcgacaccctatatacccgatgtgacacgccaaaactttacacccctagatctaaacactccctaaattagacttctggtaaatactgttatatacggaccctttcaggatctcaaaatctcataaacataacttgtcagatatacgcctaacgtatcttgaattccgacctcaacaaatgttgttttaagggaaagacctcaacaaatgttatagcgcagaatgacttcaatgccataggtgcagccgtgcaggttggatttttttttagcaagaaaccaaggacacgcatgcagtttgaatagtgcggtaacatatagtagagaggtgattcaagatttctacagagagagagagacagatatatttcggttttagcagattataagaaatctaggcaattctaccgaagagagaggtaacaaacctactgagagacagattacatacagtaacaaatgcacccctcaataagacatgacacatatttgggcacttacaggctcaaaacttttctttcctgctggataaaagaggatcgttgggaatccatcaggctgtgacaagaagcaagtgttaattctgtaatatggaaagtttacaacataataaaatggaaaaataaacaagactaagcatgcatgcatgcatgcattgaaaatttaaggaagataatcacataaaagaatagtactagcaaactatgagccaatcttgaaggttcagattgcatggagattggaggggaaatgaattgttccaactacaagtcaaatttcacatgctacagtggtcactactgcctcaaaatactgtaccactgatgcatactcgtgagatcgtagtgcgtgaatacatatacatggatgagaagtaaatcaacattgaaatgtatgtagtattagatgatggatggatatgtaccttttttgtgcagtgtgcaaaagtgcgatttcgaataacaaagcagttgagcaaccctcacatttttcataactagcggtgtttcatatcatacatgcacaagatcttttggccacaatagcacaggaaattaaactcttcatttcgtgcctccaaattttactttctaatatccagttcaaagaaaagtgaagtgaaactgccaaaaccaacaggaagcagaacagacctttgcacgtggatgctcattggcagtgccatccattttagctattacaagggagtcaatgccacggagatgctttcctagcttgttgtaggtaggctccagttcctgacaatgcccacaccatggtgcatatatctgcaacaacagcaacaacgattatggaccacatataaataccatttttctcataatttaccttccaggaagaacatacctccaaaagggcatcttttgattcatccaaaacaatctgatctaggttttttccaacaacaattttgacatctccttcattctgtatgggaacacagaatgtctcattatggtacaataagtggagaaagaacccatcatataattatagactcacagattcaggtacaggttcagacttgtagaacggtgtgagcttttcctctaagaaatcctcagcaaatctctgcatgtaaaaaggataaaaacaataaaggtgtccaataaccaagccttcaaggaataagaaaaattcttggagaatgatagtcgactccttcctcactagcagtggcagaactcaatatcaacagtgtccaagaaaagtaataagtaccctagttaaaaggacaacttctacaccaaacggcatggtgcataaattgcaaaaagatgcacattgcatttgttcactacaaaatgcaatattaattgataatgcacaaaccacaaatacatgcaagattctcaggttaaattaatacagtacaaatagaaaatgcatttgccaaaaaaactcaaatgattggtgattacatgctagcttgaaacttggtaacataatgaacaatttgttcgaactacttgagcacactcctatgctatttttacatctaataaggcactgtgcatgggcctgtgtcaacaattaccttaatattctctaccgatatttcaccatcaaggaaaaaattcctagcatcttcattcccagtgtaagcaagaacctacagtcatagggacaaacaaaaaaataacacaaacacattaaatggaggctaaattgcagcatccaatttcgatgcaagaaacaacagtacagataaaggtaacaaagaacacaagtcattactgtggtctcttgtccagtaataccaaagtagttggcaactggttcacctacttcctcattgtcacgctccacaaagacaaacaaaagctgcattttggccacacacctcatcagtggtaaacgaacacatcagtaaataaatagaatgggaaagtgataagtggtgttgcatagcaccaaatttgagtaaagcatgtgaagcaacggaagtaagtttgctgataacttgacggatcaaaagaaaaaaaaactaccttccccttgaatgattttgatgcttccttaaagatgggcagaaatttcgacgattcgtttgcaacaacaaatagtaaaatctggtttgaaaaataaaagttagcagcccagtaatgtataaatggaccaaaaaagtgagaaatgtacagaagcaatatcaattagacatgcctgcttcttgattggattgtcaaaaatggaaggagcagtttcctgtgtgagggtgttgaccaacggaagcttgtttgcagatacaaaatcggcaattgcagatgctttgaatggcccatctgcatgataggtggagtatattatccaacaaccaagccccgcatggaaaatagaaatgaggggattgatgcttaaagtgacttagagagaagggtaccatagaaggtcaacttctcctcctcttgtttcttgagcaggactaaggacgggcgcttggccgctgggtcaaggtgaaaaagcttggcaacatcaggattggaagtctggtaaaagttgatagcatcttccagcctcgaagcagcagcaatctcatcactgtgagcaccctgtaagtagtagggtttgaaaagaagattaataataatagtgtgtgtgcagtaagaatttagaaagagcatcggggttgacttgagtagaagagaagagaaggtaccgatagggagtcgaggacggcaagaatggccttgtcctccccggtgagtatcttctccgcctcgtcgacggtggtgatgttttgcaccccgggagctagcttcttgttgacccacgacacgatggcttccctggagccaaggcaagagacaagtcaaagaaattgaagccaagagacgagatgagatgggatctggggggaggggggacacgcacttggttcttgcgccgttgtagtccttgggaacgccgtcgatgaagaagaggatggtggggaagccctggacgtcgtacttctgggcgagatcagtgtcctcggtggcgtcgaccttggcgagggcgacttgatgggcaagaggggagaggtcggcggcggcggcggcgtagtctggggcgagcgcctggcaatgggcgcaccagggggcgtagaactcgaccatgacatggcggtgggaggcgaggaagtcggagaagttggcggcggagaggaggaagacgtgggtctcatctatgggatggtcctgggcctggccatggtggaagaggtcgtcgtcgtcgtcgtcgtcgggggagccctcctggagccagccgtcggggtcgttggcggggatgtcgtcggcgttgtcgatgaggtagtcgaggtcgtcgtcggaggcggaggcggaggcgtggagaagaagggtggcgagggcgacgaggaggagagatcgggagcgcatcgttgcttcctccgttgctcactgagtccactgctgtggaagtggaatggaacgctctacaactacaagagcggatcgatccccttttatttctctctctttttttaattttcgataagagccagagctttctgtttgaaaagagaaaaaaagtcgcttgcgactcacacagccggaccccggagctcggagcgcgtggtgtgcggtgccgtccgcgtgagctgccacttttggaccggatctggcccagtttctttctatccgactgcaggcccaagcccattccatatttgagatgctttctccgtcttcgaatatgagttatatctggttttacggttgagtttgtggacagtatcggtgttggcgttcatctatcccttccaggacaggcggaatcaaccatgccgtgcggcgtcaccaacaagaagccgccggcccactgcccttggagacgacgacaatgaacagtcggaggaacaccctgccaatgatcataaggatgtggctgtggtgccgtagcggctaggcggagtcgaagtgcacgcagatggtggcggagaggatgccatgcgcgccagcaatgaggaaggtagaaacagggcggtgagagccgccggaagggcgagaaagaggaggcagagagagaagagggaaggggaaaggtgaggaagaagatgaggtgagtagtaactcgctgacatgtgggttccacctgctgagagaagaaagcgggctacatattttcaaaaccacttaaggagtcaatttgcacctattttcaaagagagggaggtgttatacccggttttacggttgaggaagacgattcaatcatgagctagatatcaagggaggtgaaatagacttatttccttgtgtaatgaaataggtagacataacgaaagtaactttcatctgaaaacccttcaggatgaaaaccactatacattcagttgactcgttttacctagcctcctcctgattttcattttgcttttaatttgttcatctttttcaaaacatggctacagaaaagatacacacaatctaactaaccactatcatgtacacaagagattacagttgagttcaagcatccgctacaaagattggcttcacaaagttaaaacaggtggggaggaaaaaagagacccacagcccacagcttacccgaaagccaaataccacgtagcattgaaatgatgcggcaaaaaagaggaaaacaaactattggctactatgctcttcacacaaatcaatgaacatctcactcacattcttcactagtcgagggtcgtcaaaacaagatcccgtgacgagtcagatatcctagcagcctcagcaatcctgagggccataatagatttgtatgccaccagctcagcctttgccatgagacgctgagctctactgcgcagacgaacagctgtttctcctgcctgtgttgcagcacgttcggcttccacaactctccgcaaagcctcctcttcagcaccattagcatctgtccatcaacatgtcgagtaaaagacaacacaagattatttcccctcagtaggaacttagtctgcaacatcgggataaaaaaacgctacgttatggtacacaaacttgcatgcatgtaccagtggaacaatggtcataaatgttactagtaattagtttcttcataattacagggagcatgctttcatcaagcatgatctggattgttttgcagtttgtattgtttgtgaactaggattgcacagatctgctgctacaggagttgaatcacctagcagatgagagggacaaggtgaagaataaatctgcaactattattggaaaaggatgaaaaagctacaagtgaacaaggtggtcttggcgacaagctgcgatgatggatctcatctgaatcatagttttgatgataagtgctatttgccctaaacattagcatttattaagggtttgagacactggctgaatagctaactgtaacctgtcccaaagtaattcaccgaggactctctcctcacaaggagcaagcattctattgttaggcctcataggagagttgtttcgtttgtgaatacataggcccaaaattactagtggttcattcaccaaaaatatgatagaacatataacatgcttcatattttagtagagttccttacataacattacacaacaagtattctacgttatatccaaggttcatatttatatatgccacaattagtgctattttattaactgtgtagtatctactaagggtggcaagtagaaatttattaccacctcctccccaaaatatagcaacttctggataaattttgggatggagtgagaagttatcatttccaatagatttgttagtttgccgattactacaaattatgcatgcatttttctgtaaccattcttatcaaagtaattatatatacacatgtttacacccaactatttccaactggatcgaatgtagctaaaataccatggccatctacttagcaactttgtgcaccttgatatggaaaattggtaatacaccagaggcagggaaactaacactgtaaccttacagatgctaaaatgtaggattagatataatattaggagtgcttgatatttcaggcatagaaggatgtggtttcttatgtgaaagaaaaaaagattcacatggcttccgaaatcaattgaggtcactcttcggacaaatggataaagaagcttcttgtatcttttatgatgctttcttgcttcaactaagtgaagggccacgccaatggcggtcccaattctctagtaagatagacatcaaggagaaaacatcagtaccttgcaagcatatgtcaggctttccacggccagcttggcttctttgtctcttgaaagatctttttttcttaatagatctttgtgacagttgtcctcgtcttagtgttgcaccctaatgatcaagaaggttaacatttagaaaatataaccagaagttcaggatatgcagacaatagagggtaatctttgtgaaggttccagctttgtattaatatttggggaagggataaagtcaaaaaatacctgcaatatccttagcagtggtacacctttcttatatctcttgtttatccaatattcatgcacagcaaggacattatggtccttttccaaagtagggtatctggaaagaatctgatccaaatcactagttccttcagggttgttgaaagcatccttttcaaacgtggtaatcatcttttcaaaatcttcataagaaatatgattaagatgtgcgctttttctgtcagaatctgaatgattcaactgggtgagccactgttcatcctcagaatccagatcatatacagagtcccttgagagagctcgcccaacctcatcatccgccattctgatatagtctggcacagggcgtgaaaaaggatatgttccaatcactcccatgtcatcagaaacctcatttacaccaggaattggtatcatctttccctgggaattgcgctcccgaccctcaatttgcaactccttaaacaaaagccagtcccatttatcagagaactcaatcttcaatccatcatcaactgccaaaatataggcatgggtgaaccggttaacaacataaaacctctgctccgaaggcttcagagatattctattgacaccatgtatcttcacagctatacaccactcatttgattccgatggttccagcataacttcagcgccttcttccctccagcacctatcaggttgaataattaaaaggtttgctctgcagtgaacagaatctatattctgtctaacctcagccaaagccaacctttcattcatgcgctcaatgggacttttcaaagaagacctcttttgcttcccatttgatcctataggagttgaaacatcactgtcatccatgttttcaagcaaatcaagagagatttccagtgctgctttaggtttgacaggctccagtggaagctccggactaactgagggtggcgcatccgcttctgtctgtctagccacatcggtctggtttgttgcaactaccttgtcgggaaatcttgcagcaagacgctgtcgactgaggggatgccgcatagagcttctcttcctttgatgcttctttagcctcagaccatggaccaccactcctgcaatctcttcaaggggcacataatcttgagccacactgcaaagtttgttgctacacaggtcaacagcaggatcagtatccccagtgctcagagattcagaatcctcctccaatagggtgcgaggataaatttcttcagctccaccaaccaaatgcattctcgtacgaatcacagctggaagatacattgactcgagtgctattaacaagtgcaaaatctggaagtaagaagggactgccaagaaattgacagacaacaatggttcagaatccttggcaccacgaagctcacaccagccacattgcaccaaagccctctgtgacaatgcacactgcaagaaaaggcatacacattaaccaggtgtacaaggaactaaaactggcacactttttaagtctgtagaaggcttacgtctctccggcattgaagctggacaaaatgcaatccccgcaatgcaagcgcagtggcgacagcatcggacgagagaaaggaggcaaggtttcggaccttgccccgtcggcagctacgcatccagcgcagcacagagaggaggaggcgcaagaagtgctgagagctcccagagcaagatgaatccacaaggacaataagcatggcagcgtcagctttattagtgggaatacaatccaccagggtcaagaaatgggaatcaaagaagccagtcctggaggcaaactccctggaagaggagcatgggatggtggcaaggtcgttcggggcgtggtgctgaaaaggggcgaccttgggtctcttcctagtgaagacaatggcaaacctggtgtcctccttgggttcggggaggcggcggcggcgcttcctgctgtagacgatcccgaaggaccttgtgcgcggcagaggcggcggcggtggcttggggtcgtcgtgaagttggcgttggtggtcatggacgtggaagcagttgttgggcttgcactggaaccagtgggcgtcggcgggggattcggagaaggcgaggcgcttgccggagcggaggaccctggcaggatcagaaggctgaggcggcctgggcgtcttgggcacgaagacgcgcgtggagcggcgggccccaacatgcggcatgggcacggcaggttcctccggcggcggcggcggcggcggcggcgacggcgatggcgcggggttgctggaggggacccgaatgcgatcagatgcagtgcgcttcctcatccaacatggatgcgccgcccatcagcaaccaccaaatcgatgagctcctcctcctcctcctgctcctgctgctgctcagctcggaatcgaaacgaatcagatcttgggctggggggtcttgacgaggcgcaacagatcggcggcttgcggggcggggcgggggcgggggcgggggcgtggcgacgagatcgaatcgaatcgagagcagaaggagaagaggaattttagggtttcctcccttcttcccttcctcctccgttggggttgcgggtgaggagagagacgagacgagacgacgcgagtcgggaggaggatgcgcactgactgcgattagccgttggatgcgcatcggacggtatgtgactgacttgtggggacagtgccaagagaaggctctggaagccaaagccccttccttcttccttccccccgctacaaatctcactcgcatcgcatcccatcccatcccatcgcaccgcgcaaaaccctaacccaaaggcaagggagaagaggagcggacgccatggatgcttctcgcgttggcgagctccgcactttcgtggaggcctgcaagaaggacccctccctcctcgccgaccccaacctcgccttcttccgcgactacctcgagagcctgggcgcccacctccccgccgccgccttcaccaaggccacccccaagcccaaggtctccgatctctcctcttttgcccccatttcttccatcatatcgtaacagtcatccctgcagcagccgtcctccatggatgacatcgacgatgaatacgacgacgacgacgacgacgatctcaacatgagggatgccactccggagccggacgagcttgaccaggacatcgtcgagtccgatcttgaacttgaaggagacattgtcgaatctgaccatcaggaccctccgcaaaaggtaatactaataatattacccttgcatctcccatctccagccccactaatcataccattgtttatgccagatgggagatccttctattgatgtcaccgaggaaaatcgtgatgcctcacaggaggccaaaagcaaggccatggaagcaatgtcagaaggtgctcttttttccccccacccctttggcctttttttttctttttctacttggcttgccttcaatctgattccccattacatgtggcattgcttgtcagggaaactggaagaagctattgaccatcttacaaaggcaatactgctcaatccactctcagctatcatgtatggtactagaggtaggtcgcctctcaatgctctataccatccatctttaccgtatatcatgcataagcactgaccaagttgtggaattcgtatgcttgtgcagcttctgtgtttatcaaaatgaagaaacctgttgctgccatccgtgatgcaaatgctgctctagaggtgaaaagctctgctcttctctatttttttttcttgctcaagtggaacttttgcatgtactatatgtgaagtcaatatgcagaattgctcttattacaaggttgattgatagtctgtgtttgctgaggcatggtacagcacagcctaggtgagctaggtggccacctaaggttaacacttagcagtgcggttatattattcattatgcttaccctagggttaacacttgacagtgcggttatattattaattattaggagtattgactatgccacctaggtgcgctttgcataacctgccattattatgtagattaacccagactctgcaaaaggctacaaaactcgtggaatggcttatgctatgcttggaaaatgggaggaagctgcccatgatcttcacacagcatcgaacatggattatgatgatgagatcaatgctgtgctcaagaaggtcgattttttatttggacgctctcttcctctgcatatgaataagctcatgtaatctaagtgacactgataatcttgcaggtggagcctaatgcacacaagataatggaacatcgcaggaaatatgaacggctgcgaaaagagagggaagaaaagagagctgagcgtgaccgattccatcgacgtgcagaagcacaggtgcttcctgtttagtttgatgcccatcagcccatgccatccaccttaacaaaattggtctgctttcaccaaaattttcctcttcaacctttggtttgatctcaaattttggttaggcaaccaccacatatggcactagttcgctttcagagcaaaagatggccaaaacttggccagtcaatttgattgccccaaatatgctatgccaatttttctcttggctctcatgttccctttttcaggtttagaccaaatgggcccaaatgatactgctcatgattatgttttgtttttctacaggctgcttatgacaaggccaagcggaaggagcaatcatcaagtcgctcatcgggaggtgcatctcccagggggggcttcccaggagggatgcctggtggaggtttcccaggaggaatgcctggtggaggtttcccaggtggtatgcctggtggaggtttcccaggtgggatgcctggtggcttccctgggggtgctatgcctggaggtgttcctgggaatgtcgatatgagtaaaattctgaatgtaagtgatttagaattagctaccctcattggttttcattccttgagatgacagtcactacacatgtatgtttttccctcttcaacaggaccctgatctgatggcagcatttggtgaccctgaggttatggcagctcttcaagatggtatgctttaacattggcatatttgtgatttacttgttcaagttccagtccctatgtagtactgtttctggataacatcaatcttttttattaaaaaacctgatggcaaagaagtactgaatggttgtccaattcccattgagtgggtgtttatatgtactttaacatttccttgtgtagtctgcaagggaagtggtcctaagaaatatgtggatataaatcaacggtaggtaaattggtttttttgtggcttatcaggagttatgaagggcgtgcattagtacatctgaagatattaaaggagcatagttcatatattttttgttttctcataaacagtattgccaccctaaattgaattctcaagtttcctgagtttgaaaattctgttcactagaggctattggattttctatgtttaatgttacccttattccttatgttgtatagatttcagcccatgacagcattgcaacacagaattttgcaatttgcgagtttggtttatccctctagtaaaaaataatgttgttttgtactttgcaaagccaactatatacaactttgtcttggtgtgtcttttgtataaatacggaaaaagttacacaagtgatattttgaaagcatttttatgacaacttggctatatatttttggagtaaatttcacaaaatccatgttttatggtcaaagttgcataacaccataggtattttgactggtggcttataacactaggtattatgattctaaaatttcacaaaacccctgtccctgtgcatgttaagtatgaatttacttaaaatttagcatagagtatggatttctttatttttgggttcttgactaaggctgtgtttggtgggaaggttgggcttccaacctagcatgctaaaccaagcgatggattaacgcacgattaattaagtattagctaataaaacttgaaaatggattaatatgatttttttaaagcaacttttctgtagaaaatttttgcaaaaaacacactgttttgcagtttgggaagtgtgcatgcaaaaaatgagagtgtagaagttgggaaagtagggggaagaacacagtctaaggttgatagtttaactcttcactgctttgaaagatattgtttcgaatatgctgaaattaatcaagatttgaataaatgtggggttttatgtaacattttagaccataaaaactgtggttatgagccacgagccataacacgcggtctttttttgtgcaattttgaccataaaacgtggggttttctaaaatttactctatttttatgtgcaagacttatgtttcaaacaataattatactcaagattaacttgtgtttactgcaaggttcccataaccacattttttggtgactggaggcagtattcctgttcaccagagtcactgcactgtacttatgttcaatggtatccgatattagtaagcaattataacagtttaggcattccaggcagtattgcgtagtcaaatatgttgagcatgttatccttgcatctgggtacctgcacaagccaaggaaaacatgcatgacacaaaaaaggcaccctagacattgttgagttatcaagtcatgaaggcattagaagtttagaaccacgctgctgttagttttatcaatacatacttgctaggttaaaagggaccgtagagctgtgttctgcacccaagcatacaatttcagttgtttaaccgtctgtttaatttttttttcagtgatgaacaatcctgccagctttgcgaggcaccaagccaaccccaaggtgggccccatcattgcaaagatgatggcgaaattcaatgggtcccagtaaacgttttgagtgagctgatggtatgagtaaattgttatttggcaatatggtgtcaagtgttttgtgatgagcaaaagcacgttggacggtctcttgttaggtgctactcttttttgtgaatgtggtattaaacggtggatgtatatgcagaaatacttttcatcgggctgctaactctatattacttcttttagaggtgcgacaatgaggatttggagatatgatttgttgacagttgtcgcattcattcatctatctgtttgtgcattgtgttgggtggatagctctacttgtgttgtgtttagggcttcggtttgtaggaaaacccaaggatttttttattagtactattcaacaaagaaaatttttctttccttagttgtattactatagaactgagggagtaataactagcccgatatgtacttatttttagactagtaaatatgcctgtacgttgcaacgggtgaatatcaaacaaatatggattgctaaagcgaaaaaataagggaaaaagaaataagggccaaaacaacgtgcgccggcccgacccgttaagcaaggaggtcctatagacacagtaaacgagcgagcgaaagtagacttattacaggagaggcccgatgcagtatgagggagcgaaagtagacttattacatgagagaccgcatgcaaagcaagtaataatagggcatgcagagcaagtaataataggtgtaaaaagagagggaaggtgggagttgaaccctggtggacggagtgaagattttccacattaaccaagcaggcaaataatcacttgtgttatgtgattacatggaagatacatatattatattaactgcggttttgcaatacaatgaaaacagaccgacccgactcggattaaaacagattttagtggcgcgtgtgggatgacggacgaagaaataccggaatccttacgtattttttattaggtatatatatatatatatagatatagatatagatatagatatagatatagatttagaggcaatgaactcgatgttttgggtttaaataatagagtaaattacatgttggactatattttttttaccatggtttcactttgggctacccttaatataatgttttcaccttaggccagattttataccaaaacctttcactttgggcgtatggcccatagtcagtctctcagagccaatctctcatccctatctgatcatctccaactgttttcatcgatggctgtagaccacaaagaccacgacgcctaagagagctcgagcatatataacagagctgacgcccgcgcatctcaagctcgtagtccagccagcacggggtcaacctccgccaacacggcgtcacgctagcttgacttttgttcccgtcgtgccggccggtctcaggctcaagctcaatgtctggtggcttgatctcgacttccgcccgcactcgcacgccattccttggcttgatttcaatctccgccgatgtcgtccgctggctcgacctcgacttccgcctgttcccgcacgcacgcattttccagtctcgatttcaatctccgttttcgtcatgccccgtcttgacctcgaactctcccatagtcccatgctggcgcgccacccccggccttgacctctgccgtgtctccccccgctcgacgtcgacctccaggcaccagcaggtagcagcacccacacgctgtccttgagctcgagctcctatccaccaccctagcttgacctacgcggctccgtcgccccagcgtgccgtcctcaagctcgagctcttctccgccgccgtcggccctcgctagcttgacttcgttcttcacctacgcccgcacgtcgtccccgagctagagctcctctctgccgtcgtcgcacctcgcttgacctcgatattcagtagcactagcacgtcgtacttgggctcaagctcctctctaccgtcccggctcaacctcgatctccacggctactccgatgcccgcgcgccatcccggagctcaacctcctctccaccgccgtcgcctccgtgactcgacttctgctgtacctggatgtacacgagctcctctttgctcacgtcgcctaacatcgacctccacacgagtctttccagtcccaagctccccatgttgcccccaaggctttagcgtgatctctgcccacaccgccatgagatggttgggtgaagttggaaagagatcgacggtgtggtaggagatgagtcagcgaactcgctggttccttcccaaccgagaagtttccttttttttccctcagccacactggcaagtgggccactggtccaaagtgatacattttggtaataaaatctggtgtaaagtgaaagcattcagttaatggtggtctaatgtgaaaccatagttaaaaaatatggaccaatatgcaatttactctaaataatatttcgcggcctgctatatgcctatatactgtcgttattgtattctttttattagacgaagagagtactccgacgttattaggaaatggccatattcatgtttcagacaagactcttgatttacatgctcgtcggttcggctgacttgtctcatcgctaaaagacattcgtttagtaaatatgcgtttgttttccctttggaacgtaaaagtgtgtggactatattaaccagggttttacccttttgagttcgaagtaaaaacggctcttcagcggtttaccaaaatctgatcaaaaactagtaaaaactaaagaatttcagtcaacacagcatgaaaaccagctaataccgatcggttttcacaacccgagacccggcctcgcgtggtaagtcgtgttctttccaaatttggctatacttttctatcttttatactccatccgtttcatattataagactttctaacctcgctcacattcatatacatacatctatatgaatataggcgatgctagaaagtcttataatatgaaacagagggagtaccctatatcggagccaaatttgggtattaatagaaacccgtgcttcagtgggatattttgttgagattggtagttgcatttggtaaagtgaagtggtatgaaaattattagaaaaatattaaatttgaatacatggaactttattgctatcgtgaaacaggtagtttattaaatattatatttatcaatttagaagagaggcagtgtgaatgtgtttctttgagttcaatgtcttgaaaaaaaattctcctatttgatattcaatgaatgaacaaaacaaaatcattctaaaaaaacaaaatattctcttgatgtttgatttttttttactacatacagttgaacatatgtaatcaaggaaagactgactgagattattggatcataccttgcagattactactacagattcttgcagtaaccaaatagctcgaagagagaacaattcattcttgtggaactgcatatacattattgaaagggagagataaatcatctctgattctcagccaataacctttacttgttgatataattctagatgtaacgaattattcttgcctcctacttagctacagaggttgtaaaaatatctcaccagcagatgaatatggaagcaaatggaactaaacctcgatgatgaatagtgcaccccatgcttacactaacttggaaactggtatacaccaaagattacttaggaaattagaggatcatatggattagacgacctctccgattatctcctcttgtcctagtgtagagactggtacgcaatcaacatctttcttcacatcaaaacccaaaatagatcagaaaaaaatattgtgtaggcatgtgtacgcccagcgttgccgtaatagctgcagaggcacggtacttgcagccacgctaccgtgatgaatcgatgctgaatttccgatgaaggctatggagcggcccaggttctttcatccacgccagactcttcagatgctatccattgttcaatgtatggccacctggcacggcccgaggcgatcaggccagcacggccgtgcctacccacgggctggacctcaggcccaggcacggccctacagcagtcgtgccgtgccggcctgatggcacgacgagcccaccgtgcccgggccagcccaggcacgcctaagacatttgccacttgttcacttcaattttgcacgtacagtttgaaaatacaaagtccatcacaaaaaccatgcacaaaatcagtgcatcacaagttaacatatcacaatatcacaaatcaaatacaaagtccatcacaaaaaccatgcacaaaatcagtgcatcacaagttaacagatcacaatatcacaaatctcacagaatacaaatcatagattacaaatcacagttcacaattcaagtcacaaacactttaaaaaataatagtagctgtgtagtgcaatggctgcctcattaaaaacctttctaggtaaaaactcacacctcgtgagaaaaccctagaaaggaaaaaagagtgcagcccacaactttcatctaattatcatattaaagtccaagtccagtacagtcatccagttcctcaaatgattttataagctctacattctccatggtatgctgcaacttcttgtctgcctgcacccagtccttgatcaatgccaaagcttacaccatgtcaggacctagacgccgtcgtcgctcctcaatgatcctgccagttaagctaaaagcagactccgacgatatagtagaaacaggaacagtcaagacatctctaactaatatggacagaataggatatttgtgtttgtgctcatgtcaccagtttaggatattgaagtcattgtcgaattggttgacagtgtcactatcaagataggcagacaactcagaggcattcaagttagcattaaaagaaacagcctgaatcaaagtagtagcaaaagttctcatggaaaatgaaccagcaccaagtccagaacctggactggcaccagcaccaagtccaagtgcatcactggcaccaaaaatctttccccaagctgtctttttattactagtagtactgcctggggttgttctatgtaatctcacagcaccaaacttactttcatacttagaaaaaatgtcagacaatgcagccctaacctcagttaaataagtagagtaatcagaggtcataatttgtgacataatttgtagaacattgctaaaacctctgatcttagccctaggatccaagataaaagcaaatgaatatagaaatggaatctcagactagtatgccaagaacttacttttcatgggaacaacaacatttctaaggtcaatatcattctcataagtgttaagatgtccagcaatctcaagaatgtgatgcataattaatggagatgttggataataaacaccagacaaaataacagttgaatcataaaattgttcaaggaataaaagcacaatttcagcaattgtcaagtgcaaatcagtaagcaattgtctaccattttccctaggataatgagttgcaataaacaatgaaaaaagctccttatgtgggaagagatgcttaagcattagataagttgcattccatctaacatccatgtccaaaccaaacttacgaggtcgaacacccttagcaatacaccagtttttgtataaaacaatgcgctgattagatgcattcacaaatgagatggctgttctaaaatcttgaagcatgggtttgaaaacttctagaccagccttaacaatcaagttgattatatgacatgcacagcgctgatgcaaatataaatcaccaacataagtagactgcttaggttttagaaaatccattgccttagtattagaagaggcattgtctagagtaatagaaaaaaccttatcagtcaaaccatattcttcaacaacagaaagcacacgttcagaaatattctcagcagtgtgcttcacatcaatcagcaccagacccaaaatccttttctctaattgctaatcagaattaacgaaatgagcaacaacacttaaataatcctccttagcattaccagaccatatatcagatgtcaaagcaacatagttaacatacttgaacctctaaataagcatagcacgaatcttgtcaaagtacttaaaaacatctctactaatagtttgcctagagacagcatggaatctagggttatgagcattctgaatgtactcctcaaaagcaggagattgaccaaaattaagtggcagatcctctacagcaatcaaattaaccaactcagttctagcataatcaggatcatattcccatggacgaacagtaccatcagcattgaacttaagcatagactgagacaaattattaacagttctaggtttgcatgacttaagatgcctaagtaaatgaccagtgccaccagatgaacgagcagacaaagttttttttttgcagtgattgcatttagtagaaacgcgaacctgcatgccattacatgattcaaagagttcttcgaagtcatcccataccttggatgatcttggccgcttgttggtagcattggagttggtgccggacgacgtgctagtgccaccatcaccgtcaccggtatcgtccacgtccggctccgtctctggctgcgacccatcgaaatgaggaggtgacgaagtgttgccgaacacatgcacgtgttcctcctccaagtcatcttcgtcatcaccccgcatccccatcaacctcaactcgtggttgcaagaggatggattgtccatcgtcggcactccggttcctcaacggcagctaccgctcagcgacctacaagacacaaaatgagagaagagagcagttagggactggagagaagtagaaaaccaagagaggagagaggagcagagataggtgtgtacgctgtacctgcgcatccagagcaccggagttgccgttgatgatagagatcggcagatctatgagaagaagagagcagagactgggtttggggagtgatctgacaaagagctcacggagaaacggcgagcaggcgagagtggcaaaaaaaatgaaaaagaaagaggaaatcgagagcatggccgacgatccgaagaccggagaggcagagacgagacaaggtcacggatccggcgaggcggcgaccctcggtggtagatccggcgaggcgttcatcggagacggcaacggaggatggagagatggaggcatggtcgcgtggaggtggaggcgcggatcgacggaggcggaagtggaggcggagcggtcaaggtggaggcggagatggaggcgtgcgtggatcggcggaggcgagaagaagcggaggcggctagggttagggttaaggttgtggcgttggagggaggcggactgacggaggcgagaggacgcagcggcctttatatatgcggcgcggcggcggctcccgatgggcctcgtcgggccgtgcctaccgttatacaggcctgggccgtgccggccccgtcgtgccatgccggcccagcgtgctgctgagggagcccaggcacagcccggctgtcgggccgggccggcacgggcacgaacattgacgggtcgggccgtgcttgggccgggccaaacgcccgtgccttgggccgggccgtcgggctgcgggccatatggccatctataggcacactctctagtggtagccggatcggtgcaagcagcgaacagaggcagcactcacgaaggctgatcgggtcattcgaacaaagatatatatatagttgtatgtttgtgtaagaaaatatgctatgatatttcaatgagaggagaacactatcgttcacagttacagggataattacagaagcaaataaagtctttggcactagaattccaagttacctgcccccatcaacttgcagacaaggagatagatagtgttgaaatatagataagtttagttatcatgtttctgttgttatctctttatccttatctcttgtaaccatatgttgttatccctttgtaatcgccatggtagaggctgtttctaccctatttaacacgtaccgcgacccagcgtgagggaatcacgttctgtcggtgacatgggaccgggagtatcatgacttagagacttgaggcagacacgatcacccacgtggcctaaccccctcgggggggggggggtcgggcccgagggtgatacggccgcccttctctttgtctccccgaggggtcggaccgctcccatctcggccccgagggccgaggcgccccgaccccttgtgggttttgcgccgcgtatatggggtaggtgagcatagcggggctcacctaaccacatttattgcggtttggacgagcgcgtcacgccgcatgaaacgtagtgcagcgcactcgtttatccggtctgtgaccagtcacagaccgatcagatcgtgggttaggtggcgacaggcggtctgacgcacgcctcgccccatcccatcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgttaaactgacacgtggtggacaagaatgaccgatttgtgaccggtctgacaatggtcatgtcgtcagcagacagccatgttcccacgtcgcgcctgcctccggcagaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaggaaaaaaaaagaacgatcccagaacgatcgggggctggctcgcactttgtagcttctttatacacagatccaccaaaacacaggagtagggtattacgcttctcagcggcccgaacctgtatacatcgcccgtgtcttgtgctttttccattctcgcgaactttccacagaccaggagcttagaatctcacccagggcccccggccgaaccggcaaaggggggcctgcgcggtctcccggtgaggagccccacgctccgtcacgttccatctagttttcctatatggtatcagagccctctccctccagatcaatctagctcatctcgccatggcgacgtcgtccttggcggctccctctctctatggtcaggaggtgactgagaagctgaccaaggccaaccatgttctttggaaggcgcaagttctcgccaccctgcgaggagcgcagatggcggggttcctggatcgctcgatccaaccaccaccaacaataatcatccttgccacgaaggacaaggacgggaaggagaccaccaagaaggtggcaaatccggcgcttctccaatggcaggcgcaagaacagcaagttctcagctacttgctgacgtctctgtcaagggacatcctcgctcaggtggcaaccttcaccaacgcagcagacgtttgggatgccatcgaggagatcttcaactcgcagtcccgtgcgcgtatcatcaacacgcgcatggctctatcatctactgtgaaaaggtaaccgtagtattgccgagtatgttggaaagataaaagggcttgcagacgagatggcatctgctggaaaagcccttgatgatgatgatctgatctcccatatccttgctggtttggattttgattataatcctgttgtgtcctcgattacgggatgcaccgagtctgtttcctttggtgaagtctatgcgcagctgctgagtttcgagcagtgtcttgatctccttcaaggaggctctcagtcctccgctaatgctgtgtcgcgaggagggcgcggcggcggcggcagaggcggcggacgcaatggaaatgccaaccgtggtggtcgcggcggtggcagaggtgacggtggctccttcaacaacaacaatcgtccgacatgccaactctgtggcaagatcggccacaccgtgcacaaggtgctggaagaggtttgatgcctctttcactggggaagacaagagtgccaatgtcacagcctcgtcctacggggttgacacaaactggtacatcgactcaggcaccaccgaccacattaccagtgaacttgacaagctgacggtgaaggacaaatatgccgcaacgatcaagtgcacacggcaagcggctcaggtatggacattaaccatgttggtcgcaccattattcacacttccactcacaagctttattttaataatgttcttcatgttcctgatacaaagaaaaatctaatttctgcctatcgcttgatgcttgacaaccatgccttcattgaacttcatccttccttctttttgatcaaggatcaggcaacgaagatgctgctgttccgcggcaaatgtagagccggcctatgcccacttccatcatctacgtttcacaataaacaagctcagcaagtccttggcgctttcaaggtttccccgacgttgtggcatagtcggcttggccacccgtcgtcagctatcgttgatcgagtccttagctcaaataaattacccgtgtcttctgagagtactcagaatcaagtttgtaatgcttgtcagtagggtaaaagtcatcaattaccttttcctaagtctgttagtgtgtctaaagctcctttagagctagttttttcggatgtttggggaccagctccctcctctgtgggcaataagaactattatgtaagtttcattgatgattttagtaagtttatatgggtctatttgctcaaacacaagtctgaagttttctccaaatttcgtgaatttcagacccttgttgaacgttcatttaatactaaaatcaaagctatgcaaaccgattggggtggtgaatatcaaagaatcaatagcttcttttctcatattggcatagcacatcttgtctcttgcccacacacacaccaacagaacggctcagctgaacggaaacaccggcatatcgttgaaataggcctagctctcctatcccatgcctcaatgcccctcaagttttgggatgaagcctttgttacagctgcctatctcattaaccgggttcctagccgggtaatcaactttgagacacctttagaatgtctctttggcatcaaacctgattactctgcccttcgcacctttggttgcgcttgctggctgcatctttgtccttatcaagctcataagctatcctttcgatctaaatagtgtgttttccttggatatagcctccttcataaagggtttaaattaaatgcttggatgttgcttccggttgggtttatatctctcgcgatgttgtgttcgatgaaactgtgtatccattcgctactcttcatccgaatgatggcgctaggcttcgtactgaactcctccttcttcccgatagtttctctcctaccactcaatctgatcatgggggtgaaatagtgcaccaaccgctggttaattgttctcctaatttttctgatcaaattggtgagaattcttcaagaacaggagttgctcagattggtggttcagctactggaagcagcgaagcagaaaccaggtcgccgggtagcgccagcagagaagaaagcgtttcaccggaggaaacgcatgattttatgcatggtcctgtgcagtctcaattttctattggtgcagctggcgcaggaaatgatgatggttcaccagtgctacgtgacgtgtcagcagagctgcagtcagacagtgatgctgcaccaatctcttcatcacctagtactagtgcaccgagtggtggagtagtgcatggcacacatgctgaccaagtcacgtcgccatcatcagcagcgtcagtgcagtctgaacaggagcagcagacaacacaggcaagtgatcagacgagaccagtcatgagactacagaaaggtatttctaaacccaagaggtatacagatgggactgttaggtatggatgtcttactactactggtgagccagaaaatctccgagaggctatggcaaatagtaattggaggcttgccatggaacaagaatactctgctcttatgagtaataaaacttggcatctagttccaccaacccaaggtaaaaatataatagattgcaagtgggtgtataagattaaaagaaaagctgatgggtcaatagacaggtataatgttagattagttgcaaaagggttcaagcagaggtatggtattgattatgaggacacttttagtccagttgttaaagctgcaacggttcgcctaattctgtctattgcagtctcaaaaggttggagtttgagacaacttgatgttcaaaatgcctttctgcatggatatttagaagatgaagtatatatgagacaactctcaggttttgagaacaaaggccagcctaattatttgtgtaagttagacaaagccttgtatggcttgaaacaggcaccaagggcatggtactctcacttaagtacgaaattgcaagaacttggatttatttcttcaaaggctgacacctccttgttcttttataacaagggtggttgcactatatttattcttgtgtatgttgatgatatcattgttgccagttcttcttcagaagttgttgcagccttacttaaggacttggagaaggattttgcattgaaagatcttggagatctacactactttcttggaattgaggtcaagaaagtgagtcagggacttgtgctatcacaagccaggtacgcttctgatattctcaagagagctggaatgtctatttgcaaaccagctagtacacctttatctactactgaaaaattgtctattgaagatggagatttcttaggacaaaatgatgctagtcattatagaagcattgtaggggctttgcagtatctcactctgactagaccagatttatcattctcagtaaacaaggtctgtcaatttctacatagtcctactacagtgcattggttagcagtaaaacgaattttaaggtatataaaagggactgtggaatttggacttagatttggtaagtctgattctatgcttattagtgctttttctgatgctgactgggctggttgttctgctgatagaagatctacaggatgttttgcagttttcttgggtcctaacttaatttcttggagtgctagaaaacaggctacggtttctagatctagtactgaagcagagtataaggccttagctaatgctacggcagaagttatgtgggtaaggaaaattttggatgaattgagaattgcaagaccttcggtagcacaattgtggtgtgataatttgggagctacttatttatcagctaatccagtctttcatgcaaggacaaagcacattgagattgattatcattttgtgagagagcaagttgcgaagaagctacttgatatacgatttatatctacaatagatcagctagctgatggtttcattaaatccctgccggcgccgagtttagcacagtttagacacaatctcaacttgggctaagttgtgattgaggtggggtgttgaaatatagataagtttagttatcccgtttgtgttgttatctctttattcttatctcttgtaacaatatgttgttatccctttgtaatcgccacggtagaggctgtttctaccctatttaacacgtaccgcgacccagcgtgagggaatcgtgttccatctagttttcctatagataggactacctgtgctccttttgccaaaactttctgagcccaccatagagtttgggagaacttttcagcaacccctgagataaagttggcaatgaagattcacaagttgaccatcatcttctactagtatatgtatatttatacaataccagcttaatttggacagaaagtgaagaccaaatttccagtttttttgcaaccattaatccacccctttccgtggatgcagccagcataaattttctagacttaccgtggatatgatgctttggaattttggtttatgtactgctactagctagctagctagttcatctcatcctaacagtaattgacgtactagcacaacagtgcgtgcagctgattcatataaaagaaataaagaaaaagaaaaatcgatgtgcagtttgatcacttagctagatgatctcctgcatgcgatggtggacgatatgcatgttggcggcttgcctctttttttgttgttgttgttgtgtttgttcatgatgatcgatcagtggctgtctgcgtcacagtcactactgatgctccctccatttgacaaccaatgcaaagaatccagaagcatgatcgatcagctgttactgctttatgaaaaaggaagaggggatcgatcgctttcttgctttcatttttttccttcctttctttctttctttctgttagttccattcaagtatgaatgattgcttcgttcaagatgttttattacccgtgtctcttgagagtgttagtggctctagctaattaattcccactactgagtgctaataactcccgctaaagctaagctaagctaagctagctgcatctttgtgcatatactgtctgcgtctcctattgttggcaacgtcgtaattaactttagcatcttatgatggtgcctgtctgcctgctcgaaatcgaaacggatggatggcaaattggcaatatggcatggctaagcaagctagcttgatgcagcagcaagaaagcaataattacttatttaaggtggttggatatcctcctatattcttatcgtgcttggatctgctctcagaatatccaacctagctagcctgcaagcaagagagtgtagctactcgatccgatccaatgtctctcatcacggatgagtctcctagggattgctcctcctacaagcatcagcatcatcatcgcgccatccatggtcgccgaattagccgccgcactctggtggtggcgtcctcagcggtggtgtctctggcatcgctgtcgctcatcctgtggctcgtcctccgcccatcccccccgcgcttctcgctgctcgccgccaccaccaccgccaacgactctgcctctgtcgtcgccatcaacgccgccttcgccgcccgcaaccccaactcccacaccgccgttctctacgaccgcctccaggctagcgcctcctacgccgggctccctctcaccgccccctcgccgctgatcccgcccttcttgccgcagcagggccagggcgacgccatgctctccgcgtcgctcacgtcgccaccggcagcggctgctgtggcgggagggcgggcgctgctgaggctgcgcgtggaggggcagctccgctggaaggtggcggcgtgggtcaccggacgccacgcgctcaccgtcgactgcatcgccgttgtggagctgcagccgacgccgacgccgtcgccgagcgcgatcgtcggcgtcctccagccccaagatcaggccggctcccgctgctccaccaccgtcgcctaataatataatatccatcaaaaccaacaccacaaaccatgcaaactgatcgatggatgcatggaggaacagtcctagttcttgtacatgtacatgtattctctctcgcgttatgtatgtatattgtcctgtaccgcgcgcggtaaacaagtaataaatcaaagcaatctgaatcgtacaacgtatttcatgtgttgctttgatttttttggctttcagctgtggtgctctgtgtcccaaaagtaggagtgccgtacttgcattttggttttaatttcttttgttcaccacaggtctggtctggtcactctcactcactctaattaaatcgattttttattattactccagttcattcggtgtgtgaatgtgaatctgcctgtgttgtgtatgcgactatgtgcttatgaaatttcctggagtacacttaagggcggccgattttcgtcgtcataaggaacggcgcaaaggaaatttcggcccatacatatggcccatccataggccatctcagtgtctaggccagtccagtccagtccagtccaggacggtccagtccggtcccgtagagcgccggcgcgtgtagcttcctcctccgctccaggctccagcgagggagggagggagaccaccgtctccgccggctttgagagagaaagagaaagagagagagagagagcggcgagatgcggaagcgggatctgggcatcctcctcctcgccgccttcgccgtcttcttctcgctccaggtcagtcctagcttcttccttccttggtaccaaaccctaaccctaaccctaacccgcttgaattgatccatggccacagcacgacggcgacctctccttccgcgaggcctggtaccacctctccgatgccgactaccccatcaagcacgacgccgaccgcctcccctctcccctagtcgccgacctcaacggcgacggcaaacccgaggtcctcatccccacccacgacgccaagatccaggtcctccagccccaccccaggccctcccccgacgatgcctccttccacgacgcccgcctcatggctgatgtctccctcctcccctccaacgttcgcctctcctccgggaggcgccccgtcgccatggccgttggcaccgtcgaccgccactacgcccacgccccctccccctccaagcagctcctcgtcgtcgtcacctccggatggtccgtcatgtgcttcgaccacaacctcaaaaagctctgggaggctaatctccaggacgatttcccccacgccgcccaccatcgcgaggttgccatttccattaccaactacactctcaagcatggggatgcaggtttggtcatcgtcggaggaaggatggaaatgcaacatcatgtaattatgcttacttttcctctttataccactgctgctcatctacatgttgtaaaacacacatcatacttctttttttacatgtgcccaaatgattcgaaaataataaccatattactagtttgtaattcaagttgcattccagaataactcagggccaccagcatagaaccatccctcgtttgtaattcaggcaaggctacgcaaaaatcgttttcctcctttgcagtaggatttattcttttatagaatttgctgttatgtgtggatgcctttattttttttgctacatttctacaaaattaattttagatacttcaaagttctaattctatcatataatgcttgaccatcttgttgaatccttactgataataacatcttattttcaaactttctcttttggcttgaatatgttaacttacggtagttacttgtttgtcagtcagcagagcttttcgatgaatttatggtgtcagaacacaacagggaagagcaccgtagaagcgccagtgagaagcaggttatcttgtatttgtaagcttatcagttagtttatattctctgtgccccatgaaaaaataaaactgtgggcaatattttatatcgagaaaacaacaaccagagtacgttgttgtatccttgctccttcacctgatgaaggcctaacctgcgctggtattgcgctttgatgtcatgcaggcttctgagacaggcaacacagacctgcgtcattttgccctttatgcttttgctggccgcactggtgaattaagatggagccgaaagaatgaggtgcacccatcctgtagtccatgacttttactttatagtttatactactatttatttcaaggatgttgccacttctgtgcattttgtgtcatgcattagcatgcacaggacatgaatagcttggaaagcttgccatacattattcatgtgtttctgttttgacaaaacagaatatcccatcgcaaccatccgatgcttcagtgctgataccacaacacaattacaagcttgatgcccatgcccttaatagtcgtcatcctggtcaggtgagaattgtgcctagcactcttgataatggtatatttgccaacagaagtcacagttacatacttaaatctgagcaagtgttatgtttctgttgatatttgttctttgttagcttggtttaattatcatgatgtcgatcatcttcagccagtataggtggctgtcttgactctttagcatattcagcattcccacttatgtacaccagaatgatttgcgtgtgttctacaggaatgtactttcaaatccatttgttctttgttagcatctttagccacgtttccttcaattccttactcattctctgcatgttgctgctgctaatatttctgattgatgaaccaatagcctgaacatctttgaacaaaatttagtggattggtaaatatcaaattctgctgccatgttgcttttgatttggatttcaatgtcaaatgtgctgttattttaccacaagatgctacacagttggttcttgtagtaaatatgatctcattacaagctaacatggcatatatggtttcagttcgaatgtcgggaatttagagaatcagttcttggggtcatgcctcatcattgggtaagaatagatattagataactactatatcatatttctctaatttaattttttgggatgatcaactcagattgatttttttttccttttcaggataggagagaggatacttttctgcaacttgcccattttaggaggcataaaaggaaagcactgaagaaaacacctggaaaagctgttgtaaataacgtgcacaagcccagtgaacataatccacctggaaaggatgtttccaataggttagcaaatgtgattgggaaagctgcagatatggctaattcaaataaaatcaagaaggtataatgcatgcagacacaaacacatagttcttacgcactagcatgttgactgtgttgttctttttgtgtttggtgttttggggaggggggaggggggagggggagttgcatgaacgcagtagtggtaacgtgcatgggccaacgtaggcaccaggagcaggagcactcgtgattgcacggcgcacagagctactcaagatggagaggatggtggcgtggggaggggagaggataggatttgaaatgaggcagatcagtggaggcagtggtgctggcagttactgggccaagatgacattgtaggtggtcgggtagaaggaaaaagagaagatggcaggggcagtcgagggttcttaagagtggatttggtgttcacccagtaggaaatgggtgaagatttgcccagtagggcctcccttactctcatttcaaaatgtatcctctcaatttatctgcaagtgtgttcgtcttgaagatactgtatactttccgatccatttactgtactctcaaaattagtgttaaattgtatccctggaactatattctaaataagtaagaacagtcaaactttgaaccaaacatacttacctaacaagttcatgtctcgtcctcagctctacttatctgcatgattatgagactatgggcacgtcctaactggttgattgtatagattacggatagaaaaaaatgctcatttttggaagtagcttagaaaaagttacctaagcaatgctgatgtagaaagttttgggagaaatcatactttgctggaagcctggtatgaataatccatacctcacattagctgtttaggacgcacactatatatactcatgagaacagatgcattatttttctatagaaatcaacgaataacacacgtgtccatgtatttgcactcaaaatatcgtgagtgggagtgggtggagaatatgccatcgcccccaattccctattttgaagtgtataagatataagataagattagattggtgattggatttactttcatcaatgatctgtgatctctagtacttaagtagtgtctctagctttttttgattggtacgtctttcctggttcattttttgattagtgtatgtctttcctggttcagtggtgtgaggtaggtaggtgatgttaatagcttgatgttggatgtactttgtttatggcattccatgttagtgtacttcatgcctatgtgagtttggcccttactattaaaatcgttgcctctgattagtgatctaatgcataacaatctaaagactcactcggtaattcattaagatacatctgatatcttttatgtgcatagtgcagtcctccttcaattattggcattcatcacttattcaggcgattcttacataaattgcatgttgtttctttgctgcatcataattctttttcccccaatacaatcacagtggtctcacaccaaaattttatttacatatatcgtgttactttatcatgaaatgtaacatctttcctctactgcagtcacaaaggacgctttatgttccgacaatcaccaactatactcaagtttggtgggttcctaatgttgttgttgcccacgaaaaagaagggatagaggctgttcatctagcttctggacgtacaatctgcaaggttgcaagatatatctcagtgatatttgtgttttcacgtccctgccaaagcttgtctaattagttcattgtaaattatttatttgtttatagaattttcattgcctggtccactggctgacatcaagctacaaatagtgttgaatactacctgaatggtcactaaaatcaatctatgtttgcacttgcatatgtacacattatgcatatattttttagcaatcattttccttctaaggaaatcataattcacgtgtgcgcataatttacatgtctgtaatcccatcatacaacttttctgtctttgttttctgatttttttttccatttccagcttcatttaacagaaggaggccttcatgcagatattaatggagatggggttctagaccatgttcaggtgtgttgagcgttgagattagagagcaatttacacttttcatttccatttttttagaatacaagtcttcatgccactatattttgtctgcaacttcaaggagaactgtggaagtgtggattagtccattaagcgagttagctgcttgagtcatgaggtgttatggtgtactttacatcttataaagtcaatgaaaaaaataaggggcaattgcaaatttaccactgctttgaatcgttattgcaaggctaccactagaaaattgcaaaaatgccactagaactgtcattcaagtggcatccttacaaaattgaaaaaactggtggcaaatttgcaaatgccccaaaaaataaatgtttcaggattttcacttagttcaattaatcaatatgacctttagtgacactgaaatgttctttttttctctcactagttttgctatcttttcacactagtatatactttttaataaagtgttagttatgttatatgtatgccttttctcataaatgactgcaaaaaaaaaggtatgcaatgtccaaacaaaaatgtgaacaagaacacccccttgtcactttgcaataaataatctattttcatgtttaccacaggatgtgtactgaattagatatacaggtacacaagtccataatcatatttctttgctttcaatgtgcattcaaatttattgtagttgttttctttagtagcttcacttgtgccctacttgttattgttatcttccagtgtaaaactgagtgataatgtcttctgtaggttgttggtgcaaatggcatcgagcaaacagttgttagtggttcaatggaagtgctgaaaccttgttgggcagtagctacatctggtgtgccagtgcgggagcaactttttaatgtttctatctgccattacaacaatttcaatttgtttcatcatggtgacttttcaagaagttttgggaggacatttgatacaactggcttagaggtggcgactcctattctgctccagagagatgatggtcataaacacaggagaggaagccacggggatatcatctttcttacgagtcgtggggaggtcagcacatcactgtttttccttggaaattcctatcattaatgataattatacattgttgtccttgttccacatgtgcatttcttttcaactttccatacctccctcttgtaatctgcaatacactgactttctttattatcgtaggtgacctcgtactctccaggtctacttggtcatgatgcaatatggagatggcaactgtcaacaggtgcaacatggtccaaccttccgtctccatcagggatgatggaaaacattgtagttccaactttgaaggctttctctctgcgagcctatgacccaaaacaggtaatcatcgcgggtggtgatctggaggctgtggtgatttctccttctggtggtttattggcatccattgaactccctgcacctccaacccatgcgctggtacttgaagatttcaatggtgatggtttaactgatattattctggtaacatcggggggagtctatgggtttgtgcagacaagacatcctggggctcttttcttcagcacgcttgtgggttgcttgatagttgttatcggagtgatatttgtttcactgcacctcaactcctcgaacagcggtaaacctagggcttcaaccgactataggtgacgacattatgtcagtcgacagaattccttgtcaatattgaggtgttgttatagcatttgatttagatttttcatataatcaactgccaactgggttatgtaaacttgtgcggcgaatgcatttttggcgtaacatgttgtatgatttgggatgtatttctggcttagctcatatttaaagaggaataggcacttgccaccatgacatatcgtgctctgatccctaggacaataaccagtgatttttcgtgtggttttggatactatgtttggtggttatattattagtgtggttgtagttatcctgaaaccaagtagcagatggaacgaattaagatttttctaatggaagctatgagctttttattcattaattcttcccatcactcgtgtgctggatacacgtgagaacgctaaccatgaaaaaagaagggttaatttgatccatgaaggttccatttgctgcgttcatcaattccgttttgtgactatgttgatgctggctccatcaacatgaatgaatcatggctatggcaagtcagctacataatacgtactacgaagtactccctccattccaaaatacaatgcataaccacccataatccaaagaccaagaaataattatcatcttgtagtttggatcatcctaataaatacaatgcatatatccaatagaattagagaagaattagagaacatgagagtggatgatttaaaaaggtaataatttaatggagaaaggggtcatagttaattgcctacatgcatacatgccttatactattatggaacatctaaaaaaaagtggttgtgccttatattatgtaattatattatgtaatggagggagtagctatgtatccagtgccaataaaagcataataaggtaaaaaaaaattccagcacatgcctgttcaagaggaccatgatcgactggaacaagaatagcttttgcaaattgggctcatgctgatgaactagtctcagggaatatcaaactaacaaatttaatacctcatagtataatcacacgaaaccaaagatatatgagcaacagcatgaaggaacaaaaatattcactgggttactatggaatctgctcacagccataaaattaatcacagtgaattgttcggagacactgaagttcataatgaactgaaactcgaccaaatttctaaatcatcaattctaaccaaagtaaacataattaaaatggaaaagccgttctagaattgttggttacaagtcgtaactccaaagatcatgcgtgattcgaatgcatcaaggtttgatatttttcaacggaaagttagctgaaatctcaggagagtgaactccaagataaagctggcacagatagcatgaatgtcaggcagcttggaaacaccatccataatcaactgatagacgagaagggataatcacttggtacattccaaccacataactgagtttattttgagttgtcacagagaagaatgaacatagtcagctagtcatagctgctattttagtaattttgatatcgaagttgaggaacttattctgtaataacaataataatagcatacatagtacaaaaaaaatgagacaaatcattagcgctatcagttatcaaggaacatgctactttacaatttccaataattactgaaccgaatgcaaactgtgtagctggtgttgtcaaacatggtaactcgaacattgtcatcaacggtgaaatatagagggacagggactcacagttgacgatgacgacgacgatgatataaacatgtccagcggcttttagcaacttagtaaagggtgattgacagatccaggcgcatgagaagtgaggctgtgtgaaccatgtacagggttgggacatactgaaacgtatgtcctccagcaagtaggcagagctcgatgggtgtagaatatatggagtaagacgtactatagttgttgtctttggttagcaaagaagtcgaagaggttgaggcgcctcccttggatcttgtttgcaatgctcagcctggtgctggtgctgctgtttcttgtgagaggagtgagatggaatcggagcgtgcctgtatcgaggctcctaatctgaggcgaggagcagtgaacactgcgactgcggccgaggcggtagagtctcttgaacaaagaggactgacgtggggcagcagcagcagcatggatagaagaagaatccccccccaaggatatctcggagtccattccggcagaagagacggaggcggctttggttgggacggcggggcgagagcgggcgtgcctccaagactcggatagggatctcctgagcatctgggcaggcctggtgacgaagcccctggccctgatgatggggttggaattgggcgggggggcatcggctgagccgtcccatgactggcgggagtcggcagtggcgtcgcagcagacgatccactcgcaggattgacggagggagcgcttgcgctgcagctggcgaccttgctcgtcttcctggtccacccggacttgctgcccttggtcttcctggtcgtcgtcgagctggaagaggtagaggagcgtagtccgaaccctgggctgagggatttcggtggagatctctgcggctgcggctactggggacggggaggggaagcagcgcgcaggcgcagtggagagcctctcgagcaggcaggcggagcagaatcccgtgaaggggggctgcgacgggtgcttcgggcaccggctcgacggcacatcgccattgtgattcatcgactccaagccgtaggcgtaggtagggtgggggatctgcggtgaggtttgactagggttttgaccaacttctcttgatttggggaagactagaggaagaggaggaggaagacgaccccaccccaccccacccagagagccgttgcctgccttcgtgggtctctttgtcttttctgcctttgattgagtactcctacaagacaccgccacctggaccccacctctctttttctttctccctcccatttttttaaggaaaaattacgaattaccccccgaagtatcgtggtcatccaaattacacccctgaatcataaaaccggacattcttcacccccaactatgtaaaccggatgaattatccccctcaacccaatccgcggtggttttgatctacgtggcagtgcagtcagcaattttttttattaaaaaataggtaggccccacctatcagtttctctctctcttctatctctctctctcctccttcagacggcgacagcggaggcagcaagcgcggcgaggcgagcggcaggggcggaggaggaggcagggcggcgcaggggcaggcacgagcggcggctgggtgctgagcggtggcggcgggggcggaggaggcgaggcggtagcggctgggtgcccacgaccttttgtgcccacatcccccttcgcgtccccgccgcctccgaaggtttcctcaccggcgccgactacgccatcgccgtcgcggacttcgccattcccaaggtctccgtccccgtcaggctggtgctccaattggaggatcttgtgcatgtagtgccatgccgtgcgctggaggagctcgctgccacggccgctggcggcatgctgcaacacccggaagcacgtgttgacaacgttgcagacgacgtggtcgtaagacaggagcggagcagcggtggaggaggatggcctcctcggcacccgggtgggaaaggggagagaagccgccgccgctcgcacccgtccctgcgccgccctgcctcgccgccactggtgcctgcccctgcgccaccctgcctcctccttcgccgctgcctcgcctcctccgcccccaccactcacctcgccgccgcgctcgcctctccgccgccgcctcgcctcctctgcccccgccgctcgcctatccaccgcgctcgcctctccgctgccgcgccgcactagcctcctcctccgccgccgccgcctcgcctcgccacgctcactacctccgctgtcgccgtctaaaggaggagagagagagagatagaagagatagaagagagagagaaactgacaggtggggcccacctattttttaataaataaattgctgattggactgccacgtagaccaaaaccaccgcggattaggttgagaggggtaattcgtccggtttgcatggttgggggtaaagaatgtccggttttgtggttcagggatgtaattcgaatgaccgctatacttcagacaggtaattcgtactttttcttttttataataaaactcagcttcaagcccgaaaatactaaggagccccacgttcggttgaaaaaacaacttactagtattagccgcgcacaaaacaaaaaaataatatgattatcgtataattaattaacgcaaaatctaacagagttaactagtgacgtgttggtgggccgtcacaaatcgtgtgattattacacatatggatatggacacaggtaaagataaagcctgcaaccggataagtacagacgtggagatactacaggaaacaaacctacggaatacaatatattgttttcttttttttgcggtaatcgttatgttatttttgtttcatataagaagtaattcttcacgatattagaagtaactaaactgttttagggaaatacctatgaaaaaatagaagtaactcttaacggtgtaagagacgactagactactagaaaagtaactcataaaaatatatagaagtaatttcttcatgatattagaagtaactactttgctacatgtaaataactctttacggtatattaaaagtatattgttatagggaagtaactatattgctatagaaaaataattcttcacggtatttgaaataactatgttgttacataagttaagaacaaaaatagaaattcaaaataattttgaatatattaaatatttgacttgttttgtcacatatttcgagtaaagtacgatggttcaaatggatctttaaaataatatatggttttaaaaaaataagtggttttataaaaagaatactaattagtttcttgtattataatgcaatggtgcatgaatgccttctattagaatttggaaggatgtacgtaggagagagagggggggtacatacactaccagaaaccggattaggcctgacggccaattattttactgacgtgtacaatggtttctatcgcgaaaaaactaattttcctgacgagcatataccaacatcagaaaaatagaattttcttgacctcgattgagtgcgagactccaaaattagtactaagtttcttacctagtcttttggccatgcaaactccacaaattaatacttttgtgttatgttcaaatagtgaactggaactacattatactgttacgagggatctatgtgtagcacttgatccataagttaatgaaatattgaacttgaactggaggtgtctatgtgatccatgatgaatactggaaatgagtatttttgctaatgtggtgtgtatatttgattcatgcctacgttctggtaggttttctcctaatgatttgtggctagttgtctaattgtcagggaaatatattttcctgacggtcataaccatcagaaaaaaaccacagcaaaactgtgataggggagaccatcagcgatagatgaatatcactgactgctcacatcaacatcgggaaaactatccctgacctgagtacacgtcaggaaaattaatcctgacgcgcctccgtcacccaaatttatttttctctgacaagctagtcctgacggaattttcctgacgttgacacgtcacaaacaattttcctaacgtgtttttgttttatcctgacggtttttagccgtcataagtaatctagtttctggtagtgacgatcctatttttggtaaataacatgggttttgcttagtactaataagtgtatttgcacatttctttttttaagcaagacacactcacttgagggaaggaccacacctgttttttttttttgaaaagaagtgtatagctggttagcgctattgcgctagcacgcgttgttagtgtccattaattaagcactaattattaatttttttaaataaatttatttggttttttaaagcaactttctttagaaaacaaaatattgcggtagctagtggttaatgttgttatttaggttgcgaactcgttgtgtttaggtttttaattttttttcataattaatgtactcccaatcacaaataattaagtaatgtttgaagatatatacatgcaatcaatatatatattgaaacactaacaatcgatttctcttttaaatatttcgattcacttttgtaagtgaatgtttagatttgtcttaaaaacaagtttcattatattacaactttgttatatttttattggttttttgtgagtaattaatagtcaatctaatgtattagtgtcgaccgtacgtgttgcttatgtggccttattcaaatatctaatttaatgcaaggcaaaaccgccgtgactttcaaaaatagttcattgccctaccgatgataatataggttgatatgtatgtatggttgatgctattacacatgcatgtcagatatatctgcagagatagatagatggatatggagttaattgaactcatgagagaacaaaacccaacatgtatattttgcattgctcactccatgattttttcttttaaaacaatgcaggggatgaaaacccctccatctcaaaatataagcatttttaggtcttaatatggtcttcgaaatactactttgactaacaatatctataaatgtaggatattttaaataaaaagagttacatattatgatagttcgtttaatgatagatatagtgacatcaaatttacatgattaatatttttaaaatttttactattaatagttaaaatttagatagtttgacttgctactattctaaaaatgattatattttaggacggagggaatagcttataattatacaagagaacaaactacaaagattaatgaatgtttatggtaataattaattaattagccccttcctccgatccataactaattaaggggcgggggataaattgttggatcgcgcgctccatgaattggaggccaaatagacaagatacatatacaaacacattggttgcaaacagaaaaacacaggtgactagttggctagcgtcgttggttttaattgccagtgttccagcacaatcggttcgtatttgcgctgctcctatacggatctcacagagaatcaagtggcttaaaaatcgattgtaaccagggcaaatatatgtcgacataaatttagcaaaaccgaacaccgtttgatacacaacacatgcatacatgcatgtaccgtaccgatggatgtgggtgcggtacttagctactcctagagagcaacaaattaattagaggcccgcccaattaagcttgagctatatacatatagtcatcgatggaatgaagtatagtaggtagcaagcagaggtcggtcttgcgactgaattgaacacatacacatatatatatatatatatatatatatatatatagggaattactagcatgctaaattggtaatgctagctaaattggtagtatataattaagctataggtgggagatagcaatgcaagtagacagtagtagcagctagattaattaattagaagaaggcgagcctaagctcaaggtcgagaccggcgtcggcgtcggcgtcggcgtcagctggagggcggggcaagtgcggcggtgagctgctgctggcaccgtcgtgtggaggaggaggagggtagttgaggttgggaagaagaggcggcgtcgacttggtggagggggaggcgatcagagctgcatcaggttgatgggtgagcctgagcctggctctgtccctccgatggacgttcatgtggccgccgagggcctgcgccgaccggaactccctcctgcagaagccgcaagggtacgacctcgccttcttcgcctgcaggatcagctgctgctgtctccatgcctcctccctcctactactgccgctgctgttattcatcccctctctctctctctctctctctctcgctctcgctctggatatcaatagctactacttagaggcctacaactcgctgctgctagctagcttatatatatatgcagtcaggcagacaacaccatcggtcgatcgatcgatctcctaattccttctctatgactaactagctctctctctctctctctctctctctctcgtattcgtatagctctagcacggaaatgcacacagctgagctgactgacacagatgaacagcacgcaccactgtacatcatgccctaactactgtagctaacagaacaggtgctactactagtagttgaattgcactgtttttgtgctggatatgcatgccttgaccggcccattcttgtgctactactggttcgctcttgctcgcttcaattcttccgatccaccatggatcgcctcggtaatgtgcgtctcgatcgccatgcatgcacgcactttactttgtcaaaccttgtgcagtgaaatctttccttgtatactccaacaaactgaggcttcccgtccatgaccatcttttttttcttgaactactcgcactaggcagtgtgaagttcatattgatatgtagagcaataaaaaggaacaaaattataatcctggaatatcgtaaccagtgaaaaggaaaaaaataataccaccacccacacaccgacagctctaacatacagacccataagaaggctagcaccggaccggccgccgctaaacgtgaccaaccgccgctaggccaacaaaggaactacagtcgagatcacccaaaactcaatccttaaaaccgacatgaaaccctgctctatccacatctttaggattgagagagagagagagggggtgagagagaagaatggaaccgctctcctcctaggccctccgatatggccaacttgtcgaaactaggacgctaacacaagatgacgtgaatctagagcaagcttgctttagttgtttgggaggttttgacaaggggttgtctagacgagtctccaaggagagaagcgacggagcactgccgccgtcgtccgctagaggggaagtgacgctcgctcgagtggccattcatcaccacctaattttagccgagaaaaaagagttagccaaaattagtttaatttgtattaattcttgaagaaaaaccggtggcacggaaaagagagtagggttgaagaaatactaatttttacactaataagagagttgtttttcctcgatctgtagtgctcccgtcacagccacgttcagttccgtgagttgggatggaggagaaagactaattttcccttgctccttggcacctatgacttgtttcatcaatggatagatttctgcatacacacgaatggcaacaactcgatttatattggtctgtaatatcgatcatacaccatgtatagcattatttatttttatcattaacaaaactccactatgtggtactgtggtgtttttatcgttaattatacattaacatgcctggagttgccacaaattaaacaaacgatccaaactaattatattatacatatataattgatcaagtcgactccagttcccgggcaaaactttgttccggtatgtgcagggctatagaaggatgattaattattttcttattactacataagcagctagtgctccgttcctcagctggccactcaggtcaggtgtagttctggataatcttggagagggatgagtatgtccccacgcaagcgcagcaaacccctaccacgatgatgaatgagcaagctgcaatctgtaaatcaaagccacaatacaatgtacagtgaattaatacatcgctcatttctctccctattattacacattttcatttccatatttttgtacctgatgccaagtcacttttctcttaaggatggccaagaaacaggcgcatggaaggatgtaggtctacaaccgaaaacatgttttagcctcaccaattaaaccgtaaaaacaaactctcgtatatcatctgtggtaaaccgtaaaaacttaccacaagcatggtgagtaaagaaccaaccaacgccataactagccctgtcaaagcttaagaacagatgttatgccgctattcaatttgtcaacgactggtaaccaacaggaaaaaaaaagaatgaacataccaaagaaggggacagatagagcaatgaggagggttgagaccaccagggaggatctaagcatgattatgttcgcatacttctgctgatttggaggcagcaattcttccaaactcatagccaatggggttatggtcaatgcatatgtgattatttgttaagggtatcccagatcgaagagccatatccacaatagtttcagtcatgtaaagtatgatatgaataattgtagtttgagaatttcgtaaagcacgatataagaccatagaggtcaagcaggatcctaacttattcgacggtgatcaatttaattatagtaacacaccaacattgatattgtttagatgcagcataatacctcttgtcatcaaatatttaactgaaaccatgcatattgcaagctagagggtgcttagtaattaggccaatttctagtatcctgaaaattatagctgctataaagtgtgtatttcatttgcacaaatagctacagaaatataactattctaggttaatttgttttgatattagatctcattaaagaaatctgatgcaccaaggatatttggttattggatttgccacctgcaacaaagtcaagaacttactattagcaacaggattgagcataaaggcaggtatctatctataaaagatactccatctgttttcaagtagatgatgttctagatatgcgtacagtcaacccttgaaatcttaactcaccaaatagtgaaaaaaatattaagactttatatgtgaaaatgactttagtatatctgtcatgaaaaatacttccatgtagttatattttttattaacttttacgaatatgtgagtgcaagaagtaatgaccaaacatgtgcattggagaatgtttcaatgtcctgaatgggatctagagaagagcggaggtagtaactgtttcaattagatgaaagatagaaaaaatatctttttagctaatcattatggtgatataactatatagtattgtatatgcacagtatcgtgattgtttacatagacaggaacagaaccgtgctccatttattcatggcatgattatcccaggtaataagcaaacataagtttctgacccatttgtatggttatagcatagtaattaaaggaaatgtttgaaagagttttggcattaccgtggtccagacagcaacctttgaaaccaccaaattctctggtaagttcagcgtgaactgagattcagtggactcaccaaacatcttatatcccatcacagcagcaccggcaaacaaaattgaggacaacccaatactgataagaaacagaagccaaatcttgagtactgcatttgtaatcgaaattatggaatatggactgtatcgattgttccaagttagttaattaccaagtgaaaagaatagaaggaaactggttgcgattcttcagagaagaatagatgttcgggaacacaccatgtcctgagtagcaataaccatacagtccaattgcgatgggaattcctgggagattcagtgcagtccctttgttctcaaaaccaacatggtcaacaaccccaacccagcataggcagacaactacaaggattgatgcaatgacacccccagctacaaacacaacaacatcatgagacgatgtgcagtacatacataaggcacaacaaataacgtgcatgttatttaaacaactctagacccagtaagatgaacagaagaagcaaggaaatgcaaacctgaaagataactcagacagctaaggtcgcggagccaagtggttggcatgactatgagggtggtcaagattgcgaagaacacatgagagtttagtgtcatgctcccaatggttagatgtgcattggggaataactttgacaaattgtcgctctccaatatcaaatactcaatgcaacaggcctgaaacagtacatcagggtcaattaacatgttgtgaaaatgctttaaatagtattactattcagaaggaaataaaaaaatatattatgtttccgtggcaactcttcacaacctaaactgagctaactcatacgtattgcatggttaagttaggtaaatgtattgcattataatctcaagatctaagtaactaaaggtaggtattattttggttctgttttaaagcatagaaatttcaactgaaataaattattattgaagcatgtgacactattatcaatgagcttgaatacatgagaggtcatatcagagttgcaaataatctaatagtgtggtgggctggtggccttgtacttatcagaggcacgtgtgtgactatgtgttttgtcccggatatgaagttgatgtgtgttaattgtatgaattcattccctggggactagcacgtagcaatttcgattgaaaatggcttattagtaataagtacttacatacagttcgatgtacaggattatctgtagatagtggagccacatacaaggaaaaagggttagcacaagagcagtcatttttgcataacctgaagcatacagttgaaatatcatcatctacaagagattttaccgagattgctatacgtccagtggtgccaaaggcggcatgaccaatatcagggtatgtctcaagaccctccttgctgtccagacaacgtcgaaggagcactccggtgtaccaagcgagcacagcaaataagcaaagtatcaccagtccaagccagcctccctgtttaatggcatatggagtcgataggatccccacaccacacagaacatttattcctgcataataggaaaaaatcccctagactaagtaataatacgtaggtatttggaaaaaaaaaagttaagttatttgtcctgagtaaagcaaacagatcaatttcttgggttaagaagaattagataaaaatagagagattggtacttgtacattttattttggatgaagtatttctgcatataatttgataataattatatgggtttgtcttgaagcaaaagtacagcctgcagatctatctacttgctgtttgtgacaactgtcacatggtggggtgactcaaccatgtgatgtccctattgatgccaagaacaagaagaaaagttgaactggtggacctgtgatgcggcgtatcaacaaagagaatagaccattttcaggacaacatgattgaccatttgatgtacttgatgtttgcacttaaactgataaccgctgggctaatctgggctccagatgtttgctgaactaactaatgttttgcatttcgctaaaaaaaaactaaaggtttgggtcttctatcaatgctggtatatcaaataaaatgaaacagcatgtaaagctagtataactactagttcaaaacagtgtgatctcaaattctcaatccagatccttagaaattcatgctctgattgtttggactggtctgagcatcaatacactgaacttggacatgctggtctgtgggagcgtgtccaggttcaccaaatctgattgtgtattcatcaatgctacgtactccatatgacaaggatattctgtggtgccaataagtgagggggtcctatttctcatgttctacttcacagtagaagcaaaacgacttccagaaagtcatatgcaagcaaattatggttggatctataaattggtttacgagaagcaacatatatatctagtatcaatcattgcaggataaataacattctagtatttcccttccataaaggaaaaaaaagaaatgatatcatcattaattaaaattggtagacatgcgtaccattcatcactgcctgggtgtaggagcattgttgataagccggcacctcatgagccggcaccaatggtttttgatcctccgggatctgttgcaaagacggttttcttgagggaagcaggtactgggaactcttacgggtatcatcgtcatgctgctgctgctgctgctggtcgtcgcttgaagatgatgggcgtagaagtggcttgacaagattagagagaatttcaggggttttgccacgaaaagagttggtgaggaatgagttggagagcctgcttagagttggagttcccaaaaagctcaggttgggagactgcacgctactataaatgtcgattgattgcctgttaacatagaagtaagagagaagagttactccatttttatttttagtttagtttagtttgaataagatgagatgagcaagggaggttggcatctagtagtcctatagtatgtggactgtttctcttttagatgaacttatttaaattggaagaatgaggatacagagacagatacagattaattgatgggaggataaaaagagaagaaacaaatctgaattttggcaggaagggaggggaagggacctgtagctttgcggccattggtgggtggcgtaggagcttgggcgcggggtagcgcaggaggagtcgtcggagtcggagtcggagtcggcatccttgaggaggatggaggagtgggggtgggcttcctcgtcctcctcctcctcctcgctctcgatgaggaagctgttgctgccgcgctcctcctctgacgcataacgagaagaagagttgttcatctcgtgggatctcatctcttctcttggaatctcctctcctctcttgggctctgcaagtctgcaactgcagtcctcctcctatacaagattagtagcagtacaagaacaagagctgtgtgtactgatcaatgttagagataatgccaagacctgattaggattaaattagttctcctctctctctctctctctctctcactgtcgcacacacacttttagccccagctgatgcaagggagaaggaaccattggatgactccacacatgcatactatacgattggagtagacaacaagtgcatgattaaggctgtgttcgcacataggtgttcccaacttgcacagtaaacacagaaaacggagcggttcattagcacgtgattaattaagtatttactatttatttttcaaaaatagattaatttgatttttttaagcaacttccgtatagaaactttttttaaaaaacacaccgtttagcagtttgaaaagcgtacgcgcggaaaatgagagagataggttgggaaaaaggggttgcaaacacaccctaaataaattgatgccgtccgtcatcaacgtcatgattccctcacacattactctccttcgcctctatgacgatgattccctttctattattcataaccatattccccttcattctccaattcaactttaaataaacacaagacattactactagtcctagcagcttacatgtcaaattttgctgcatatggttgccgcaacaagcaatttttactgctgcttttctcctaattccaaaaccatatcattggatgcgccatgttcccgggatcacatcaccatcggatccggatcggatctgatgccgttttcaaccaaagattcaaaactgtagtactatactaggggtgtgtttagttcacgctaaaattaaaagtttggttgaaattagaacgatgtgacagaaaagttaaaattttgcgtgtaggaaagctttgatgtgatgaaaaagttgaaaattccaagaaaaagtttggaaaactaaacacggcctggttctctttttctgtttgagagagagagaataacttattgatgagcactgatgaggactcaaatttgacactctcaccctttcatacaaaactaatttcacatttgacgaaaactaaccctcacctcattaccaggatccttcgtcccaaaacaaactaatgtaatacgggatgtgacacattctagattcgtaatattagaatatgtcacgtcacgtactaagtagatttatttattttaggatgaaggaaatgcgtgtttataagtttttgatgggcctatatctaacaaaaagaatatcaagagattcagcgactctgccagatttgtgttcgagccctcgtcccctttcttcttcattcgtttttttatctcctgggaggaggatacacagcactacgttcactttcttatgttttaggcctattaattaaaatattaagattaaattgcaccttggacgagctattattatcaagttttatcctaaaccaatctacacttaatgtttccttttttttaccatgattctattgcttactgggctacccttctcttcacccatctgttgaccaaaactcaccacacacacgaaggcctgagatgtctgcttagatttagtgcaagtcctatcaaatcgggtttaggacatgctagttaatttgatcctataactaataagatagaaaaaaaaaagattagatcgtggggccaattgaccatagggccaatatattatcgtaagcccaaccgatgccgatggaatttcggatcgatcgctataacaacattgaccgaaacttagatataatatatttgtaaatcatctaactttattatagccaatcttaatagaccggaccaaaccgacacaatataagattgaaagtaacaaaattgaatctaaaaaatatatatatcttcgagatgcatgccgatgtgccaataatcaattaagacttatcattgctctatctgaagaaaataaactaacatcggatatgacaacttaaaatataatcaccaacaatttagggttattaaccaaaatctagatagatcgtacccaactgtgacaatataagattgaagataataaaacatcagctagccaattatactaaatcttgtggatcaaccattatggcagattaaattatggtaagctgataattcatcagctaaaactccgatggaaaaatgattaaaaatctattggcttgagcaaatctaaccagcaaattataacctagaagattgaacttaaccaagatagttcaaaattaatggtgagcttgatagatttaaaccaaccaattggtaatactcagtgtgattgatatattgaatctaactaagacaacaaagcaatctaagaaagaatcgatagatcacataggcaacacaagtaaaagcttaactagtatatcgcacttaaccaagaaagtactaattccgccaatacaagcgaagttgatgatacttactttctcgctagagatcaaaactaatgcagcccaaacttgaaaacaaaaactcatcgaaactagaaagttgtatattgaaccgttgttaaattaaaaggaccttaggtgtacatatttatacccataggttagatcaagtccaattctactacagttagatcagcttaggactctatcccaaataaggaaactacatgatacaattccgactcagacatgactctgatcggcaaactagctaagtccgaatccaacacgagtccatcagctcataactctgtccatagaaaatagaaaccaaaataaacgttccttataacggaacgagataaatttaccaaccaaatctacgaaaatcatggtgttaattctctattttgattcagtattggctaacgaaaatggccaaatttcaccgttaacaccactgttggctggccgcacctacctctggcttcgacaacatcgacgcgttgaaagttactttcctcagcttcaggggcacgtgtgtgtaacccttttgtatcctcggcctttagctgggacgagatcggatctaagcaacacaattaaatatctcgtgtactggtctactaggcatcgggtgctcctgcttgaagatgctacgacattattgtggtgccgcctttggtgccttgtctacatggtaggaatggacaccaacaatgagaaagaactaaggaaggatggcaaggaagcattgatggccactgcgtacaaaggtttgatatggggagtgggtatcaaacgagtaggtcaagaggaagggcagaaggtcgcccaatattcaacataaggtaaaagatcatagtttaaagtgaaaatattatgtatgacttggttcacgataagattttagttatagtccaaagtacaatttactcaaataacattgactggcattcttggtgtttcgtggtcaggagtacgaaacaacgtgataacattggcaatgaggtattggatgtcaatgccaagatctttctgtgttgaggtatatgtccattttgtttttgttagagtttgtttttatcgagatctatttcgaaaacaactttcttaagaaagaaaagagcagtgtcccctagaaatttgagtgatgtggtcaggtcagagcgcgcaaagcccaaatgaaagcccacaacctggatctggaatgtactccagtattgttttgttgggtcggcggcggcgggtgagagtggagaatgatgatggctctccgccgcgccgtcggaattggctccgccgccgccctccgctctgccgcctacctccgccgcgcctccccctcgccggcgcggccccatcccctcgtccctccaccgcctgccgcccgaaccttcgccgccccgccccaggtatcgtatcaatggatccccttcaccctcgaatcttaactagtctagtctagtgtagtgtactactatactccctaactactaagtatcttgttgttgtattacaaggtgatgaagaggagcaccaaggacgacgacgacgatggccctcggatcaacaacgacatcacctctccctttgttcgactcgtcactgaccaaggtacggtaccccctctcccgtctacccttgtcctcaccgcatgctctctcactttttgctcatttttgcaggccatagtgttgtccccaggcacgaagctcttcagcttgcggccaggatggacttggacttggtcgaggtacttactgccctctatctgctttcttcttgtaaccaaaccaacctaaacatactagtatttcaattgccatcaccatgtcaaatccatttctttgtttatctatctgtgactctttcatcattcctttttacacgatttaagatgttcatggatgatactgacagtggatataaacaaccaaaccgattcacttgtatttccctctacaacatatctgaccatttgccacatttcttgagatttgcccaatgttcattaccgtttctcttttattcaggtccacagaaaatcagaccctcctgtctgtaaaatcatggattttcacaaagagaagtataagaaagacgttaaggagaaagaacgcctaaaaactaaggtatacttacttcctggctcagttttcttaactatccattgatcactcattcgaccaaggcgatcaacgtacaaggtttgccttcttgtgagaaggtgatggtggtttaaaagacctgtgttatgttatgtagctgtatggatcaaatgcccaacatactgctcaatattgatgctcctggttaatttaatcatcctaccattgggaaagactgttaaccatatcgtccctgcttgtgtttggatctgacaggctataacatatatctccttgtgttgttctggttttgtgcagtctgctattgtcttacgcggtggggagaacaaagaagtgcggtttaagggtaaaacagtaagtggttttttcttgctttagtttgtttattgcagcctatcatcttggctgcaatagattgctgatctggtaactggtatgatatggtcgtatggagtatctagttggcctatcatacttggttttgtccaaggcatttttttttcagtttgtttggatccatatgaacggtgcctagtttgtttggacttctctagtctttctgtttaaattattgaacctttctatggaagtatcaaagagtccaaattatttcaaagtttcttttgcagttacgtttgagaaattgttggtatgaaggcctaacttggaaggttgctgatgaacataaattgttacatgtaggaactaaaagacttgaaggtgaaagcagatggaatcaccagattaatggagcgaggttacagggtgaaggtcagcttacattccatttccctttcttgcttgtaccactgtagaaaaggtcactttgtacaggcacgtaaccgactggttgcacgtatgtgagtagtaaagcaacccgaataagtgaatcatgacggattttaggtgtgtgaaatgttgaaatggcctgctagcctgatcaagtggccgattgccatataatcacagagttaagatgcttaattctcatattgagcctagcagtccaactaggataatccgtatataatatctatactgcttccatcatcttatgagggtaaccacatgagtagtacaaatatgctttttaataattacaattgaatgtgttcaaatgtctctaagagcaaacaagcaccaagtatatagattcattagcatgaacattaaattatccatataattctgaatagtcatctgtattccgacttatcacttgatggtaccttgtccatccgatacgcgtatccagacttatacaacactggtttgtacagctctgccaatatttagtgacaattcatgcagtttctgttagcatcatcttatgctttgctttgtctttttttactatcatttactccctccttcccaaattgatcatcatctaatggacttcaaaatttctcaaattgatcatcatataaccgcatggacatggatttcatcataatacaattaatgcagcatgagagaatgtgtgcatgctaaggtgtaattggcatggtgttttgatcgatgcatgcattgtgggagaatgtgtgcatggttgtcttgattgatgtgatttaaattatccttggtcttggtgcataaacatatactccctccatcccataatataacgcatggtaaaagttacacggtctccaaaactaatctttaacttataatttctcatatgctataaggtttgtagcaacaaaattataatcatatgaaagtaaatttaaatgtcaatctaatgatataatttttaacaaataaaattcatttcatattatattaaatgttggtcaaatgttttaaaggttgaatcttgaaatacgtgcacaccttatattatgggatggagggagtatgatgatcattttgggaaggagggagtatataattactttttgtcatcagaggcaacagctgtcggttttctagtcaaatattgctttgtaattttcagtagacgattatctgagaaaaatatgccaaatgatgggaaatgatgagggagctttgctgaagagtagcgattcttaagtacattgttctccatctaatatgtcacactattgcattttgacactagagagttgctccactggtcatgtttgcttagatattgccaccaggaatgtggtaggtggtgcaaaatgcacaagctgtaaatctcacatgaaaaatcaatggtttgggtttgggtgaagaggtcgtaccaggtggtagagatcatccaggttgagaggatggcagctgtagaagttatgtcgtttgcagacttttacctgtttcagtaatagatgcatgatttgttttggagtagaacttatgtctttgttgagtgtagatcaaattcctaaccggactgttattgatggtgtgatggtcatgtactcatgttatgcaatggttctaggaatccagatataaattttatttacttttctatttggatgatactgtgtttgcatgtaacagtattttctgtatgttctttctttttcttgtataaaccagtaacaggcacaagaactacaaattcaggagaactttcttcctcttcttaggaaaaggccctgctgtctcttgtctagtttgatcaagaacaatagcagttggaattgaactgaacatggagaattataagaaagttttttttttctttggtctctatttcaagcaatgagaacctgaaggattttggtctaatttttgcctgatttactatattagcgcattctgtgcaactgtcaccaacattcatatatccaattttaacttgaacttcagttctgaatcagttaatttcagctgtcttttattgtaatttttgtgcatgttcatatgcatatgcatttatttgttataaggtcttgaatacaaactctaaaattattttaaatgtgttcctatttggcagtgcatggcgatgccctcaggtaatgaagaagaagatttaggagggccactatctcggttgttaggacttgtgagtgctctgctccttattattttcatgttgcttgcaaccaatgtcagcaaattctgtttgacaactgtttgatgtcctggttacattttcggagctgtccgtaaaatgatctttttatatgatgtcgtaaattgaacagatacaagatgtctgcatagtggaaagtggcccacatttggactcgaagcatgcatacgttattgttaggcatgtgaagtttgcaacaaagaaagctggaaagaaagctagcaaggccatagaagatgtaggcaaaggtgcccgcaagaatgcctctgaattgtcaactgttactgccgatagtggagatgagacaaatgattgtggaaatggggccatctcagatcaaatggacaacgctcctgcttacgtctccaatgaattttccatgcagaaagatgcacatgatagaggctctagaagggagttgagttggtcgaaatcgaacccgggcaactacggtgaaaacatgcaaaatgttgatgctggggcacacagaattagctctagtcagcgggcagcacaaacctcagagggtgggtttggttccaataatgtaaaatctggtatggaaaagcaagaaaaggctaatgaagatgtggtacctgcagaaaccaacagatacgccagccgaagacagcagataagaggagataaccagggtttgagccaagatagatccccgcaaggtcatagaaggaatgaaaatgaagttcgctatccggtcaatgactaccaaagacctctgcagcagaacaaccgacaatcaccaaggttcaacgatggtagattaccacaagaaccaagaagaaatgaaaggggaggccatattccgttgaataacaaacaaggccaatttcagcaaatgaatcatcctgctgaatcagcgggtaatggtgcaggctatcctactccgacggccaagagttttggagttttcagtaccagaaaacctgctacgtctgagttggggaaaacaaatggtgctagtaggactgctaattctgatgtacctaaaagctatggaatctttagttctcctagaagggaatctggtgataaaagctcatgaatgaaactatcagcagataagcctataaacagcaggtctacatcaaagtttgtcgtatttggaattggcacaataagcctcgaaatgtaaggatcagcatgtgggtctcatgtttcagtttttgttgatcattgactattattcattcagcctgagcatatctacgtggcggtggcacggtgagaaagccaactgcaagcttgagaggtactgtactactcctatttgttaagtagcttttgggtccacttgtattgttatcatttgattggaagaatcacacctgtttagactagaatagcccttttacttgtcaggttgatcgaatagtgaaaaataatgtcatgagtggtcggatccatttgattgtgatagcattttttactacatccatcccaaaataagtgcagccgtggatatccgtgcctaacgtttgaccgtccgtcttaccgccataccgcaatagtgttgaggcgggtgtgcagcgccttagctcgccataccgcctaataaacttgatcttaatagatcaattgttgatcaaaaccttattccaatataacaaaatacactttatattttaaaacggggaagtactccattttaaacaaactcatgaggtaatatagatttgctcctatattttacagttccaaaataaacaatgataagaagaagaatagagtaatatagttgttagatgattgttttggtttgtaatttaggagaaatatatgtgatggtgtcatgctaaaatggccaaaatgtgattccgtaaatggggttggctcatcatcaaatggtgcctaaatggcacttggtcagtttctaattgacttgcttaattttgttcttttctcaatgtgaacggatgaaattgaccttttgggctgtgaatagaaacggtgagcagctccactccagcacaggtgccgagcatgagcagccgtgtttagttacaaaatatttcttcaaacttttaactttttcatcacatcaaaacttttctacatacgtaaacttttaacttttccgtcacatcgttttaattttaaccaaacttttaatgttagtatgaactaaacacagctagctagagcgaggcggccttgcattgttctcagtcacggtcggtcggtagcagcgacagcgagcttaattaattggtggtgatctcgatcggcatcggcggtgacactttgactccccgcaccgctagctggccggagctccacctcccccggcgatgatgcctcgtggatagcggccggagataacctcgtggcttcagctctactacttcttaactgatactaatgcttattcttttaactatatccaaactagcgagtttagtacatgttattattatgttaatatatatcaataaaatatcaaacttaaaattataaaggtgatatagacgagatagagcgagctcggtcgtaagcaaaatcgaccttgaccttttaaactcaataagattacgagtcgagacaagctggctctctaagataacgagtttaaatgagctgagctagtacctaagtcttattttatcccccaactataaaaaaaacactctttttttctcttcaaacggtttggatgatatatagatttatcctacgtggcaagttaacctagttttcatctgatgtggctcttcaatggtattacatttggaaagaaaaatagaaaatacaatgggacccacttatcactctccatcctcttctttctcttttcacctctccactcttaagctgtgttcatttggtggggttggaaacccctccactcttcatgcaaaacaaaacgatggattaacattattaattactaggtattagcttaaaaaattgaaaaataaattaatatgatttttaaagcaatttttctgtagatttttttttcaaaaacacacacctttaatagttcggaggagtgcgcgtgggaaacgagggagtggaggttaggaaccttgagttaagaacacaaccttatttctcatgtgcatgcttcctaaattgctaaacagtgtttttttaataaaaaaagaatgtacgaaaattgttttttaaaaaatcatattggggtttaggtaatcctatttattaagtttttttaagctaatacttaattaatcacatgctaatttaccgctttattttcggtgcgtggaggattagtttccaaccaacgctaaagaacacaggcttagtctcttctggtcaatggtggtagtactcaagtctctttctcggtccgttctttgactatcgtggtccctacagtgctctgagcagctgatggaatggaaccctcattcctacttcaactatagactcccttcacctattgaggccagggccgtctccagtactttggggcaccaggttgaaatacaaattgaggccctataatttttttaaaaaaagcatgtctaatataaacaaaacatattttcgctcaattatgtagatgcaatatgtgctataatgtacactattttaaaatatattatgataatcatactaaaagagcgaagaggtaaggaaggcaggagccaggagcccaggaggcagctgcacactgcagagctgctcggagactagaatctacggccatcgcgctgccactcagagtcgcaagttgtatcgtcgcctcgctggtcaccgcggcatggaattgggatcgacaatctcgtctcattctcgtagcagccacaacgcacgcaatcacagaattaggatcgatgcgatgatgttgcagtgtcgtacgcgtggccacctgggcttggcgatttgccttgcatgctatagttgtgggcaatagactatagtccttcatcttcacatgggcccaaaaaaaatcatagaccctatgcggtcgtctatttggctcttgggcatcaacgggtctgattgaggctattggtgccagtgtgattgacgtcaagacattgaaactcggttctaataatcttgacgtcgagaaaaatagtttatttctaagtaagttttttataaaggtatatttgtaaaataaatttttaaagagctaaaacataaagaaaaacaatgacgccccagggcagccaaaaggactacgaaaggtggctgcggcgtctgaggctgttatgatggaggcatatgtcacgtgatgtacgtgaggcctatgtgttgtgagtagggtttctcaaaccgccggggccggggttaccgcaccccggcgccgcggtaaccatgaaaaaccgtgcaaaatttatcaaaaattcaaattattttttaaatttatttgaatttaaggaggttaccgcggtatttatattaccatactccgcggtaagccctggttacggtggtaacatcaaccctggttgtgagtcgaaccattgattgatgggcccatgcaccagcttggtgctgtgtataaattgtgctcatgcaagaagcaattaaacggataagttatacaggaggtgttcttttcatccgataaagaagcaaggacacataaaatagaagtattatcaatatatgattaattaagttttaattattactcctataaacttaaaaattggaaacaacgacacctgataccttatttagatggaactaaaacttttaagctcttatcacatcagatgtttagatactaattataaatattaaacgtagactattaataaaacacatccataatcttggactaattcgcaagacgattctattgagcataattaatccatgattagtctatgtgatgctacagtaaacattctctaattatagattaattaggcttaaaaaatttgtctctcaaattagctttcatttatataattagttttgtaagtagtctatatttaatactctaaattagtgtctaaatatagaaactaaagttaagtctctggatccaaacaccacctgagtgtgtcagaatgcattgcacaacgcatctggggttggggttacagaacggattgaaggcagcccgggtgcagctaggtagcattaaatatttgtcacataataaaaaatctgatgtgacaagagagttaatagagttaatgacggaggtaaaaaaatgaagaaatcatttctctcgcaaaaaaccatctctacgcaagaacaaataatgaaaaataggaaataggtggataaaaagagagaagagagatgattggatgagaatttaatttgacgacatcatccattgaatatatagtttttatacagtatctacatgaataacatgtatgaaagctaattgatagtttgatagtttttttattggggatggcctaatagtcccagatttttagcgcatatgcattgtcaaaggacttcctttgttccataataaatttatttttagccatttttattgtctcaaaatgaattcttattttatttttaaagtaattattacattaaagtttataaaagtgaaaaaaataatattgagagtagataaaatgagaaatagttacattaggatttgatattgtagaaatattttttaaaactttttattgatatatgtaggatttgtgaaaaataaatttattttaggacaaaaggtaaaggtgtactccctccgtcccataaaaaacaacctagtaccggatgtgatacatcatagtactacaaatctggatatacatctattcagatttatcgtattagaatatgtcacattcgattgtagattcgtatttatcgtattagaatatgtcacatccgatcgtagattcgtttttatggaatatttggatacaggaaacgacgaatgaatggatgatggccggccgtatatccatccacacttccaccacagtccgtcagtcctaccttctacagtactgttgctacaatgactactggatcagtcgtttcagtactagtactatggagccattcaattcagctcgtaccctcaacagtgaatactatgggctattcagattgatattattttaaaatttaaaccatattactttttactaaaattatcaaagatgtgtatgtatttagtttctcgtcaaattgaggtaaatagataagaaatcttataaaaattttgataaacgataatattgtcagtttatcaaaatttggacgctagtaagatttattttggctagcctctatatcttccgttttaaaatataatagattttggttaaatacaatgtatcctagtttttttttgtttagggcctgtttagatcccacctaaaaatgttacaccatgtcacatggaacgtttgagcacatgcatgaagtattaaatatatgcttaaaaaaatactaattgcacagattgtgactactttgcgagacgaatcttttaagtctaattgctccatgatttggcaatgtggtgctacagtaaacatgagctaatgacatattaatttggcttaataaattcgtctcatatttactgtcggatacttattttttttattagtgcataaacactccatacaacaccctatataatacctgatgtgacacactaaaattttacaccccctaataaacacctccttagattggtaatataataggtcccattcaatcaaaatggagggagtgatacagtacagtaggatgcagcatggacgcttggtctttgttataatgcgctcacgatctgtctcatttgggagcagccgcctcgccgcctccgcgccagaaccaccatgccgccacgacagactcgcgcgagcactgccgtgttgcttcacctcgtggcgcgcgggcgccgccgcaccgtctctcccgcgtgggagacggctcgccaccgggacaaggcctcgccgccaccatcaccgggaagaagacggaagagagaaggaagaagatggagaaggaagaaaatggatggaaacctaacggcagtggtatggttacgaataaacgaattgtaatattatttttctgaatagcaaaatttgtagtggtatagatcaaattaacccataataattcaacgacgccgtctttaaatataataatatatacatgattaataatatgtatatatgaataatagaaatatgatatatgaccgctgactgatcatcatcatcatatacagttctgactcaggaattccgatatacggaattgctatctgtttggtgacagatttttgagtcacatatcttgcagatttatgtgcgttggatggtgtcaagattcgtggtgcatttttgccgactccatcattatcgatttgagctatgttttctaatgctaatttgtttatgatcccacacgtactaattacaccgtacttacactgtaattatatattaattacatatgtaattttagtgtatttacgatgtaagtctgaaaattacatatgtaattttagtgtatttatgatgtaagtctgaaatcaacttgagcccatttgagtccacgtgagcttcagattgtccatgtggcctgtttgtttgttgttttatattttgtttgtgtatattaatgtcatctgttagatgttcatccaaagagtaagaaatctgtatgataagaggctaaaaaatctgtcatcatctgttagatgttcatccaaagagtaagaaatctgtatgataagatgctaaaaaatctgtcagatgatatataggcagtcccatatacataactttctatccatcttaaaataagggtagttttgcattgattgtatccaacgtttaaccgttcgtattatttaaatatttttgtaattagtatttttattgttattagatgataaaatatgaatagtactttatgtgtgataaaatatgatagtgatatatatcttgtaggtgtataccctacgcctacggcacgagctcgagacgccatctgtgccatttcattccatggccatgattgatcgccaacgccacgtaagacaacagaccagcccgatggatcttactccctccgtccaactttaagtaaggatgatattaaggttggacatcacctagtacaacgaatctggacagagaactatcaagatttgttgtcttaggttatctcatcctcaccaaggttgagctttttttttcacggagggagtacacacactcgcacacaaaatattatcgctgtgctgtgataccaaatcgctcgttctggaaatacaagtggtgtgatggtgaagttgtgggtgcatgactttactgggttcaaatcctggtgcctataaatattatgcacaagcaaatgaaatttcaacatgactttagtgagatcaggaatatgcaattggtgttaggggcgcattcgcgggggtgtaagtgtgtgttaacgccaaaatttggtaagattttttaatggattcggttaaggaaagagcacaatgagcctatggaaagcttatctaaaagagttcgagtttaagaaggaaccatggaaaccacgtcatagcagtttagtttatctattagttaagcaagttttgtatttaggaaagtatgattcatgtccgatgaggattttatgttttttcttttatctttagaaaagtttgtttagtatccgctcaggattagtatccactcatgggtataaatatgtacacccgagatccttgtaatctatctatcggtcaatacaacttcggcgcatcgccatcctttttattttcgtctttctcgacgaggtcttgtttcgagttgggctgcatcggcttcgatctccaacgaggggtaaggcttgttatagctatttgtatcggaagggctagggcctcgacactctaatattgttgatgtaaacacctatttatcatatatcttagttaatctaagtcgaagtctcaatttacatgtatcgactagatcttttctagggttttattggtgtcagttaaattgtttcatcgatagattatttactcaagtgtcagaatttacattggaaatatagccgattgttcaaaactctattgacatcgcctggtataagcatcagctagcatgctatatcggcttattggacaatcgactcattgatctctaatttgtacatcttgtcagttacaagattaaactaactagaatgtgtgtatcttgtcagtattttggatctgcactggagctaagcagatctctcaagtcgtcgtgtcttttcattaacagtgattggtgttacgtgtatagtggtgtgtggatgtgtgtttgctgggtaatctcagaaaaaaaatcgttcgacagtagtacataatgacaactttcaacagcttttctgattaatttaatgtacttttttcttttgttagctacacttcacttgggttaatactaatgcggagtactcccttcgttaaaaaaaatcaatctaagagaggatgtgacctctcctactaaaacaaatatgaacacgctgtactagaaggaatctgttcagattcgttgtaaggaagggtcacatctttctttagattggttttttctttttttagagcatcaccaacagcctatctaaatcggactctccaaacaactatatagccaactcaaacacctatataaccaattcttcatctaatttgactagtcaaactagttactcgctctaaccgcctctatatctacccattctattttaattctatgacgctggtccccacacgtcaattgcttcttcttcttcctcctctcccctacttcctctttctcccgcgcgagtcgacggcgcggtacctcgcgcgagcctgttaattactcaactctaatcaatttaactaccaagcctgttaatttgcactctgcaggcgtgcattggcaatgacatccaaaataaaaaaaaatcaccgagatgaaattggtacgcagtaaaattccaataactggtaggactgcaaaattcagtagcatacacacccgcaggacgaagtcctcctgcttccagacggtcaggcagcagaaggcgagatgcgcgaccgcgacgccggcgctgctacacgagtccgactgctgctgctggctcgccgtgaacgcaaagcagaagccgaggaggcggcagagcaagaacagatgctgcatcgaagaagaagctgcccccattggcttgccactgatccccgtgccctgactgctcttctccttcctcttcttcttcttcttcctcttcctctcgtgcctttcttgccatggcttagctcagagaaagcaccggccgtcgagctcctcgcgcgcggcagcggcggcggcggcggcggcggcggcgcggagtcctcctcctccaccggggtcgccgtgcagctcgccatggtgcttctcgatgaggagctgcgctacatcatggtccaccaaaccgtgcagctcgaccccacgggcatcttctccctgcgccgcctctcactcggctccatggacgacggcagcgccggaggatgacggcggcggcgccgggaggacgacgactgcggcgccgggtggacggcgacggcggcaccgggcggatggcgccgcgagcagggagggagcagcagacgggatggggaaagagggagagagaaaggagagagggtgtgggacccacaccgatggcaagccctctggctggccaactttggcaagtgtggtgaggaatttagccagccaaataacttagccatccaattagtaagtctgttggagcattttttttttctaagttagctaaattttgacttgaatagctatttggccatccagttggagatgcccttacggagggagtatagctcagtagtcatatcatacagaagcttggtgagggtgaaagcaattaaggtccatagatggaatttatgatcaatttatgtgatgcgtgcagatgtagatagatgcaacacatgcacgcagatgctgcagcctgcaggtcaggtccatcgatatcgtccaatggctctgctctggagtcgatctgactgatcgctggctggctagctagctggaacgaccttttatattgttattatggtcggaagattaacaacaatgaccagtatattataggcttaattagatctcctccctccatccaaaaactttaacttctagagtttaaattttatcacttcaataccatttacctgacattttagtcattcttcatctccattatttttgtcttgggatgttaggattggctttttttttacggagggagtatgtcagtgtaacttttacggttttaaaatatatcattactattcatttatctgaagtaataccattacaattttactgttatttgaaatatgccactacttacctcttcaatataatttctagaatttttacaccaaattatccttcttcctttttttctgtctctcctgttcatcttctctaccaactagatccctcggccactaagctgaatatcacagcagcaggccctactactccctccgtcctatgatataagagattttaggtggatgtgacatatcttagtacaataaatttcgataaacgtactccctccatcccataaaaagccaacctagtattggatgtgatgttttctagtctaacgaatctagacagactcatattcagaatattcattggactaaaaaacatctcatcaaatattaggttgactttttatgagacgaagggagtatatgatatatcacatctatctaaaaccctttaaattttttttttttgacagagggagtacgtagaagtacgtagaagcgagcagttgttgtggacccaattacgcaggcatatgcagcaacgatgggtcaaaccaacgactactccaatcaccaggacagtatcccaaggtgaattagctgccgtgtttgctacattggtgcatctactatcaataccattcgtggtggtcgatggggtctgtgtgtcaatgcataccgtagtactactatctccgtagcagaaacatcatggttttacattgtttatgtcaaatatttaatcgttcgtcttatttaaaaaagttctatgattactatttttttattattagatgataaaaacatgaatactattttatgtgtgattattattttaaaaaaattattaatttttaaataagataaatggtcaaatattgaacacagaaatccaaagttacactaaaatgtgatggagaggtacgtagtactttatgcagacccaccctgtgttggaggtacgtattgttcgtagtacttaatacacgtctatcgattgatcgatcgagttggtacgtattctcaactttttatcatatcacatcacatcgaaaacttttctacacatataaactaacaactttttctctaaactattaactttctcctaatttttcaccttttcctccatctaaacacagctatactgtccgtccggacgctggcgtagtatgtaggagtagtacagtaacactagtacttggaatgcttggatagctggtgtgggagcccacaggcccagtcacccagacccagtgatttctacgagtatttgctcaaatatgcatgcaaatctatggcagatctatcaatggcatactggctcagtcacagtttactttagagcgagtacagtagcaggctacaagtcagctgtatacacatgtggaggagagaaaagaagagagaagtaaagcgagctacagatttatagtcagctgtagcacagactctaatacattgtgtgtgtatgaaaggtaggaccatatattagtagtatagtattcttattgtataaatgagctattaaattggctatagaagaattggagcgcatagttagctatactatttaaacttgctcttcgatgctgcatgctcatgctggcctggtccaaaagaaattgtactgcccccaacacacacatacccacccactagtgaagatgaattgaatgccaatgggagaagaggagagcagacgattgaattgaatgcggtactggatcaaaggcagacaggcagccatttactcgcccatgtgcactgtttatttgcaggtttctatccatcaagtagtatgtactagggcaactatttttatccaggagaggatgtctccttgtttgtttaaaatttatttaaatagttatggaaaaaaaatctcataacacttgataacactccatgacatacacacgtataccacattataaaatcttagatccaaagtcaactcacacatcgaaatgtatgaataatagcgtattgttcgtatctgaatttttatttcaactagaaaaaatgcccgtgtgttgcaacgggtgaaggctattttaatcttattattgttatatggtttatttaagatgaaattcactgttaaatttgctcggatatatattttattagaaaatcatgagctataattaggagtccgatcgtctcaagttagcatgccaatttttttaaacagatttcatatacaattcattttgtatttccaaaagcgaacgaacttaaaaactgactcatacatggatgacgtaccaaactaccggcaaaaacatcttcaatttttataaatacccgtgagttgcaactggtgaaagctattttatttattattgttatatgggttagttaaggtgaaattcacttgaatatatatattgttagaaaattataagctgcaattaggagcccgatcattatttcttatacgatttcttctatatttccaaaagcgaacgaatttaaaaaccgactcacatacagatttgtatttccaaaagtgaacgaacgtaaaaaaccgactcatacataggtgacgtaccaaagtatcggcaaaaaaacatcttcaatttttataatagtagagatgtgtagattggactaattttttttttactgatagatgtcaccgtactctacattatttttttggaacttttaacaactatttgtattattattgagttttttttaaaaaaatacataacagaacattctcattagaattcattccctatccgctactatgtgttgtcgaatctagataccaggggtactaagtatccactaattagctcgttaatcgtagtagcaatttgtgatattctgtcagtaatcctccctccagtttaaaattattgacgttttaaacataatctcgtatagtgttatattatatgttttcctaaatattgactttctgttgcctggttggtttgagctaatcaccggccggtatctatatatgcaagccgtgttcgattccaaggctagaaagtcagtgcgtaatgttgcggtgccaacgaatggtcaactgaaactagtcaacgcacgtttacaattatatctgaagtcgtgtatataaaaaataataactatttagatgatgtgcaagaaaacaactcctagtgatcatagtactatatactctcttcgtttcaaaatgtttgacgccgttaactttttagtacgtatttgaccattcgtcttattaaaaaaatttaagtaattatttattctttttatatcatttgattcattgtaaaatatactttcatgtacatatatagttttacatatttcacaaattttttgaataagacgaacggtcaaacatgtgctaaaaagttaacggtgtcaaatattttgaaacggatggagtatctagtatgggttgtactggtacagtacgtacgtaggttgccaactctatctagtacggggtacgtaataatagtagctaggttgatgcaaattgaaaatatatgttgcgagcggcggtgttaagtgcagtgcacgccaacgataaatcatgcttgaatttggtcgtctataaatactagacaaacatagctagctgcctggtgctactttaattttactgagagtgcgcggtgctgtgcttagattcaattcgctggcagtacgtagagcgtgtagagatagaatgagaatgggaggaggcagtagcgcggcggcggcattggtggtgatggtgttgtgggcggcggtgccggtggtggtggtgcaggcagcgtcatcgccggcgctgatcgtgtttggggactcgatcgtggacccggggaacaacaacggcatcaacaccatcatcaaggccaacttccctccctacggccatgacttccacaaccacacccccaccggcagattctgcaacggacgcataccaaccgacttcatcggtaactagcaacatgcttttctttctcttgtcaattctcatttctcataggagtacatgcatgcacaacaacaactaacaacggatcgatcggaatgcatatgcagcttcccgtcttggtctgaaggagcttctcccgccgtacctgtcgccggagctgtcgactgaggagctcctcaccggcgtcagcttcgcgtcggggggcaccggcttcgacccgctgacgcctcgcctggcctccgtcatctccatgcccgaccagctgctgctgttccagcagtacaaggagcgggtgcgcggcgccgccggggacgcgcgggtggcggacatgatgaccaggggcatcttcgccatctgcgccggcagcgacgacgtggccaacacctacttcaccatgcgggcgaggcccggctacgaccacgcctcgtacgcggcgctgctggtgcaccacgcggcggcgttcgtggacgagctggtgaaggccggggcgaggaaggtggccatcatcgggatgccgcccatcgggtgcgtgccgtcgcagaggaccatgtcggggggcatggagaggcgctgctcggaggggcacaaccagatcgcggtggcgtacaacgccgggatgaagaggaggatggaggagatgcaggccaagaagaagagcaccaagaccaagcttgttttcatggacatctacggcttcctgatggacatgatgatgcgtccacgggcgtacggcttcagcgactccaccatgggttgctgcggcactggcctcctggaggtttccgtcctctgcaacgccctcacctcctccgtctgcacccccgtctccgactatctcttctgggacagctaccaccccaccgagaaagcttacagcatcctcaccgacttcgtctacgataattacgtcaagaaactcctcctcgactaactatatatctctgtccatcattattatattatatatatctagcttttgctttaatttgctccctcttttttgtttcaacttttattggattatataatataatagtattgcttgctcttcttcagctaagccaggttttcccttaattatttcttcccttataaacttactccacttactatacgcaaggatgcatatgtatgtgctagttattactaatatcaattaattcctctctctctccgcaggctgctagtgctagctagctagagccctgtaaatctttgtcattgatgattaatcgtacgtttcccaaacaggcagctagggtatcttcatttcgtaacagtaattaatctacagtagtagctagtacgggtgtaataacatacatgtagctcgcatgttttaagactcacaaaattacagtcgtactagtggtataataacaaggaattgaagctagctagtatattatatatatatatatatatgtgtgtgtgtgtgtgtgtgtgtgtgtgtgaaattagatatcaaaagtctggctgacagcttgttgcccgctccgctagaacagcaagcatatgcacctcgatctagacttcatgtagtggagtatgatcttgaaccgacagatataatatgatggaccgagctccagttcttagagctttgacgatggcaggcctgcatcgcatatatattcgcatgcagttaaagttaattttaactaggcaatgaataggaattaactaacggtacgtagtagtaccgaccgagttgtttggcattaacaatgctggggcaagcagctggcggcgttgcatcctccttgagaaatggctccactagattcgggttcccccaaaccggataacccttgatcttgccctgcattattattattattaccgtatcagcaggtttatataatcgatctagtgcaaatacaaacatgcacagacagacagacccactcacacagtgtgtgttccattcatcatcaatagtataatatttgggctgaggctaattaagcatgcatatggaaggagtacttacaagaacgtttagagcagcaagtgttgccattccttcgcgcgtccactggagaattggagaatgatgcaaattatatactatattagtcagtacctttttgattcatattactagtagttgtaggagtagtagtacgtaaagatggatggatatttttatgggaagaaagaaagaaagaaagaaaataaaacaagctagctaggcatatatatatatataagcagatgcagcaggcaggtagtggaccttggaggcagatgcgatgtgaggtacgacgacggcattcttcatgtcagcgaggccgggcttcatgtaaggctcatcctcaaacacatcaagaccgacgcggaacatggggttggccttgaggtgctccaccagtgctacctcatcaatcaccggtcctcgacttgcattcacaagaaccgcttcctgtatttttatatttagattatttgtatacatgctctgttaattacccactgcatagtactacagtatcaagaggaccgagagaagaaattaacagaggcagagaggcaggcaccttcttcatgatggccagcctttccgggtttatcagatggtaagtggtcttgtccaacacagggtgcagactaatctgccacatacatatatatatatatgcacaagcatttatttgcataattaatcaacatcttaataattagaatgaagaaagaaagaagagacgatgagagagatggctgaccacgtcggcctccctgaggacatcctccatggtggcggctctcttccatgtcacaggctgctctccgtttgctttcaggaactgcccgtaagctacatgcatatgcattcaaatcaatgtgcaggtcattaattaatctaatctaatctatctatcttaatgtcgtactccctccattccaaattgatctacatatagttttttagattatttctaaatgatctacacatttgtgttcatttattagagtctattcgttatttgtgcattggagtaaatggacattgatgcatgcatccatgcacacaagtatttataacccacatgcaatattttgatttgctattggctagaaaatattagggatggtgcatgcattgaatttgttgctagagtaaatatagtatgagagagttattagtttttattgatcttggtgtacctatgaaatatgtagatcaatttagaacggagggagtacaaattaactagccagtactataaaattggatgcatacctgtgacgaatttctcaaggcgcgtggactgatacaggtcgtagtagatcaagttcatcttgaagccctcgatctgtggtaaaaggaaatgtttacatgagtaattttgtggtgcaattgcgaaattgaacaaataattactcctactataataataatagtcctagctagtaaggtaccaactgaactaaccatcattcttgcgtaagctgagccgattcgaccagctccgatgactcccacagtctgacccttgagcaagttccccacgaacctgcatgcacatatatacatatatacatatatgagtatctatcaactagcagcagtagtaaaagtaaagagagagagagagagagagagacaggtgcgggagccatccgtcgtagaggccagccctcatgaactgatctgcctccacgatcctccgcgccgccgccagcgacagagacgcggccagctccgccgtcgtctccgtcagaacgccctgtacatgtgtacgtatgtaagtaaattaccatccagtaagatagtctagaaatcaagaagcagagggcggcagaactgacaggcgtgttgccgacggcgatgccgttcctattggcggcctccacgtcgacgttgttgtacccgacggccatgttgctgaaggctgttccgccggcgcgcttcagcgccgagaacagcacctctccccactcctccgtcagctgcacttaatttgttatcaacaagaagaaatcaatcaaaattattggattgcaattgctttgcttgcctggccgatgacaccatcgcagcgatcgccaatgagggcgaggatgtcgtcgacagagaggatggtcttcgtctccgtgcagatctgaagcaaggaatgaattgactctccactactagtgtaattgtaatgcaataagtaatcgctgcctaagaaggaaaggaaaggattacctcgaggcggcagtcgttgtcggcgaggaggcggatccagcgggtgccgggcatggacttggtgctcaccacgcgatactttccgctcggattccacacctcgatcgatatcggcttcgccatttcttgttttgctttcgcctgccttgccttgccttggactcgctactgcttcttgtcttgagctcactctactactagtatactactagtgtactactcccaactttatcggctaacttgaggcgccaaaattattcgcaaaacaaaacaaaatcatggatggataaggggcccaaatatacgtgtggcaaccaacaccaggagagaccagacacacccagccgccttatcatctttctttctttctttcctccaggccaaggcttggcctggactcgctgctgcctcaccacctggcacttcctccaacactactgcggcacagattagatagatagacagacagacactgagacaatggacgacaatcagatgactttataatcccagtaataaatcatccatccaccagacgatatcaactgcagtctaggcagccgcacataacatccttatagtaacaatcttcagtttttgttttcccttccatacccatacttcataaaccagctagttaacctaacccccatttcatttcatccttccttcactaaccacaccccccccccccaccccaccattcattctcactccaaaataattacaaccattgcaaccgaccggccacatgtagcagctgctgcatctctactcaaacgcccactggttctccctgcggatctcctcttcctcctcaggggccaagtccttcttgatgttgaaggtcttgcggatttcctccggagtcttgcccttgatcatgtctgcaacggtctgcgcaactcagatccagcaatcccatcccttgatgttgagatagtttgcagcctgcaagaggtggacaatcaatttctttcttcctttctacatacagaaaataatcaacacatctaggcacacttgagttaaaactggaacagaataacaaaggcaggtaagcaggcatacattatgtttccaaagagcaaatcaggtggaccaattcatccgtgtgttaggcaagtacttcacaagtcagatctatatatctcaggttaacaacaataaaactaaacattttatcaacacatgcttcacaattacataccaaacagctctttgcttcttcaagggcaacatatttttccactatttattatgtatatatgtggaaaatccattgagacagactaatacaggaagccactaacatgtcaagggacttggtagttaaatactatcaaacatctattgtccttttaaagagcagcaaatcctccaattaaacatggatacatgtgcactatccctagagaaaatacaggtaattaggaggtaagaggaaagtaacaagtatggaaccaattattaggtaacgttagcccactagtcacagttaattgttggtttctaaaaaagcactaagctgtcacaacagacaagtagacaattaatgacagaaggatcacttaaccacattgcctaaatgaattgaacatcaatatatccacatgtttaaaaagggtaccatgattataaatttaaaggctagcacaataaatataagtccgagcatcaattgtactgccaagtatgttgcaacagtaacaaaaacatataatgcattaggaaaacctagaagggtccattttgggagggggggagacaaggaagcatacaatagatttgagccacaaagacagtagatccgaacttccaacttttttcatcacatcaacctgtcatacacacaacttttcagtcacatcgtaccaattttaacctaaacttccaactttggaaggaactaaacacaacctaaggcttagcaagccaatgcatttatggatgttaaaagtgaagacagtatcaattgacacaaactgacagcgttactggtagaagagtaataaacccaccacccatcaacattgtccccaagcacaagaaaagaagagcactagttgaaataaatggaaataaaaagcatggcagcccctagagttgtacacaatgggtttgatttgggagataaaacaaggacacgcaataatcatcagataagctgtgctaacaacacgcaaccagattcacataggcataataaatcatctactacctccgtcccaaaataagcacagtcatgagtttccacgcccaactttggtcgtccgttttatttaaattttttttataattagcatttttattgctatgagatgataaaacatgaatagtactttactcgtgacttatgtttttaattttttttaaaaaaaaatcaaataagacgaacagtcaaagttcggcgcggaaaaccatggctgcacttattttgggacggagggagtagttacttatttaagacgtagtggagtagtaccaatatagaaatatactactactggagtatattggtaaagccaagacctagggtagggagaagagtgcaacctagatagatctggacgaactctgcgctgtatgtaaataaaaaaaataatcggagaggagaggagaggagagcggggagtggagagggaatgggttaccaagatgaggtcgaagagggtggcctggtcgaccttgacgaagtcggcgtccagttcttgaggtcagcggaggaggttgagtcgtcggcggaggcgtgaacgtgcttgttgcagtactcgataaccttggagaggatcttggaattcacgttggggagggggatcccattgtcggcgcatttatcctcgatcatgtgccggatggtctgagactccatgcccaccgcctccacctcgaattcctctccatccgagctcttcagcgttatcatcttcttttcaccctccgccgccgccgccatagctgttgcttctgattcttgatctccgctgggaaggaggaggaaaccctagacgacgacgacggtggaccgagactatttatttatttattattattctctttggttggtcttccctctatctggatggtgggcttacatttggttggcttctctctctctctcacacacaccaacatgacttgctttttaaccttttttttagataactttctttttaggacctctttaaatcgtaggattacgaaacataggaacgaccgtttgtttcgaccgtataaaaaaatacaagaattacagaagagagaaagatttaaaggaaagtttccatgaggttttacctcatgttaaatttcctccaaaacttgtatggcatgagtattccataagatttcataggattcaattttattcattcctttgaaaaaggatcatctaggggaaaaatcccataggaatgaattcctccaaaaattactttaactttcctttgaatcaaagaggacatagcttctggaaactataaacgaaaataaatacactagtaggaatgtgttgcaagatactactgtagtagcaaatagagttgaaactgatttgaacatttcacatgccacatactggggaggtagttcttgcaaagtaaattatggcttttaagtagataagaaagaagagaacgaactgcaaatttgtgtggattagaaaggaaacattgggcttgtttgattcggaaccaatttttgccctaccaaaattttattagtgactaacattgggtactattggataaggcaataagatggtattaaaccaaacaagcccattatatgtgtataatagaactaattattaatgatgtagtacataagttaactattatacatatgaattgtctattagatttactataaatgattcggagctatataaatgatttggagctaaatgattcggagctatataaatgattcggagctaactgatgtcgtctttgagcaaaatctttgcttttcgctccttggggggggggggggggggggcaagacaataccgtctatgtactagcactacaccacatttattagtacaaaaacagtacgatattatcgatcacacatgtacacatgatggttaacaacataataatagcaaagtaataacattccagatacacagcaaagggtttcaccaacgaatcaatccttctttcgacaaatatgtaaactactattgccccttctttttttttctttatttacatgtacggcaaaggatagagctcctcttctcggtgctcgcgaggctgcccacgccacatatatggaacttgatttcactgcaaaaaccaatactacattatctatttatgtatcagcttatatatatgggagtatttaacatgagaaatactccagttcagcacctgtgtctgaagggagactctgtccttcaagctttgtccacagcggctggtagcctcaacctattatgtcacacgggcaacaaagaaactaattctggataaaattgatagggcattcaatggtgagccctgtatgttagttatcatcaactcatgatagatcaaatgatccacggccttctaggatcgcataaagcaatttcttgcgcatcacttcctgcaaaaagcaaaagcataaagccagttaagataattagcacatgtacaagagaaaacgaaaaattcaccatgtaccagagaaagaaaccgtacttttgtggagtatggaggcaatttaagataattagcacatgtcataacacttggcagatcatcatctgcagactctgtaactccagcgatatttgaagtattcaccgcacttgaggggtgctaatgatcaaaagcaacaacaaagttatatcacccaaaatgaggcgacaatattcatacgttataacatgctaataagatataccaagaatgttaccttcctaactatagtaagcttgggattaagggcagctaaaccaccaggcggaagccgaggagcaccagttacaaactggcagaatgcatgttgttgctctggggtgaattcagccatgatctcgagtagctacaaacatgtagagcaattaagtaactaaacttacagaaggccaattcagatattgaaatgcatatagcgcacttacatttacaattgcaggacttttagcagtatacccatgatcaaattttatattatccaccaatgaatcaggctgcagcacaggtttattcagtgaaatgtaacaaactaaaactgtgtgcgtgtgtgtgtgtgtgtgtgtgagagagagagagagagcattacctcccaaatttctcggcgaccacatattagatagtcaagctcttcaggtgaaaatattttcagggatgagatgtcaaagacctaaaacagaaaggtaaacatgaacaattacagtaaacaaaaaaaaacagctaataaaatgattacaagagagagaaaatgacgttgcacctggttaaatcctgatctaaatgcttcgacttgcctcattatccctgatttaactgtagcatccactaccaaagtaacatactcttccaagttgtaaatatttacctgcaaaacagagtaatactatttattaccacaaaaaggagcaaatgcagacactagtcactgggacaaacacaaaactaagatgggtttcatcacttacaattgtgttttcctcgccttctttaagaatataatcaggataacctggaagagtaaaatctaaacacaaatcttcgataggagtgccacggaaacgcaagtccgtgacttctagctgattcatgccataagtggattcaaggaacctcttccgttcaacaagaatttgcagttcttgcaatgtctttccgaattcagcatcaaatgagattatgtcaaataagtccagctcctggcacatacagttcatttgttcagactaacttcaataaaacaaatgtaacaaaaggaaaaactgatattaatccagtaagagtatatcacttacttgtccaagtataagcttataaagtgctgttgatagaggcaaatctaaaagtcttccatcttgcaaaacttttgccatcactcgcccaaccaagcggaaatgttcgatgaccttagaaaatctactgccttctgaagcatcaacggtaagtggccaaggccgaggaaacaatccaaagggagcttgtatcaagtggctgccattgtcaggtaaatctgagctgagttctttggctgccaagtcatcgtcgggacttgcgctcctatcaatttgcattcccgtatcagatggagaactagatctccataatccaaggcgaacactctggagttcatggcttaagagagtatagaactccaaagtgggcccaagccctgttccaacttcaccaaagtattctacctcaagaacagctctctgactggagaacatctccataactttagcagcagaatccagaatacggttacgggaaacacgaactttttgacgttgtagccttccaaatcggatctccctttcgccaccagcattttggttgtcaccctgttgttgctgaagtcgattcaaagcacgggacaacccaaatgctgtggagtaaaagtactgtctccttgtttcaaagggaaacaagaaagggcaggctttggtcatctggtaacaccaagaaggtaaactgccactacagagggcaagaacatcctgcatttgccgagcaagctttggtgtcaacttactattaacaaactcttctgacggtaccttggctccagttctatatagctcatccagtgtggtgatttttccctcagcaaaatcatcagaagcagcatgtactcttaaacgaggggacaactgattgagcccctctaatacacgcaatagtgctaaaatgttgtaagttgagtttgttctctctagatcacatgggagttctgcctgtaagatgctatcaaggagagaaacacctttcaattcagatatagatcttgaaggatctgattttgagttcaacgaggtggaaccaccttgggataccttctcagcctggctatcagccttctggtatgttatcgtgaacacatcaccccaaaatcgatttccatcatttgacaaatcagatccattaaacttctcatcatcatcctcttcaaacatcagctgacgttggagagcttgatacacagtcagatgtttgctgagctgcttccccccagccataaatatcagtttattgtgctcatttatgctacctccaagtgacaggccacgtcgatcgcgactacctctaaccccccgaccaccaacagaagccagcccagccattgtcgcagcaacaaatgacattgcacctcgtgaaccaaaggtatttggatctactcccctgctcatgatgttcctagtgctggaaccagatgagggctgcacttggctatcacttgctgaaccaatgttagagtcatcagtgtcacccaatttcacgtcatgcaccccatcttgaacacaaataggaagagagccatcttggagaacctgataaatagtagtacagttatttatttacagaccagagcaaataatatctgtaataatgaaaaactaagagctttattggcatatgatataatatgctgatcttacaggcaggcctatcaaataaaagcttacagcttatatatcaacaagcacaacatgttgtttgcataaaatcccattgtgacttgtgagccctagcataagcgcaccaccccacttcatttataatacatcttctctgtggaagaaaagcttatatttgaatatcaagccgaaaagactcgatagctggttagaccaaacttatgcttatcattggtgtatgccgaaacttaaataaggtcaagctagctctaaaatgccatgtgaacaaacttatatataaacctacaaattagtgcaggttgcaacaatacaaaattagaagcacaataaattttggaaagtggtaaacattacctcatgatcatcttcttcatcctctgacatgtcatcatcatcaatcattaaagcgtcatcaatttcaataggagatgtgtcaagctcctcatcctgcatgcacaaaaacacaaatttactacttgcattgctcccagtccatgcaagtcatatccaataattagcagatagtatgcatacacacagctagtttctcatataaaaatgcattggaacttcaagtcatcttttttaacaataattgtcctcatcagtaaaatataatataccttgtttcacatacaactctgttgggaatggcaatcggagactgaactctatgtcgaacatgggtatcagatacagaattgttatgatttgtttactctataaattaaatggccacatctagcgcaaactaatagctaggtggaaaaccacataggtttgctatgaaaccaacatgaaatattataaaagaaaaatgaaaatgtactccctccgtttcatattgtaagactttctagcattgttcacattcatatagatatgtctagatttattaacatctatatgaatgtgggcaatgctagaaagtcttacattgtgaaacggaggaagtagtttataaggcgctgaggtcaaatcttggtatacaaaaaggagattgtacattatctttaatttaatacttgttggacaattattatgtctatatgcctctcaacatagaattaacatgcactagaatcttgtatagagctaaataaaactgacaactgcattcgtaatctctattagaatttttcatgttcattcagagaaatgaaagaaatacctcagagctgctgtcaccatgtgctcgcttcatttccagatctttctctgaagcagcttttctgcgagtagcattccgtgtattaggtccttttggttcttctgagtttggttttgcaacagccttcccctttcccttggcagtgtttgtgctttcctcctgagaatccttcttagatgcaccactacttgcagcagatgattttgatcttgttgttggacgcctgccagatggagctggtgcagctgtggatgacgcaccagctgcggtgccaggtatgccagattcagaattatttcctgatggaactgtaggcttcgaagcagcctcactacgctgaactctgggccaaagaaactcttcaacagctgctagactcgcaaagggatcaataagcacaatatttgacgaataatcccgaagtgatttttcaccctgacctcgacaaaggcgcaacttgaagggctgagctagagcactcaaacctgaagtcaaacgggagcctccaatacctattctgctggactggctgagcacaacagggaagcgctccaatgaacacaaagcactttgcagtttttggaccaaaaaagccataggagtctcattcctttcatggtcaatagaaagggcaacagatataaaagacttgtatcgcctaagcgcctgctgacgaagctttggcaggtttgcctcagataccctctcctttccaaatgtcccacaggacaaatagtcaagcaatgctgcaacaactccgcttctaatgaactcaaatgttgatacgccgttagttttgctaagctcagtaagtatttgtgttattatcagctcaaattgtgcctccacatcatgtgagatgtcaaaatgagtggcacttaacgcttttgatttccctttggcttttgtcacgacattctcacttgcagaatttaactttgcacagagtgttctcagtttaagaagatcgtcagtaactccaagatctcttgattcatggtcagaagggaagtatttatctttgaacgactttgcacgatcactaactgcaaatcgaagactggtgttttgaacttctgtagagcatggtgttgagctggcaatcccaggattggaagtgtttgattcatctaatgagctgttttctgttggtgcagcagcaccacgccggcgctggcgtctagaatgcgagggcatcacagattcattgtctttatcatgtggcaatacctgagaaggcaccatatcagaggattctggacatataagcgactccacagcatgaacgacaccttccctcacaaacaacttagagaatgtctcaggaagtttttccatcataatttctgctatttgaagagcaggaatcaacacttgcggatctttccacgcaagaatgcctgctaggaagctgcaaatggaaattatgtagcttagcaaggatcagaaatgaaggtgtgtctacttgcacaatacaagaaataaaagcttccaatatacatatgccagtaaatcattaggttgtgccaaggagtgactggatcatttcagcagggctgtagcacattagttttccagttttccagtgattgataagcattagttttcagcagtcttattcttccaacataaatatgcttatcaataaaaacttccaacataaatacaagaaaagaataagactgaagcagaatcttgtattagcacctggatatgtttgttgtgccaaggagggactggatcatttcagcagagctgtagtacattagttttccaatgattgataagcatttgtggcgtatcggtgcatttacacttgagccatacacctgtccaagaacagatgccattaagtacagaaaccctgacatattcccaaaagtagtagtactccatctgccccaaaatatagcaacatctggctatgcacctggacaaagttgctctattttggaaggtagtagttatgttcactgacaagaaagaggatctgggcacaaacctgcgtcattatgggtaataagtccataccgaactgctttagaagctcagggtgctcacgtaatagtctctcatgtcctgacctttcattttctgttgaacttgtcccatcttgtttggtggaagctgatttctttgaagaagagcctttaacaagcacatggaagtatgctggtaaagaaatgattcccgaaggcaaatgtggaagcaaatcatcagcaaggctcactatctcaaacatctgcagaggtaagagtaaatatgtaaacatcacacataaagaaattaacaagcatgtatcaccccctcaatcaaacataggtgccaacaatcaacataagggtgcgtaagtgagataacaagcagcagctgctgataacatcatgcgttaacaatgctcacaaatgtcagatattttgaatctcagcaaatatgtttattggcatatgtatgatataagaaataagaccaaaaaaatgtaactcagcaattagttactactggtaagcgttggtagctttggatcaatcacacttcaaattagatactgagtattgtgttcctttatgtctccttaaaacactatcccaaagaaattaacttaatgcaggacgcgttatttgagaatagtgtctcaaggactgttgtacagcatttgaaacaatggcactgaacatgaacagagatccaccgataacatgttccctttctgcgtggttcattaaaacgtcaacagactagtttttgtttactaaataacagtcctaccttcaatcctcaagaatattaccatagggaactgcccactggtatggaaaattgtacatgtggcataggcgcatagccttaacttttaggaagttgtggtaagccatggagataggcgcagaagacacaagtttagaaaacatggtctgctaaagcaagtttcagaaatacataagaactgagtctcagctacccgcatgtcacttcatctgagatagatgataaaaatgccataaagcttcagattaagtaaattcagtgacacaggcaatcacctgttcagcaggccttgacaaagctggggagactgatgctccagcaaccaaaccagaacctgaaagaatatctttaagagtaccactgattccaagaagaagaagtgttttggctgctaaaagcgacccactcgcacatgttgagagaagacgaattaatccctgaaaaaagttccagtctatccttagcaagagtacagaaaagataggaaacaactcgaaagaatgacagaacatatttgcgtgtaccgtatatgttgatgtactcaacgaggcctggcctgcggagttgctgattgataccaggctagcagactgagcaaccaacccatgattgcacaaatcatccaatttctctggataagaagcaaaagcctctgcaacgcgtgtcaaacaaacagaagcatgttcgagcacctggaatgagcataaacagaaagttaaaaccgcatgttataaaggtgaagccggatcaccaatgcgatgtttggaaatgaaaaataccttagaatcatggtggttcaagagattcgtgagcaacggaacagcttccatgacaaactcggacgcatcagatggcagcttcctgcatatattagcagcagtagacaacgcaactctctagaagcatgtccaagaggaaacagatagtaagttaatagagcatgcagaaccagaggaaattaaatttaagtgggtttgaagatttgagatatccggagtggtgaattaattaatagcatacctgaacaccagtagagaagaagtccagatatgacaggacagccattagcgcaccagctcgtaaacaggcagttggatgctcctgggagatcttcttgagggcttgtagcgactaagaacatcaagaagtggatgttagcatctcggtaaacacatgcttgaaggggcaaagaacaggtgttccgagtgaatctagctagcctacctcatgacggcaaatggttagattcatcatttatttatgacaccacagcttatagttatgcactttaaactaatcatatgaataattttatttattcatcagtggtgtagttattcagttgggtatggaatataacgagacgacctaataaccacatgagtagagttcatgcatcaatggtactagagcgtatagctatactggacctatcaaagacaatggctactgagtcgtcgttgtggtggcataacaacagcagagcaagatgagagtattcaggtaaaaatattcaactaggtcatatgaacaattttattaattcagtggtgtacatacacgagtagatgaatgaatcgatggtagcagaaaagcataacaaagcaataataataatatgaagaatgagatgagagtaatgagtaatgagacaaggggcggggtgagtatacctgctcggcgaggtccatgtactcgatggtgagcaggcgagcacagaaacagggtatagccccatagtgcacgacggcagagcaagaggaggggaggacgtcgacgagattggcgagggcacgggcggcgagcagcatgacatcggggctggcgccgcctgcaccatcctccccggggccgagaaggccaacgaggatgggcacgaaggcatcgacggggaaggcagcgagcgactcctcggtgccgatggagagcatctcgcagagctgcatgagagactggagctggcgcgactcgtcgccatcggactggaggccggagaggatccgcttgagctgggcggaggtggaggaggaggaggcggcggcggcggaggaggggaggaggtcgtcgaggccggcgccgagcctgcggaggaggccctggagggcggtgctggcggaggtgaaggagtgcgggaagggggcgacggcgtcgtcgtcgtcgggggcggagggaggggaggggtcggaggaggggtcggggtccttgcccttgtcggaggcggaggcgcgagcccggcggcgggaggaaggggaggggtccatcgcaggtgcaggcgcaggcgcaggagggggagcggcggcggaggaggaggaggcagcggaggagcggcgggtgcgcttgggagcagaggctgaggaggaggaggaggcggctgctgctgcggctgcggcggcggcgcgcttgcggctgcgcgtttccatacaagcggtgacgggcgggggggagggggtggctcgcagccgtgcctaggcggcgaccggcggcgggcgcatcgatcgatcgatcggagctcgactcgatctgcggcggatcggattcgctcgccggagaggagaggatggatcgaggggggcgagggatttggggattttggggcttaagacggtgcggtggacgtggcttggctttggttccccccctcctatagccgctcttcaaccaaacggaatggaatgcttctcctaaaatcaacctcccattttatttttattttacttaattttattataacaagactacatattttttaactaaattatcacaaactgtagatataataagtttatatattggaaaacttccaattttatgcttgagttatcacaaaactacaagttttaggttatgggagggatcacaatcttaacaaaattcaaacatcttgagctagctcaaacggtgcatctcaaacggatttcttcaaaaattgtagaatatcattcaacatatatcaaaatccgttcataactaattaaaaatcaacgtccagacatggctcaaaacttgcactagccaatcaagattgcaaataatgtttcagtcccatatacaacaatatctaataaactaggtcttacatatttatatgtatcccacgtaagaagagttttatttttagcggtaaatatctatgttcatgatcttagaaagcgtttctaggtacattcaaataagtatggacattttaccatatcaaagcataggtataagtatggacattttacccatagcaaagcatgggtattttgctagtattgtaacaaagataattcactgttgccatctctatctatacttatagggtcctcctagcgttgagggcaatattttttttattgaaaattgaggacaatatttagtaagacgtttaaaactttgatatcaaatacttgttattccattacaaatgtcttgaaaatataacttagcctcaatattccacagcaacaatttgtaaaatcttaccatctgtacagtattatgacaacatgtatacttgggataacttgcaaggttaacttgcaacccctaccagctcgagtctttggttattatttacgaatgttttcataacatgaaaacggttacccatccccttaaaatctttgttgacctatattattattaccattctgaagtataaaaccaaccaagggattccactgtctaacttatcttccctgggttattaaggttaggagcactataagcaaggtataccagtttataaagcgaagtaaggattaaacagatgtacaatgacgagaattgcctccctatttacatttgaactgcattgcgcatacgcaacgagtgcatatttacatagaaatgtatattcgcatgagcacaggcgcatgtacccacacgtcaaaaggtcgataaaagatgaacaagcaggtactgcaaaagacaaccgtggaagtagtagtacgtgattggtaccgcaaaatgagtgaacatcctacgaaataacatcttccgatcgaccttgtaaacaagaaagaaagaaagtagagaggcagctcaggacacctccacgaccaaaagagaagaaagaagctactactgggctcgtccacgggcacggggtgggtggtctgtcaacagtcgaataagcttgtcggatctccccattgcatctcttgacgatttcactttttcttcctgcaccaaccacgcctacactttgtcagcagctaatccaaatcaaaccaattgtgcatcaaacagacagtggttttgccgctagctataaataatgtcatgaatcagcgcttaacaagccatctgcatcagcgatcaaccagagcttagatttagccgccccattattgtgaaacacttggatgtggttccaattgttgctgaggtttcaaagagacgtacctttctggtatccacaaatatatcaggacctgtgaattctttgagcatcatagctgacacaggctgcaatctcctggtcgaggaaatgaaaggtaaacttcaattccatgacaagcatgcttttttttgcgggacacaaaaagcaagactcttaagcagtaattatgcaagaaaaaacatttctgaagtactcaccttctagtgttctttctattgcaaggcttagaagcagagagatcctctattttatctgtcagtttttcagcctgattgtccttggttggagacttcgaacgataaccataacaaaatatgactattagaaagggcgacaataaaaagaaactagcctaacagagcatgtcatttttctttttacttcttaactaacaatattccagtagaatatctccaagtgtttatagacttagcattatatttttcatcataatgcaacaagcaaagaagtgccatccgccccagactagacagtaatgatcttactattggagctttccttggggaagattttccatttagcgtacatggatacatgcctccatgatcatccactacatgtggaggttgagcacagcctacaaaaattgtgttccattgataatgtaatacaacatttcagaaggatatagacaatcatatacaacatgcccacaccaaattaagcacgaccaatgcttttgttttatgagatattacacattacataccatattccacaatggttatttctactgttggcttgcatctttctgactgaggatcctgctgaagagcaccctaaagaaaaggcacaaacatatgtcttagactttccaacaaggcaacaacgatttagcatagaaagaagaagcgccacttgcatgcaatcatatttcatcctgagaaatagattaaaagaataagaatagcagctaaccttgattatgtaaggaaatattttcagtgcacaaagggattatggacagtgttctacaacttgactaggatattattgtgttatttttggaactttgaaggagctcagtaccacagtgaaaatagaatatgcattacgctccacatccccatacttccatagctctaaagaatcaatctcttctttcttcccaagagctctcttcccagcctagcaagaaacatccccttctaaacccccaatggcagccatcaccagttcactaccctccccaaactcccataatagaaaaacacaacgaacaaatcaaaggtggaaaactcaaatgtacaaatggataactgtttgatgcaacaaactgcttgattgtgctaagaacaatacaaagatacgtacaaagatacaaaaagaattaaaatattaaattgttccataccatcccttgcaactgactggagctaacatgtaatgagccagagttcacttcttgggaacaacttggagtactatgatgtttcacccctgtcaaaagatccaacaaaattgtgataaaatggtgcatcatgagcaaaatattgcaacatggaacttgttaacctcttgtgtgaacattctgttgaatcccctccgttgttatattgtgtatctcttccctttcttcttcactttgctctatgggagatttcttgctagcaccaataaattgtggagacaggtttgcgctttcattctgtaggcatgtatctgcacaagtgaccttttgtgtcagttgaccttattgtctacacaatatttttatttttagaagtcacacagaaaggacttcccttgcaaaaatggtaccacgatctttaaatggaactctaatttccacatcagaagaaatatgtttcctaattttattctattgtgtgagtgttaccatgttaaattattcagcgggaagaaaaacatagaaactttaagaacctgtaaagctttgatcagatggatgatccaaactactggatgaatgtgtgacaccaccaccatcagagcaactttcagacctatccaacttcttatcaagcacctgtaccactatctaaaaaaagagaaaagtaagatatggtttatccacttgtacagtcaagatagattatactctcttttttcaagtgttccagtaaacatctctaaaaaaccttaataagagactgagtggtacttgaaaatccaaggtaaaacaagattcttctacgcatgtgtgagaaagagggagagagatagagtacatattaccccaatgttttctttttccacatcatgctcaggaataaaagcatcggaactacttgctttctctggctaaaagaacaggatgatggtccatatgtcagtaaaagatgcagcaatgttcctcgagtatcaacatcatgacatctttttgaaaaagaactacatgagcatttctccatgaggatccaaaggtccaaaccagtaagtatcataccttacaatctccggagcacaattcttcttccgctatcagcttaataatagaagtatcacaaacatcagatccccctgtccctgttatagaaaaatggattctcaggcctatgagaaccatctgatgatattgtcctgaacatgtacaccatggaaatgtaacctgtcttgtcatcataatctgaagacctttcagggccatgacctgtagattcttctgagacctcttctactgctaactgtaggaaaaaagaagttcgcttagtgctatgctgtataacatgcaaaagaatattatcaagaaagctccaacctcatttatatctgcatttgaactttgcatataacatgccctaaaaattaagaaactgcatcttattgaatatagactattggcgtgcaggcataaaaggggagatattttgcttcccattaggcaagtagtacataagaaaaaaaatggtgcactatgtaaaaaacaatccaaagggcagaagatcgtaactatcaaaggaagtgaagggttaggaacaggctgctgttcgatgcaaccagagcatgagattttatgacattgaagttttaagcatgctcaactgcgccaggtatcaactcattacagtaagtttaatctgacgtaaacattgtgacagcccttctaaagcctaacagcatatctacagagtttgatggaataaaagatacaaggagtgttaagcactctgtttgcttgtagagctttagatccaagacatacttattcaaacattactttagttaaaaggcactcaatgaaaatctaagtaaaaaaccaaatgtgaggttttcctgtttgaagtttctttaacttacagatttgtttagagcagagtcaatagatacaagatcagtttgacttgatagagaaacaaaactttgagccacttgaccagaagacacatcattgttttgctcaacaaaggtatcttcaacagctggaaatttcttgcatgaacaacttagaaccttcaacttcttctccagctccataattttgatgtctttagatctaagcaattctcttgtgctctcaacagcattctcagactcctacaggcaaacatgtgaattaaaaaaggacaaaaaaatctatggtgaatttattgatctatatatcccatacaatataaacctactaagtgaaattatggcatttctacttttctcacaaaagcacatcatcataattttctagcattttgataattgatctagggtagtagggtgtagattgtaccacaaagccaagccgtctagctataattcaaatccacctcggacctcatgttaaccattttgtcacgctaatttcacatggcgacacacaaggtttatatctagtttcattaacaactaaaaacagtgaaatttcaagagcactagatatacaacaataaatcccacttcaagcatgttatgttccttacttgacttcactacccatccttagaacttaccacattgaagacagacatcaatattccacattctggtcaattaaacagagataagcaatataaaggcaggaaattaccaaaagtttttgtttatactgctttaaaacagtccataaagccctggcaaagtttgtcattatttcttcatttctcgaaactcttcgcaattctgaattaagaagcttgtactgtgactcatctgcgcaaatatatgaaataaacagtatgaggtgaatgttgttattctcttactttattacactgaagataagagaaatatttattacgagttatgcaaagcaaagggtcagaactatgactacagacaagtaagagtcaataatagtactgactactgagaccgaaaatgaactgtgccaaaaaaaaacatgtgatattgaaacaaatgaaatattaatataggtgaatagaacctttttcagaaattgtaacaccatcatccttatcaatgtcatcctttcctgcgacctgcataaatatagcatagattatagtgccttctgagttctgactaagatatgaaataactatagcagacataattatataagaacttgtttgagggaaatatggatcagaacatgatgaagtttgagtgatgtgagggcagtcaagactcaagactatgtggtcctttagtacttatggtacaggattgtaattaaacactaaaaattgggtcaatgataaatcaggacttcaaggttttaaattgatcagcttgtttgaagcactatggagaattaataagttagatgggccaaaatgaacaagtggaaagcttagtaaaaattacatccatactgcaaaaacttcaaccttatgaatcttcctctttttcgtgttctcttggcaaatcagggaagcactgcttctcttttgggaaaccaatccagaagagtcctcaaggttggtatacctgaaagatagcaaaataaaaccagggcccctttgaaacacaggataggaataacacaggaataggaaaaacgcaagaattgaagttgcatgtttctccaatcctacaggaatggaaaacacaggaaagatgaagatggagccctttgatagcatcacaggaaactaacaaagcaaaggaaagtttccaagaggttggacctcttgcttattttcctatgaaattgaaccataggaatgcaatcctatggaaaatgtcctatcctttcctacgaatcaaagggctccataggaaaaattccttaggaaattgaaacctggcaatattttctgatgttggatatcaaatagaaaataaataatgaataccttcaaaagaacatgtataaatgaagtacttgctactgagattttgttttagtacaaacacattattgaaaagatgtggattaaattagtcatatatcgcttccctcaatgcatttcctccattctagggttacgtcccatgatctaaagttgtcccatgatctaaagttcccaatagctgatatcttaaaatatgaccctttcaactagaaatgctcaccctaacagtattggaaaacaaacagaggaaacaccaccaagaagctttgtgtaatttattaggcaatttttacatgcaccatataatttcagtatttcacttgcaattccttttgcattttccagcattcataccataggtcatatgtagagcaaatgtaaaattgtttcctacttccctaaagtcaagattatgtatgtattcaagtttatctcccttcatgtgtctaattcctcaaaataatgagtaattgctgttatgaccaacataacaaatagagaaataggcttagagcggttttttaaaaagaatcaactgcactagaatcctatctggttaaataagatgcagcttacaaaatattttttactctcataagacaattctgtcaatgattgtaaggggagtactttattttcatgtacggagatgcttgtcttagcaaaaaagatgtatccaaataatcatcatctcctggtttcacattcaaaatctgaaaaataagaaaaatcacgattaaaaaaaaaactcaacacatagaccacacagcaaaagtgataaataaataacatagcaggctgcaaatgtcattgcagcacataaatgagcataggcactgttatggatgcagccaaccatccttacattaggaggcactacgaataatcacaaataagtgctcgcttcaatttggatctatcttattatgttatcttttgagtgatgaacttgttccttcaaagatagtacttcctctacacaaaaataagtggtgttctaggatcaaacttttgtactttcactaaccatacccccaaccaccaccaccacaaaaaaaaggagggtaaactcgaattttttagatgtcagtaaaccaacatttccttgatttgataaatatatcgctacaaaatttgggatcaaagagctttgggaactgtgtcaggtccaatgcattgcttaatttgtgacggataaagtataaagcacatcaaaacattttttaaaaaatgtagcctataagtgaaggtgaagcgcatcatttcaggagatttcaataagaatggacaattattttaggtgcaaataacataccagagtcattttcttccttccttccaggtagtctctcaagtaccttgtcaactatcaaaaatcaaaattacaaaagatttagaagaaataaaaataaaattccgtttcaaattaatcttcaattgctacaactggtgaatcataaaatgttgtttgaactttaaacttattgcataaaaaagttttgagagcagaaaaataagtcatcaggaatagaatgtgaaaattagtttttgcatttcatcaacaaactagctcactatacatggaaccaatgtcattagttatataacaaaatatagaaaatcaattgatgtgagaccaccgaaaaaagtgctaagcaagatttatcaattgtaaattgccttgttgacctttagatctgttcttcagattcctcactacaaatagaggatctatgtaaaacatcatttgatgaccataattagggaaagaaatggtgattacacaccaaagggcaaaaaaggatagaaagaggcaagattcaaatccatgttttgcttgtctcaaaagaatatgttgtgtcagcagacataccattgagttcttgaagtgcttctccaagggtttcttcttgtttttctgatgctctaacaaagactgcagttccaaaagatatttaaaaaagcatgcattagcaagcatgacttactgatctgagtatgcaaaacataacttagtatttctgcaaccacctccagatggaaaaaggagctactaaagaaaatccatttggccataccctcaaacagagaccaaaaaccatggatgtattgttgatgaaattactctctagcaatcgtgtaccctgtaaatgaaagagtaagagaaatgtacacaaaagatggcatcccataaaagaaaaggtgttgtgcatgcttcatatgttctatctactaatctatattatagggggagggaccattgatcaagaaacaaacttgatttccagttctcctttcccgctctgcccccgcaaggtctgctatggtcaggacagcattattaagcgaattctcactttctgcatcagagcttttatgaacagcacgtatagtgataatgcactgcgatcgactgcaagacaacataagcgtaaattagtagatcaaaaattagaacaaatgctcaaaatagaaagcaaagaactatatggtagaaagaaaaaggaaagaaaacacagcatctctaccatcattaggaaaagaaaaccttgaaagtaaaatagatatatccaggataaagttttttggttagtgaagatcatatgaagaaatttataaggaaaacatgccttgacttgctgttagcatttgttgcagctgtggtacgcttcagcatcccagaaaaaagtaaggcctcagcatccgcaaaattttcaacggatacctgcagaacaaatgaacttattgcatggtaccaagcacattggtatcagcactaatgtagttcaaatggaatgggccttccccctgactatggtttgtgctccggaatcacagaaagcagagtaaactcctgacatgagttggattaggaagttttcatccaatcggaataattaacaggaagtcacagccagaccatttgaaatgaccgaaaagatgaggtgcacatcctaggttaatgtttccaacatacctctttaagacctttaattgttgactgctggagaacaaggtcggtcgcatcagacagtaggtcaagaatccgctctccttttccctcagaaagtatctcgaacattgagaagcaaaatgatctgtagttatgagaagagatatgatatggaatttaaaaggcttccgtcctccatggtagtgttagaatttagatatgaacatggttaagagaaatattaaaatgatgaaagcatttgttattggaattatgttgaatgacaatgtaggttttggcttaaaaagagtgtaataccgtagtttgctgaagggttcatgtgttgttggagagaagatgcggcgtagcgtgagtggtacaagtccaggattccttggggagccaaagacagtatgggtctttccagagccagtgggacccattgcaaccagaaggccactctttcctcccaacaacaagtcatccaccagcggattcatcacttgactaaatacatcatgctgcatatattggagtactagatatatagtagaagatcatctacaaacttaacacgatggatggatgcagtcagaacgcaacgaaaacctcacctgtgaggaatcgggtgagaagacggaggagaagccgtcgaagacctcggtgcggccgcgcttggggtcgaggagcttggaatgcgggacggtgagcgcgacggagttgggggagttggcgacgaggcacacttgcttgggattagttggggacttggccttgcccttgcgctccgggagcgggagggggcggatgcggaggaacaccttgagccgctccgccgcctcctcgagcaagcgagagatctgggagggtttggaattggggagaggggtggggggaggcctcgcgctgcgtggagggttccgccggagggtgctcggagcaggcggagaagccgccgcgccagcgccggcgccggtgatggggggctccttcaaattcatctcgactttggggtttgggggtttggtgctcagcctcaccattccattttgaagccaactccctccgctcaaactacacttttcttttgtttcgggggagtctgagggaagaaatgaaagtttaaaatatttgaacattttttatctcggtttgattggaggatttgagaattagggttggtttggttggtgttctatataggcattaccaaattttttttaatgccaaatttttgtaagttttggtatgactaattttagtaaggcaaagttgtgtttggattgaagccaaaatagcctaagttcactattggaatgcccattttcttagacatgctaaaattcggtttcaaaccaaatagacactaaacactattaaaattgtgttgacgtaaaacacgaggactgggagatctgcttagctcctgtgcaggtccaaaggttggtgatatgagggcgtgccagttagtttgatcctgcaactgacaagatatgcaaatagtagatcaaaacagccgatcggctgacaagccgatggagtagttctagccgatagccgataatagccgatgccaataccagccgatagcgatagggtttaagcaatcggctatatgtccaatgtagatgatgatataaaggcaatcggctgatgatggtgtaataaaataacaatataatccagtataaattaatcggtaaataatgatatgataaataagcatcgatccgaaagttaaagcacacatcggctggaggtacgatgtcatgaaatccacaaagattagattaaacagtgaaacctttgttgtcatctgctaaatccaacttatatatatatatatatatatatatatatatatatatgcaatccttatgagccgatgcaacgtccagataactcaccggctgaaaccccgatgaaacccttattggcattcaagaagcaggctagagattatggttctaagcacgacttagtagatcaaacttaactgatacagcactaagtatgaaaaagaaacataatatctagacaatcaagccgttgactgagttttcagggtggtagatgtataagttaatctaatctagcatgacgatttagccgataccggcataaaccctaaagcgagaagcagccgatagagctaaattgagatgctaagactagattaacatagacatatgataaatagccaggcaaatatattatccaaaccagagtaatccaagaggtcgaatgtaatgatgcagccttgaacgacgccgacgtagacgatacaattgcctggaccggtggaacattggacttatcccttcgccggagatcgaagacgatgcagccccacgtcgggtgccaagttccaccggaacgtaaaaataaaagtaaagcaaaagggtggcgatgcgccgaaattgtattgaacgtgtgtatagattacataggccctgggtgtacatatttatacccatgtgttgatacaagtccttgtcggacaagaaagaaacttttctaaagataaaaggaaaagataaagtccttataggacactaaacacactttcctaaaggaaactaacaaactattcctaattaatagataacttgccatgccgtctcttctggataagcttcctttagtagatcaatttccttaactgaatatagcaagaatccgacaactgacgacttgacaactctcatcgactaatctcaggacttcaaagccgatgctgactctaagccgatgactactccggacttaccaaatttcactgttaacaaattgttatatattggtgagcctaatgcatacatgaacatggtgccgttaatggatatgggcttctcagtgtgaatgttggtacggttgagatcatctggatcaaggccagcaaagcgagatacagtgaccttgtattgttgtccttgagtcatccacttcaattgaagttctccacttccagcctgcccaaagtatatagtgcgcatcgaactgccccatcacgtcctcacaccaaaatacacccaagacttaaactgtggccaagatccttgttgatacaaactagcttaaataacatcattggaggcataagtttgctccttgttcatatactcccagtcccacttcatacttaatttcttttaatatatttacgtgcaattattttacgcgtttgccaaaaacgtcaacccaattcataggattcgatcttgccataaacatgaagttgtaccaatcaatttggaaatcatgcggaagcgaggatctttggactcgtgaggaagcagagtgtcttggtctattttgcgtacatgtacattcaatagtattacacttagggataaaatcttaaccactaatttattatattttagccgtaaaaaaaaatctgatagttttaagattgtaattatgtcagaattttatcttctttttactctatgtataatgaattttaaaatgcaactttgcacgtaaatgtaatactattggaagtacatgtgtgatttttttaagaattttttatgataatttttagttggtgtacacggtgggtacacacgagggtctgtgtgcataggatacgctcccgtaaactgcggacatcacttatgtgtgtgtgtgtttgtgtgacctggcctttgtatgaatggaagtgatatccgcagtttataatttgtatgtatatatagcactggtattatggctgaagatcgagtagagaagaagaaaaaaaagctagtagaggttaatactagtagtagtatatagttaaaaggaggacatgcaaaggccattttggtgttaaataatggagtgtaagtaaataaaaaggaagggggggcggcaggcttcacacaaagctggcgcgcacacagacgcatagcatatataggatgatgcgtgtgttgtattccatcatcatcaggtagcgcgcgcggatagatcatatctagcgtggacgatggcgaggcatcggtggtatgtgcaggcggtggcgctgctggtggtgctgaaggcggcggcagggtctgcggcgccgccgacgacgacgaggagcaggagcagcagcacggtggtggccgggatggtgttctgcgaccagtgcaaggacggcgccagaggcctcttcgactacccgctctacggttggattgcttttgcatttgcatataaagatactacaatttgattgcaataatccatgatgatcgatgatcatgggggcggcggcgtgcttgaggcttgagcaagctacctgtccgtcatctactctactgtgtgcagtgcatgctattctccttgcctacctaacctgatcaattagtactttacttcctttattattctttccttcagaaatttgtggttaatttggatatgctgtaaaatggaaggaatgcatttgtggtgggtgcaggtgcgcgggtggcgatcgagtgcggcggaggggagagcccggtgacggtgcgggagtgcaacaccaactggttcgggggattctccgtccgcatggagggcacgcccgagatgaaccgctgcacagcgcgcgtcgtccaggccaccggccactgcggcgccgccatccccaccgcccctcgcgacctcaccctcgccttccgcatgctcggcctcgccctctacaccgtccccccactcctctcccagccgctccgtcccatggacttctgcccatctccattaacatctccatctcctcccgccctcgcgctcgccccctctccgattccgactccaatcatcgcgccgccccccgtgtcctcgccggctccccctctcccgcccctctggcgccgcaggcctcgccgcctgccgcccatctggcgcccgaccccaccctcgctacccgttgacaccatgccgccgccgccgccgccaccgccaccgcagccgcagggctccgcctgcaccttcgagtacgtatctatctactagtccttccttaataatttgaacaacatatagatgattaatgaaatgaaatggatcgtcagcaagtgggcggacgttggattgcacgggtgcaactggaaggtggtgacgcccaacacgacggtggccatggcgttcggccccgccgcggcgcagaggtacggccccgacatgacgctgcgggaggcgctggacgggaggggagacatgtaccggacgctgctgcgggaggccacggcggcgctcctcaatgcctactacaaccccagtggctccggcttcctgtaccccaccaccgccagcgtcatcgaccacatcaacgccgccctcctcacccccacgctccacaagcttctcctcgagggtgcgcgcttccgccgcgccaactccgactccaacctgccctgccacctcaccccctgcaactaattactactcctgcttgcttactcgatcgctaatgcactcgtttttcattttattactcgctacgctaatgtattactagtgtctcgactcaatacttaattggtggatggattttaatactacactactactactggagtactatagtacaatcgattcaattttattattacttaattaactaatagtagcagaacatgcataccgtatgtactggaagcatcatcccttgaccagccaatttattatactccactcgcgcggtcaaaccaagtcaatacgacaaaagcagagcagagcagaggaaacgtttgctgttcaaactaatttaaacagggagctactactacagactactcctccactagaagtagaggaattaccactagtagtagagtagtacattccaattccaattacttgagtagatccttggattattcattccatcaagggttggattcaaaaactagacatccaaattcattcattaattagaggtaggtggagtagtaagtaaaagaagaaaaaaaacgaaaataaaagaaagaattaggagcagattgggcaaagcacgaggccgttctcgttacactcgccgcagcgcaccaccaccaccgcccgcgtcttgttgctccttgcagccgccgccgccggcaccggcgtggggagggagaagcagagcttgcggctgccgttgcagtcgaagcagggcaggaatcgcatgccgccgcatccgtcgcagcagccaccacctgggcgcgccctcggcaggccctccagcagcgccgcaagcttgccctcctcctccaggcgcgccacctccgcggcgccgccgacgtggttgccccggacgaacagccgtggcaccaggggcgcgcggtcgtggtggtcgagggagatgcggtggcgcaactcctcccggaagccgcggtccatggagatgtcgcgctcccggaaggcgacgccgtgcgagtggagcgcggcgcggacggcgttgcaggcctcgaaggtggcgcgcacgccgcgaagcgtggtggtgtagagcagaaccccagcaggaggagcaggaggaggagagtggtgcgtgggcctccgtggtttctgtggggtggcggggtcgaggagaccggccatgagctcccacgagttgatgacctccgcctcgccctgcttcttcagatgcttctccggcggggctgcacatggtgggttggtggtggtggtgggtcggggaggcggcgtgggcggaggaggaatcctagtaggggattgggattgggattgggattgagctgatgatactagaatgttgtcgaggatgccgtaggtggaggaggtgagggagacgatgtgggaggcggagacgccgatgatgcgccggcggcggtcatcgtcgtcgtcgtcgtccacgaacgcggaggcagcgcaacccatggtattggtattggtatggtaggaaggaaggattcgattcgaggatgattaaggagaaaggagagtgaagaagaaaggaatgcattcaaatttcaaaacttgaaaccgccatgccattggatggcactgtactgtactactcctacattactctattgggcctgcctctctggtcgttgggcttggcctactcctgcatcaccatgtatgggcctaacttaccatgctttaagatggtaccaccagttaccagaagtaatcatttagatcctctttattttaggcttttaaccgatcttttagcttactagacaaaaaaaaaaaccgtgcgttacaacggaaataaaacacgagaacattaagaaaaagttgagaaagatttacattatgtaattaattaaaatacaaatttcaccatccttcatataaagaagatatatttatattcctatttttatttcattcccattacatatgaaatcgcaattatacatgtatacgatgttgaagaaaataaagtatcatgaaaatcaaggtaaatatgggtaataaaattttccaaatattggaactaatttttattaaattctccatgattaattacattatctgattttatttttcggaattttctgagctccattactaattttaaccatacagacatcatttcagtttttatttaaatgaaaatctaaatgaaaaccatactttctctctgggccattttcagcccatttatttcctcagcctgtagccgagccggccctttttccttcggaaaaagtacatccaagatccctcaacttgtcatcaagatacaaaatcgtcccccaattgcaaaaccagataccgggcatccctcgagtaacaaaatcgttcgctttaggtccctcgtagttttaaccccagttttgtccgacatggtggccgagtctgcgtgggacccacgtgagccccacatgttaggatgccacgtcatctatcccttcctcttctatcagttttctcctcatctggtaggcaggctagccggcggttggggaggaagtcgacggggcgagccgggagaagaggaggttcggcggcggtggccagcgatcttcgatgcagcagcggcgacgaccacgcaggagcaggccggtcggcggagcgggaaggcgacgggcggagcggcggcggcagctgcgcctgccgcaccggcgtgccggaggaccgggcaagcagggggcagagctggcgacggcgcgggccggagcgaccgaccggcggagcagcccgcgccgtcgccggcgggcggtgggcaggcgtgctgcaggagaggaaggggctgcggcggcaggtagacgccgtcgtcgccacgttcaagctcggcagccgccgttgtactgctcgacggcggtggccagcaactacaccaccgacagccagtactcgctcaacctcaaccagctcctcgcactgaaaaatggtcaatgtgtggttaacgtgtggctttaactttgcagtccctatagatgaaaactgaatgtgatttggttttgtgttggccatctgaacttgtgaattgattctgacattggcaccatgtatgcaaatgcacaatactcggaggctgagagcaacgatggcttctacaaagcttcgctcggcacggcgcccgacgaggccttcgccctcgccatgtgctacgccgaccggaattgaacggaatgcgagagctgcctacgcgcggtggccatcgggatggcctccctctgcccgcggagccgtaatctaatacggactagtagtctcttgcctcattacacgtaaggggaaaaaagaactggtccaagctagtttttttacttaacagtgtaaaagtgtcttatgacttttcaaaaaacaacaaaaaaatcagcttattttgtttacttaatagtgtaaaaatgtcttatgacttttaaaaaaccaaaaaaaagcaacttatttgagtccaataaagagggtcccaaatccagctattcaattgctaggggtcaaactggactttttcctatcaatttattcacgatccatccatccatccggcccattaatttccttcccattaaggcaaagtgatgattactactccccatctcaaaataaatcgatttaatacttagatatgattaatattttctagtataaaaaatttagatataagcatatctaaatacgttgtatattagaaaatatgtcatctaatattagattggtttatttaagacagagagataagaagaagtaaagtactccatccgtattttaatgtatgacgttgttgactttttgatcaacgtttgaccattcgtattattcaaaaactttatgtaattattgtgacttaatttatcatcaaatgttctttaagcatgacataatattttcatatttgcaaaaaaaattgaataagacgaatggttaaacgttactccctccgtcccataatataagagattttgagttgttgctttcactgtttgacaactcgtcttattaaaaaatttgtgcaaatataaaaaacgaaaagttgtgtttaaagtactttagataataaagtaagtaaaaaaaataaataataattccaaaattttttgaataagacgagtggttaaatagtataagtaaaaactcaaaggagtagtaaaaatatcaacggcgccattcagagggagtagcagatattattgatacgatgaaacgatggatggatggatgcatgcctgccttacctttaatttttgcatcatcccattgattgattcgctgattggctcacccggccttccatgatcgagtagtaaattgatccatgattgcagcccaagaaagcgatctatccacagtacgcaccaaacccaacccccaccaggaggttatgactccgttcaggttcaggtgtgctacctatctgacgagaagcgcaccatgcaggcagctactcctactacttttccttgttcacatcatccatccatccatgttcaacctaagtggagtaataactatacttgcattaacacaaatgaactgctatagcttcatcgtgtaacacatatcacactccaaccaatcatacatgcaacttaaaaaaaaaatcgatattctaatgcccatgaatattacttatacgcaagtgggttttcaatggaaatttagtgagataagtgatgtgccgctaatttttgtctcttttaaacatgtgttagagggtatattcgtgggtgtgtgaatgtggtattgtgtgtatggtggtgtgtgcgcacgtccgccatgtaattgaaaaaaagaagatatatgcaactcccataaaaatatcgatatatcaatggaacacttcacattttttagattatttgttagttaactgatattcccgtaaaaacaatcattttttaacagatatgcagggcgatatcttactttgggctagagggaggctcattgccttcctcctcctccggtccctggcctattcttctttctctacctcatcttcctcttccctctctccttgttctctatatatggtgatattcagcgtgggtatgcatcggaccctggatctgccccggactacagtcaatgcacatgttggatacgacgatatagccatcatatccaacttaaagtttattttgcttttctctttaattaatttggtgcgacaacgacattacactaagtctgaaattggtggattttgccggtctcactacctttctccctaccggtatgtatgtgtgcactactattaccacacaatataatgtacgatcattaattatttgtaactatatatgcaacagatagatgctgatgagatgcaggtctctttcgtgcatgtcgtctaaagtgattacaagtaaagaaagaatctctaagtggatactatgaaatgtctatatagtagggtgaaatggatcaaattaatcccccggcctctagctactaaggctacaggtgcagtgtttcagagcaaggttaatagtatagcccactactaacttcaattcatctatagctaatttatacaatagttgattactatactataaatatatggtcccacctgtcatacacacactgcgttttggagttcgtgctgcaactggctacaaatctgtagcctgctgctcttctctctcatcttttatcttattaaaatatgtttatagctggctaatagtctgctattgtacctgctctcacaggttccattaatagccaattgcaaggtaattatcattagtctagatgagctgcataactagcctacgaccaggcctggacatgcatgatcgatgcatggcacaacgttgcaaatatgagtagtatttggtatttcaggttataaaatatttttgattttggtcaaagtcaaactgctttaagtttaacaagtttgtagaatagtaacatttacaaccgaagacaaatttattatgaaaatatattcaattactgatttgatgaaactaatttagtattataaatattattaatttgtttataaacttagtcaaacttaaaacagtttgactttgaccaaagtcaaaatgtcttacaacttgaaacagggggatattattttcaggggtgggggtggggggaggaagaagggattgccgcatgtggggtctaacaccatgttgtccattttgttttcatgtatgtgccacttcagaccgaaaccgccatgtacttattaagagttaagatatgagagtagttcatacggtttcaaaaattcacaagtgttaaatgtctggtgttaatgtagtagttgaggagtaaatcatgcttttttaggatcacaattaactgtacatgtacaatcttccctactactgcaaatgttctatatatcctccctccgtttctaaatatttgatgctttcaaaattttaaaatatgtttgaccgttcgtcttattcaaaaaattaagtaattattaattcttctcatatcatttgatttaagtaattattaattcttctcctatcatttgatttaagtaattattaattcttctcctatcatttcattcattgttaaatatacttatatgtatacatatagttttatatatttcacaaaagtttttgaataagacgaacgatcaaacatgtgctaaaaagtaaatggtgtcaaatatttagaaacggagggagtatatatgaccgcaaaaatgtatatgtgtgtttgtattatttgtaagatttttttaaaaaaataactactgcatagagtatatgcatatacatggtgaatggttagatatgtaagtggtaagttcaataattacatcctcaaaatattttatgtttttactgtaagatttggttaaaaattatccttaaccgtcaataaattatcaaatgtctaatttaaaaataaacaagataaacttgtgttaaatttgtataatagtaatatacaaatttgttagttggaattaattataaatttttgacagaatcttgtgttagacgttaaatatttataaaccagccaaatgaggtaatagcgaataattatatctaaggcatatatgagatatttagttgagtccattacaaagaatttaaggaacatagtgagaaaaagtaaaaacggtactatatatataatattgtgtttatatttgggacggagggagcaagtagctagcctcttaaataagtatcatcctagtgggggagtaccatctatctatcgatcttcttccacacgcgcgtacgtgtgtgttggtcgtctcaaggttagttattgaaacgtatgtcttatattactaatttgtttcatccccgttgtatatgctatatatgtttttcttatcttatgtagtatatgtaattaaaataaataggagaagaattaagctggttaattattttttctggctggtatatgcataatagtaatatatagaagagattgtgttgcagggtatatatagcaaattaataatagatagatcgatcgatcgagtggagacgatgttgccgagaagccgaacgctcccgccaaggattcatgatggcgtcgtggtggtaagcaagcacagatgttgcagtgttggtaatggagcatattgatagatgctagctgcatgcgcgcgcgcgcggggtgatcgatatatgatatgatggatgctgcaggtagaacgcgatgtgaggaggtaccagcagctgccgcagcaggtggagatggagatgacgacgaccaagaggcagcaggatcatcaggtggagacgatgacgacgaagaagattgatgaagaagatgaagaggtggacgacgacggtcgggcgaagcggagggggacggtgtggacggcggcgtcgcacatcatcacggcggtgatcgggtcaggtgtgctgtcgctggcgtgggcgatcgcgcagctgggctgggtggtgggccccaccgtcatgctcctctttgctgccgtcatctacttcacctccaacctcctcgccgactgctaccgcaccggcgaccccgccaccggcagaaggaactacacctacatggacgccgtcaaggccaacctcggtcggtcgatctagctccttggatcttgcatagtactagtatatacactacacagatcgagatatctgatccatcaatatatcgatgtgcaggcggtgccaaggtgaaggtttgcggatgcattcagtacctcaaccttttgggagtggccatcggttacaccatcgccgcctccattagcatgatgtatgtgcgtagttgttatattttgggagaaagagagagagagagagagagtaataataattaatggaagaaatgcatggtataaatatgcagggcgatccagcgttccaactgcttccacgcgagaggagagcaggatccatgccacgcctccagcaacgtgtacatgatcatgttcggcatcgtccaggtgttcttctcccagatccccgacttcgaccaagtctggtggctctccatcctcgccgccgtcatgtccttcacctactccgccgtcggcctcgccctcggcgccgcccaggtcgcccagaaccgcacgttcgccggcagcgccatgggcgtcgccgtgggcttcgtcaccaagaccggcgacgtcgtcacccccgcgcagaaggtgtggcgcaacctgcaggcgctgggggacatcgccttcgcctactcctactccatcatcctcatcgagatccaggacacgctgcggtcgccgccggcggaggcgaggacgatgcggaaggcgacggggatcagcgtggtggtgacgagcgtgttctacctgctgtgcggatgcatggggtacgcggcgttcggcgacgacgcgccggggaacctcctcaccggcttcggcttctacaagccctactggctgctggacgtggccaacatggcgatcgtggtacacctggtgggggcgtaccaggtgtactgccagccgctcttcgccttcgtggagaggagggcggagcggcggtggcccaacggcctccccggcggcgactacgacctggggtggataaaggtgagcgtgttcaggttggcgtggcggacgtgcttcgtggcggtgacgacggtggtggcgatgctgctgcccttcttcaacgacgtggtgggcatcctgggggcgctcggcttctggccgctcaccgtctacttccccgtcgagatgtacatcgcccaccgccgcatccggaggtggacaaccacctgggtcggcctgcaggcgctcagcctcgcctgccttctcgtctcgctcgccgccgccgtcggctccatcgccggcgtcctgctcgacctcaagtcctaccgtccattccgctccacctactaattaacgatcgatgattgtgctactagaaaggaaataggtatccgatgtatcatgagcttgggctggccataacgatgcaatattaataaggcctcaacccacaagatgcaacgatggtttcaattataaggttgggctagacacggttcatccacatatactagctttcaattactaagtattcttattttcttattgaaagtcgcttgctttttttacacgacaatgcatcacatcaacaaaacatactactagttgaaacctcatgttttactgcggaatttgaggtgaacactcgtcttatgggaagatttatagaacaaacctacaaagggattcacaataaggacatacgatttacatcacattaaaccactaaataagtagaaactaggataaaatgtagaattggacaacatgaaaagtcaaaaacagatcgatcaagtgtttgactcggaaagatcgatgggttcgtggggcgcggcatatattagtctatggcttcatgccagtagtttgcacacatcccgtacgttcgagatcaggccatggcccacgggagtgcgtgggacatggagtacataatgaaaggtacggtggcccaaactcgatcggagaaggcacgtacgcttccggctacacgatcgagcggcgggacgcgggatgatgcaatgcacgacgcgaaacatatatatatatatatatatatatatatatatatatatatatatatatatatatatatatatatatatatatatatatgtatatatatatcggtggatgaaaaaaaggtcaacggcgtcatacattaaaatatggaggtaatagtagctagagatagaaattttgacataaataaataaatttgtcctattgccaattctaattgtcaacaatatgttgtcaaatatcttccgaaatgccatggatatgcaagaaaagtatgctgtacgtaatacaccaggactagatcaggttctttaattttacaattaattaaatgcgtggaattctccgttattagaaaataaaagacgatgaacttcctgcctgccatgatatgagataatgaagtcacatctctcaacagagatgatcgatcgatcgagtgctcctagcttgcccgcagccagcacagaaaatcagcgctagcttaattagctagctatacgtggatgatatcatccattgcatcatgcattcatcttcaatcacacttaattagtgccttcatctctttctttctagagacgcaattttaaattaaaaatcggtctccgtacgtacgtcgtccgtcgatcgatgcctaattgagcacgccttaaggtaagacaagcaccaataaggaaaatattatcccttgtgtgtcaactactaacagagaacaaaacgttctctgttgatgtgtcaatcgatccatgcatgttgcttaagccaattaagacaaattgccaaaaaagaaaattaagactttgcttgtccccctcatgacaacccttaattaaggtgcactttgatatagtttatacatgatactggaaggacagacaaaagtaatgttccttgcaatcaaaggttatttcctgatacatttacaacataaattatcctttcaactacataatccaggaaacaagtttgattaaattgtctaacattatacataatattttcgagcattgctccggtccagcatattgtacctcgaggtaccaatttaaatctggccgttcattcacggagggtaagatagaaaatatcacacgctaagcagctcgtgatgctccttctctctgactgagtgactgtgtcaacgaagactccaagagcaactgagcaagtccaaaccaagagcaagggcgtggtgggagcgggacgaggggtggtcggcgccggtggtgccggaggcgttggcggcggggtgttggacggcggcgcgttgggcgccggcggtgtctgcacggcggcgaggtaacgaggagcaggaggggtggtcggcgccggtggtgttggacagcggcgcctgcgtcggaggctgctacgcggcggcggaggcgacgaggacctgcgtcagttgtcgatgtgctcgaatccggtagcgataggggaagggccgcggtaggcgtatgtcaccggcgagcttgggggaagtgatgcacggaggctcgtcggccccctccacctccactccggttagcctgtccatccctggtgagagccatcgatcaatgcaggcatgcagcatcttttggagagagaaaagacaggaggaagatgaagaagatacatgcgaaattacttaactacccttgcttctttagtacctctctatgctctgtaaaatcacgtggacaatactactaggtacaactctttctcacccgttggatcaaacgaaatcgatggctcaaattgcatgtaccggtaggtaccaaggtacctgctggacagtaaaaattatcaatattttcatgtgttccaactcttaatgtatgatgctatcacataaacaacatgtcttttataccggtttgggtggcgtagtacctacgtaatttatgctaaaatctatgtgattttagaaatgacatttcaattcatctatttattagcgggagttggggatatgcccccatcaccttttttttatgtctttcttcttactttaagatttttttttactatgtacccattggtagaactagagatgtaatccatttctattaaactttaattaaattagagtgacttcttcaataaaggatctttatcaggaggggacgatctcaagtagctgccttttttttttctttttaagagaacgctataaaattgatcatatattgaaggacgaaacaaataatccacgataatataatcagataattaaaaggatcagatggacagagggagagagccaaacatagaggggcgggttaatcaggaggtaagaacaagtggagaagacaaggataagagatgagaagagcaatgagctatgtatcaataaaataattgatgacctggcagcttagcttaattagtgcagctggaactgataggcgcgcgattgatagcttataaatcgaaggagggggaaggcctcatctccgtgcatctcgctacctaacctagctaacctcctctcttcttcttcttcttcttcttcttcttcttcttcttcttcttcttcttcttcttcttcttctaggctagcactgcacgtgcccaactaacacatacattcatcatatatacacctcctcctccttcttcctctaagttgtgtgtgcatatataatctactagtagagagcagggctaggctagcaattgcaatggcgcctccctatgaaaccaggtcagtcagatcagaattatatatatttatgtactaattcatgacctgctagcaactagatagtaaaagagttataatctatatatatgaagaaattgaaatctcggtatatatgtatctgccttaatgcatgcagcgccgccggctctgaatcgccggtgccggtggtaacggtggatgtggcggcggcgagcgaccttatcacctcggccggccaccgttacgtcgacgtcaggtactactacctatctgtctgtctgtctttgcatcctcccctagctatatctatcgatatcatgtaggagtatatgaatatcaggatatatatgatccatccttaattaatttcttcatgcatgagcaacgagagcatatatatatacctcctaattaatttgttggagaaatgaaattacagcacatgcatgactatgtgtgctggtatcttcgtctgattgatagagcaattaaacatgattatgcaggacagaggaggaaatgaacaagggccatctacacaactccctcaacgtgcccttcatgttcgtcacgccgcaaggcaagtcagccagccgattaattcactttaatctgtccagatttttacaccatttttcatcgtcgtccaaataactagcgtaatcaatatatatactcttatgattcaatactagtactttaagaatttggaacaagaaattctgtctacacatatcgatctcgttctcgctcaaacatatccatccactcctatcattttcatgaatagtaatttcccactacaaaacgatatactactatatgcatgatgcttctggttgttgggttgtgtctgtacctgggcatgttgagcatctgatttatgaacgtggacgtgtgctcgtccaggtacatacggggggagtaattaacaagcatgattatatttatgagcgttattatcatccatgttgcagggagggaaaagaatcctctgtttgtggagcagttctcgtcgctggtgagcaaagaggagcatgtggttgtggtacgatacgaattaaaattaaaattccccaaaaaaatatttatttgacaagaaataatatatgtgctcgatctaattgacgaaccttgtaataaaaataaacaatccaactattaggggtgccaaagcgggaagaggtcggagctagcatgcgttgatctccttgaagcagtaagtttgatgtttttaatcaaacacgtactagttgcacttgtacttgatcgaccatcatctctctctacgtttctcattgccttgttgatggctctgtctcttgttccctgtttacttcccacacacaaaaaaaaaattacaccatatcacatagaacatttgaacacatacatacatgattaaatataggctaaaaaaacaactaattacgcagattgtgactaatttgcgagacaaatcttttaaacttaatttctccatgatttcacaatgtgggctacaataaacatttgctaatgatgggttaaataggctaaattcgtctcacggtttactgacgtattctataattagtttttttattagtgcccaaacacccatgcgataccttttataatacccgatgtgacacgccaaaactttacacatttgaatctaaacactcccttaatatacatacagtgaaacaaataaagtaaaggaagacgggacaggtcatgattcatactcctcgtctaaaaaaatgaatatataactggatgtaacatattgtagtataacgaatctgaacaacgatatattcagattcataatattaaaatgtttcacatccagttttagattgattttttatagaatagattggttttttatggaacggagggagagtacgagtgagttgtaacatgactgacatacagtatatatgtatctgcaacaggggttcaagaacgtgaagaacatgggaggaggctacgcagcgtggctcgacaatggattccccataaacactcctcctcatacaatgtattaacgctttgcagcaccgatgagatgagcgagtgataaacacggactctactgtatctactgtatctcattccaacccctcttctcatctgcctgctagccgctgcttcgtgtgccctgccatgtatatgtatgtgcgtcctgttttcctgtttgttactactggtattatggaggcagccaattgaataaaattgatcatcatgcatgcaatgcacgatgcgtctgcaaatctccgggatgacatcaatcaaccaagtagctacacatgttcaaggactttattatctctaaatcagcatattgtggccggtttgccaatccaccataacagtaggcgtgaggcagagcctctggttacaaatccaaacgaacgactcataccaaaggggcaggccaccttatgcaagaatcatcaatcaaacgtttgcttctcttgccatctgctatgtgctgcgccgttggcactaaagcattgattgatcgatcacctcaaaaattacagtctcacatctcagactgccggttgcagggcaaagtgtagagaaaccaacatccaaacaaatgaagaccacacatcacacggttagatgtgcaattagctctttctttggacgtccatcgccacagccagatggcgagctccacaggacaaacaaattgatgactacaataagtatgactcaaccacggtccgcccaaacttctgctcaacatcctttggcgtttcaatctgcaaacaaagcaacatgacaaatcatttctctacttgaaaaaaaaaaataaaggaagaaataaatattgcccaaatgttgcaatgagaagctaaatatatttcgagtaacgggcactcacggcgtttaatgctatgaagagagctttgataacattcagggggttccttgaaccaataatctgcaagtaaaagacagaaaattactactatctttcaagcacggatggagtgataactggttgcctatctagaagaagtgcacctttgacttgacgttgctgaaaccagctaaatacagtactgtttcaaccgtcctaccagcagcagacattccacttctcattggtccaggccagaggtatatcttaacatacacaagcagcaaccatgtccacataagttgcagcaaaaccacagataaataagaagagcgctaagatacacagatgtgtttttacctttgtcttctcatatttggcctgaattgcatgagcaattgtgtggtcctcatatcgctccatgtaatggaggtcctggaagcatttctcataagcctgcaaacgaaaaaaaaaatcaataaaggtattggatgccagcaagaggcataaattagctcaggtattagtctaatcagatgtccaaacccgcaattgaggatcctcgacgacaatatataagaggaagctactggtatagggccataagaaaaaaaaaactctactgcatctagtaataaatcctgcattaacaaggatataaatgaaaaaggttctgaaatgagaaaaaaggcatatgcagtgcacataggttagcaccacaatcactgcacaaacatcccaaaagaaaaggtgaacaagccaacaatgaaatggataacacatcagcgactattctttgcgcgctgaatgagaaggcaatcataaagtcgcaccgactacaagaaaaggctctaccaaacaagttgtagacgtggcactgaaacgtaagttgaataagaaagatccataccctttgaattgcaatcttggctgtcggacctctagcttttgcaaatcctacaacaccatggtagtttccagtcgctaacaatgctgtgaattttgctatttggcctccctgagacgtgaaatgcataattgggtaatgggtcagacaaaagggtattactagtaggcgtgatcatttgaattcgaactaagagaattcacctttgtgactttacacgtccgattaacatcaatgaccttgacgtcaaaaccctgtaaagtgcacaagatttgtaactaggtaataccaataacaacaagtgaaagcaatgtaaccacaggatagggtgctggccaatccaatgaaagctcggagatgaacatcacttactttcctgtacataggtctcctcttatgctccgtgagggagttgcgctcttcaacaagatccttaatttcctcctctagaactctgcccttcttaccaaacgtatgatctaactcagctaatttctcctcgatcttcttttcgatagaattcaacttctctatgagcagatcatccttctccttgtcttcattgaattcctcgtcgtcgtcgtcgtcaccagccccttggatcatctgcttctccctgtcaaagccagcattgagcacaagatcctccggagagccgacctgctggtgttggatgaccccgaaattggaggggttgctgggatcgtatgcttccctgcattccatgattctaacagctcggttaagcttctggaggagaagaaagcggtccttgccggtggcatctttgaggcggttcatcatgtcgccgatgactctgtactccagtggaagcttcaaatggcgctcctcgaatctgtcgatcttggtcatccatttgtgggcatcgtcaagggtttctggcaacagcgggaggtgtttgaagtgggcattggcgaaggaaggaaggaaggaaggaagaggggaatgggctttaccggcttcggcgaaggagcgtaggagttcggagtggcggttgcacttgcgctcgaactcgtcgacgcggcgcttgatggcgtcaggggtgtagcgctcgtcctcctcgtcactgtcggagtcggtgggctcccagaaggaatcgtccggcgcggcctcctccttggccctgcggcgctcgagcttctcgatgagcggcttgacgcccaggtagtcctcatcctcaccctcatcctcatcctcctcctggcggtcccgctggcgctctcgctggagctcggcgaagaggtcgtggatgacccgctcgctctggatctgcttgagcctagagctgccggaggaggcgttggcggagaaggcgaagtggcggcgaggggaggcgatccgcagggttagatggtgggtggaggatacgggagggctggggcgcagggagaggaggcgcgcccacgcggcggaggcggcggcgcgggaccgggcggcggcggaggaggccatgaacctcccggcggcggaggaggagaagggttttggtagccaagtgactactggaccttccggactatactgacttgtgtgtcggcctgcccccatctacatttcttagtggcccatctatctatctatctatctatctacgaataagttcatttaaggtcctttaacttgacagcgcgttcgattttatccttgaacaaaaaaaaaatcagatacaacgggtccctcaattatcaaaatcggtacaatataggtcccacgacagtatatcgggtggttttgtccgccgttgcaatctaagtcagcgtgcgcccaacatgtcagggctcccctcacccgttattctctctttctctctaccctttcccccttccttttcctagtctaatactccaataccatcaatgatgaagcagggttaaggatacctgttgggagggtgggggatgaacatcggcattggcacagcccctcttccctatctttcgtttccaacggctgtaggatagaggtagctagcggtggtagaggcgggacacgacgaggtggtagtagtgatagccgatgaggagcaaagggagaccaaggcccgcgacagtggtgtcgacatcttccttgcaactgacattgtcgtcgttggctcgtcttgtcaccatctccctccgacgcaatggtgcaaccccatattcgcatcgccgttacatcagccacacgaaggaggaggatgaagggagctcaccagcgatgaggagcagcgagaatgaggacgggcgaaggaggagctgctggaggcctggagcgaggtgacctagtaggcaagcagtggtggcagcgggcgtcgggacagggcgcaacggtccatggatgtcaattgtcgtcctcctcaccattggtcttctctagtgacgctttcaccacctccaccgatgctaaccctaacgctggtgctgccatccccacctctaccgatgaacatgccaccccctctgcccatcacatgtgagcctaccaccaccacccttgacgtcatagtcggcctcctccagctccaagtccccccaacaactggaccgtgctggccaatgagatgtgaacaaggggaggaagagagagagagaggtgaagagagccctgaatacgggtcccacactaactcacacgctgttgactcaggttaaattgtcacgtcggacaaaaccatcaattatactgtcgtgggatgtatatttgttaacagtgaaatttggtaagcccggagtaatcatcggcttagagtcagcatcgtcttcgaagtcctgagattagccgatgagagttgccaagtcgtcagttgtcgaattcttgctatattcagttaaggaaattgatctactaaaggaagcttatccagaagagaccgagttcaaagagaatacggcacgacaagttatctattaattaggaatagtttattagtttccttttatctttaggaaagtgtgtttagtgttctataaggactttatcttttccttttatctttaggaaagtttctttcttgtccgacaaggatttgtatcaatccatgggtataaatatgtacacccggggtctatgtaatttatcttcacgatcaatacaattcggcgcatcgccaccttttaccttttctactttattttatcgtccggcgggacttggcacctgacgcggggctgcatcggtgttcgatctccagagaaggggtaagtccaatgttccgtcggcccaggcaattgtctcatctacatcggcgtcgttcaaggctgcattagtacattcgacctcttggattgctctggtttggatgatatatttgcttacctatttatcatatgtctctgttaatctagtcttagcatatcaatttagctctatcggctgcttctcgttttagggtttctgccggtatcggctaaatcttcatgctagattagattagcttagacatctaccaccctgaaaattcagtcgacggcttgattgtctagatattgtgtttcttttcatacttagtgctgcatcagttaagtttgatctactaagtcgtgcttagaaccataatctctagcctgcctttgactgccaataagggtttcatcggggtttcagccgatgagttatctaggcgttgcatcgactcataaggattgcatatacatataagttggatttagccgatgacaacaaatgtttcactgtttaatctaatattgtggatttcatgacatcggacctccagccgatgtgtgctttaaccttcggatcaatgcctatttatcatatcattatttaccgattggtttatactagattatattgttattttattacatcatcatcagccgattgcctttatatcatcatctacattggacatatagccgattgcttaaaccctatctctatcggctggtataggcatcggctattatcgtctatcggctggaactactccatcggcttgtcatccgatcgactgttttgatctactatttgcatatcttgtcagttgcaggatcaaactgactggcacgcccgcatctcaccaatctttggacctgcacaagagctaagcagatctcctaggccggtgtgttcgattttttcgtcaacaatattacaccggttatgacggttgagtgatccgttatatctgtttttttttttctgttaaaggatgacatcagactcgttgtcaagttaagggacctataatgaacttatttcatctatgtatcacatatagaatatgattggggtccagcccaagagagtccgacagatagcgaggaggaggaggagattagtgtctacaaaagagaaggaaggaaggagaggcggagaggaaagagaaagaggatcgtctcggctcgtcgtcttctagctagggttcgtaagttctagggtttgcgatgatccccaactcctcctccctctagtatttcgagcgaattctccaacactttcacccagccgcgcgcgagaggagaaggaagatagatagatagatcgctccgcacatactatggtgctcaccccatcgccgtctccaccgccgatgctccccaagaagctccgcgcgctcggtccaggcttgaatccctttgctcccttcggcatgggtaactactattcctcctctcgctaatatatttctcctcgctcgatccatcttcccccacctccccccttctcaaacaattaatccccttcccgattcgattcgattcggttcggttcgctttcggactcggtttcaatttcgattctccctccgtcgtcgcggccctattctagccgccccctcccctccgctcgattgcctgcctccggatggtgcaattccgcagctctctcagcatgagccgggcacggacccgccacggcgatggcgacgaccgcggctggaaccagctccacgtcgcctcccgcaagggcgacctcaaccaggtaatcctcacgttgtcatctcttacgttttactaactgctctattataattatattatgcattggcttattttctccacgcagcaccaccaccatcgtaatgcttctttaaagataacgcatactcttctactacatagattataacagtactgaatgattatagaggagggttaacaacaactcataatttgaatcaaacaacaaggaatgtaaccatctctgcaaatagtaataaaggataaatactacgagtagtaaattatcattagtcgccaaataaattagccttcatgtcatcaccattgaaacaataaatttgatttttcttttttttcttcctaaggtgaggcgtctcctggatgatggcatggatgtcaatgcacctgcatgggggccaaaatcacctggcgctacccccctgcatttggctgctcagggtggacatgttaaaatcatggacgagctactggagcggggtgcaaatattgatgctcgcacaaaaggagcttgtggatgtaagctcaaatgtttcttcccagtcattgcatgcattttcatgcttctagagcttgcctattctcttttatttacgattggtctgagagcagtttctatttattattattacatataaagaaggtttcatgcccccccttgttttcagtcctctgttgagcagattacttctatattcactactgctgcttgattgcacaccccatctagtttagtggattgacttgtttttattcaatcattataggagaccatatccttgaatgaaagctactccatgtttcatatactcagaagtttctgatgtcttgctcattagatcgaaacgtacaagtaactttctcatgaatggtgtatgtcttcatttaatacctgcaatgttgtactatgcaaattgcaaataccgtaatgttctggatgaaattatttatttgctcagttttctgttcccaacttctccagtggttttaaatttattaaaacaccttgtacactcaaagaggaggtcactttacctccggaatcttacattttcctcgtttggtggaatcagggacccctctacatattgctgctaaggaaaggaacaaaagagctgtcaggtttctgattgagaatggtgcattcttgccacctgacatgaatgaccacaggttcaatcctcctctccattactgctctggattggaatgggcatatgagatgaagcgcatgcaagacgaaagtgattcgaccggtgaaacttctctgggctcggagagctagaggaaagcaatctcctcagtctggcaaagaggtcaatcttggatcaacagagtttgtaaacatcaagggtcacgtttactttgtgaaattggaacgaattaccatgtgaatcttacatgcgacatggtactagcatgcattgcgatgttgttgtggggttacttgtgttttcgataattgcattgtgttcttactacactggtagcatgtattctactacacattcttaatatcagaatcaatatccggtttgcgtcctatgacagtatgcaatgtgtttcttttttgatgttgttgctcttactaagaaataggatgtgttgacgcttatcaccggaggttctactactttggctgcaaggtcgatggagccacatacgatacgaatttacgctcatcgtcaattcatcatcattaaaaagaaaaaaaatcagcaatagcacagtagcagcaatattcattcatatcaacgggcagcagggtacagtggattaataacgaaacaagtcaagagtcactagtctacatacatgaaaacgctgccccacctatgaaaacttgagccgagctactaaagttcgctgcaatacatcatgcttacgagttaacaccaccggcatgcatccatccattctgcacacaggcaaactaaactggatggaggtacataagcttagctcacatgcactctggctgctgaaccaacgttttggatgatgaacacaaagactccctggacttcctccatatcataacagcatacaatgagctgcccgtaaatctaccgcctcacaggaggtgcaccaccccgtccaactggaccaccaccacgaccagcagcagcctgcatcaattggaggtcaaaagattaaatgttgcgacaaacagagcacacatcaaaaaacagccttgaaggccagttagtacatgtgcataaccttacgctaaatacttaaaggtttgtgtaatttaaatatagatgcttcaaggtgatagatgaagggaaagtattaacagagagaagattaactttgtacttgttaacagttgacataatatttgtcagcttaatttcagaatcacggcataacgcaatttatattgtctttagtaggtttgaaactcaatgcatgaaatcaatggatttgcaagcactgattatataatagtagtagttaagattcaccagcctatatcatttcagaatcactgcacgatgggatactgtccttgttccttaatggagttaaaacagagtgcataaagttaatggtccttgagttgatagcaatatgatggaccatcacatggttgtaaacacattcacaattaaatattctgcattatatgttgggcaaatgttactgaaagaatgaaaagcagagtatggttataggaaaaggtaaatggattcattcagtcatggagtcacccatctagtaggttatatggtctaactgggcactggacagccaaccacgtgagcaaacaggcaattcaccaaaatatagggacacccacttcatgtatatgaggcaagcatgatatagtagaaccattttttggaacactgagacatgagcaattttgaatatggcactagggaattgtggcaaaataagaaaagtaaccacataataccaagcatactaatgactggatagaaacttcctttccttaaaggtaacatgactcctgcctacaatggttatttcttagagcagctgcagattgtcatgcaaaaagatgaggcaaagactccattgatgaattgataggtgtggctcagtttcggtttgcattatggtgctagggcaagatttagttgcacaaacactagctcataactctcctatctgaagatttatctgtctatgtcatggttagccatcagccggcaacgtgattttgaaaaaaaaaagaaaaagaaaaaaaagagagagatgtttttcatcagaacaacaaacaaggaccataacagttttaaatgcaaaggcttaaaattatttgcatgtactacactgaccagcatgagctccctgaaaatagaaatccagtgctatttgctttctctaatcgaattttggccaagcaatactgatgaatcaagcagtaggaggttagatgtgaaatcttcatgttgaaagcaagcagttgattacccaatggttatttctaagaggacctgctgattgtcatgcaaaaagatgaggtaaagaccccattgacaaattgatatgcgtggctcagtttcaatttgccttatggtgctagtgcaagattagttgcacgaaaactaggtccaaactgtcctatctgaagatttatctgtctatgacatggtcagacggcaatatgatgattttgaaaaaggatgattttcatcagaacaaaggatcaggaccattatcaatttttgcatgaactccctgaaaatgccagtgctatttgttttctctaatcgaatttagagcaagcagtagtaatgaatcgaacgctaggaggttagaagtgaaactatcatggagaaagcaagcagagcagatgattacccgagcacgcatagcaacggcacggccacggccaacaccaatagctgagcctttaccctgcaggaggcgagaggcatgtcacaatccaattccaagaggaggaggagaaaagagagtgggtgaaaagaaataccctaatcctagcctcgaggcgcttgaacatgggggcgttcttgagcatgtcgggtatgatcatgaacctgaccctgcttcctctgatgaagacgtgctccagctgggagaccttgccgtcctatacatatatatatgtgcacagaaagaatcaagaatctaagaagaagaggcgcatgattcgaaggaaggaaggaagggtaccttggcggtgaaggtgatgttgtcgagctggcagttccagttgtcctcgcactcgaccatggagccgcggtacacctcgccggtcttgagctccacggtcaccacgtgccccgccgcctcgtgcagcagcttcactgggataccaaggctgcggctcatcttcctcctagggttgggtagagaagggaaaccctagctaggcagacgcgacgacgagttgttgttggtggtggtggtggtctggtggaggaggaagatggcggcggcggcggcggaggggagtcgagtcgagtcgaggagggcagatgagagagatggaggcgagggggcgacttcgatgggcccaagcccaataccatcaatatgaaaggcccaaacttgtctctgccaaaccttcagaatttgggcctaaacacaacagagcttctccacgtttcaataaaaaaaatcgtatttaacgttgtaatatggcttatttatgccttttgttaacaatgtagaatgtattaaataacatacaagattaaacccccttgttaaaaggaatagaaatgacaaatctccgagacttcgtatcttaaagtgtcatataagatatacaagcaaacaagcctagttaactccaaaagcatgtgaaagagtatcggtcaccatatttgttcctcatatatatatactgttgagattatgggcatataatgatttaatttattccataaataagtcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccgggtctacgagcgacggcgcagtacagagtaggaggcaaaccctagattgattttcgcatatattgcgtgaagacggcgggtcggtttatatagagaaaggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaagaggctgcatctgcgcaagggtgaggagccaatttttcggaccattcgacgcgtacgtcgtgcacgcgcgccgcctgccctgccctgccctgcccaggccaggccaggccaggcgaggcgaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaagacccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatggactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttagagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcaaccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaagaagatatcaggcctagttgcactagccaggtacatcaacgagccaatgatttgggagtattccagttgattcctagcaattctcttgttcttgcgaagcgacaagctaggatcataaggtgttggagaaggcttactatcaatgtagccaaagcgattcaaaatcttctccacataatgagactgcaagagtgtaatcccattctcacctctaattagcttaatgtttaaaataacatcagctactcccaaatctttcatatcaaaattttgagacaagaatgatttaacctcatttatcacctcaatgtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaagtacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctctctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacctctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataagtcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaaaggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaagaggctgcatctgcgcaagggtgaggagccaatttttcggaccattcgacgcgtacgtcgtgcacgcgcgccgcctgccctgccctgcccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaagacccattcattaattccaacatatacaacaataaactgtgaacaagcctgtcacttgcactctaaagtaggtactgccgatatgataattgataacccgacaactgtaacttcacaattcttcgtcgagaacttctcgaaccaagaagccacccataacgaaatagaaaaagcaaaagactctagacaaatctaactccttaattgttatggaaagacaaaaccctatacaacaatctaaacttctaaagacttttttagaaaagccctttaaatacctaatgtaaaccaatgagaaacgggtcccctttctgctcacctctggtgaatacagtagagatagaggaggaggactgtacattgtaagggcttcgcgaaaagaacgagtggcttatttacactctagacttgtttggctaatgggatggtaaaatgatttcccacccaccaaaagacattttaaatcctaaccattcattctctctttcatttaatcataatccttcatctatttctcaatcccaatcccacccccattttccattatccaaacacacactctggagatgatgcataattttttttcttataatttaacatataaaatggactatgctcatttctttctaatatcaaatccaaataaaaaaaaatgtcttggttcatagttcatataagctgagcagcaaatatctatactttgggaatgttttctctaaagtttgacttttgtcatgtccagaagataaaactacaaagtcgaaatttccttaaaaaaatgccttctttctaatctccactccagataaaaaatatatattggtttgtagttcacatatgtaaaaacaatggagtattgtttatttggacaaataagttttgtacaatttgagaatttcacaaatgttgaaaataaggcgagatgaaaaatacaacctcaaaataaaaaaaaagacacaacaactagagaatagtactgtgttaacttttctgaaaaggctacgagtaaaaaaaatacttcttccatccacaaaagttagacatatttcacatttgagtttttccaaataagttgtttctatttgtagtctttatgcatttaagacttaaataaatagataaattaaatatttgattagaacccaaagagtcatctaataaatactcattggttgcatgcttatattcactccttaattttgtagcatctaagataatttaatttctccttagtcttggtgacaaaagtaatattggtaacttttatgtatagagtgagtgtttgcaaaactagatttataacttccatatagttagactgaatgaattagtgtcgtttctgtctttcatgtaagtataataataaaaaaggaatgtttttcctttcataattaattgcgtgggaaattatttatttagcaaatagagcaaaaggaacaatataatgaaggaaattaagaagagaaggggaaaaagaaattaagagttaaatatataatgaatagtttgtaggtgtggcaattaagcgtgagtttcggtccgccaaccgcgcgctcttggtcgaccacaacgcatgctactctcagcctcagccaaccaattctgcaaaatgcattgatcgatcgatgttctctcctccctagctgcggacggacttggatccatccatctcccattcattcattcattcattcatgtggccatccatccaccatcttgcatgctagctagctaccctgcaggcccataacgacattattcaattcgaattaattccatcatcatataataatatatatgatgctgagctcgtcggcgtcgaggcgggaggtcggcggcggcggcgccgcctccagcaccaagagcggcgagctgtccctgtccaaggtggccagcgtggccatacgggagtcgtcgggctcgggctcgggcgggatttccaagagcagcgaattgctgtcgagggcaggaaccatggcggcggcgagggaggcggcggcggcggcggtacaccacgaaggatggatggtgcgctacggccggaggaagatcggcaggtccttcttccacacccgctacttcgtcctcgacagcaggctcctcgcctactacaagaagaaacccaaagacaacatggtacccgccctaactccatcatcattcattaatcaatcaattattactactcgtactaatttcaaacactcttactatcactgccttgttttaattttccttcccctggcacacgcttgtctggccaattacattgtgtaacaaaaaaactcttttcattctaatatattgatgcgttcgcgaaaaaaaaacactcttactattacacatttgcactactactcatagtaaattcaaacacacacacacacactatatatatatatatatatatatatatatatatatatatatatatatatttggcaccaaaaattaaatatgcattaattcagtcacatcatctagaatatagtagcctttggatccttcttatgctttgatctcaaccatccatttacatatgcatttacaacccactaaatacatagttattagtataaaattcaatgtgcattaaaccataacatctacaaaactaatagtcattggatctctctctcatatttgatactccctccatccctaaatatttgacgccgttgacttttctttttatacatatctgaccgttcgtcttattcaaaatcttttgtgaaatatgtaaaactctatatatacataaaagtatatttaacaataaattaaatgataggaaaagaattaataattacttaatttttttaaataagacgaacgatcaaacatatttaaaaaagtcaacattgtcaaatatttagatatggagggagtatataactatcccagctgtcatgtaaaattgaaatttataatcaactactattgagcaaatattctctatttacatattataagtacttgatttacatattgctttcttttaattttctataaagtatttttaaatttcctgctgcaatgcgcgggatatgcactagttatatgtaataatgttgtacatgcatatatccatgcaggtgccactaaaatcgctgctgatagacgggaattgcagggtggaggatagaggactcaaaacacatcatggacaagtatccattatttcttctaatttatctcctttccgtaccatccttcttctcatgatatactgtatcaaccagctggcttttacacctgacattgcccccgtccttctcaattgacgatgtatcataatgatccttaattttcagatggtctatgtcctgtgcgtttataataagaaagaaaaggagcatcagatcacggtttgttctaactaaacctgactgcatgttctcgatctctttcattcagcgttatatcagtatatatatgactagatttaattcgcagatgggcgcgtatgatattgaggatgctctggcctggaaaaagaatatagaactcattatcgatcaggtgcagtaatttttcttcatcttacagttttgactttgcatatgtaaacacaacaagtaattttggagtactggataattctcaaatttcaatgaaaatccattttcatgtcgaatcatctaatacccaaaatatgtgactcttagaccgtccagctgccttattcaggattttctaatgaattaaaccgaacaaggacctttgtacgtactgtttaaagggtagttaatttgggctggcagaactttaggtgtactctttacggatatatgtagtaaattaagctgcaaaacaatatggatgctccatgttgttttgtgaagtatcacatcttcacattgttgcagcagcaagaaaatatgacctccaaaaaccgcaaggcctttgcttcaatggactttgatacggaactaggagggcagtttatattctcagaccatgacagcgcgtaagtgacatcccatcttctctcttagattatcttacaaacgacaaacaaacaagatctgaaataagctgaaatataatttcactacgaatatatgcagagctgaagatgaagaggaacgacctatgttgattcgcaggacaactatagggaatggtaacaagttatctgcaagttttgttcttaatttccgtttgtggatcgatatgctacagaaattcaccacctcatttctggtgtgctaggtccccctgaatcaatacatgactggaccaaagagcatgatatcggtccacccaatcagattgaccccattcaagttagctccaagaagaattggcgcctacttagatgccaaaatggcaagcacacaagactcctcctcctcctccttaggttatcagtcaatacttgtctacttgttgcttacttccttgtcattcgcaggactacgcatctttgaagaacttctggaattcgattatcttgtatgtccagtctactcactctcgactactgctagacagttaattgattagatactatgcatcttctgaaattcttgatgatttttcacttgtcctgtgtaggcaagaagctgtagcagagctatgcgagctgttggtgttgtggaagccacatgcgaagccatttttgggctggtgatgagcatggatgtaacaagatatgagtaagcatatttactactatcacctatatatattcctactacagttacatattaatcttgagattacgtactgatgtttaattattgatcatcacgtataggtgggactgcagctttcgctatggtagtttagttgaagaggttgacggccacaccgctatactgtatcataagttgcagttgcactggtgcccaatgtaactagtcttctttcttgtccgtagcattttcaaacatcctcctcctcttcttcttcttcttttttttggagaaatttcctcttatttttgagtgcacaactaaatggtagtactaatatttcggattatctatcagattgaaacttacacattcttccattctacatgaacatgcaggttagtatggcctcgagacctatgttatgttcgctattggcggcgtaatgacgatggaagttacggtaaaaatattcaaatcttttccatggaatttgctgttttgtagagcaattaatttctgattgtttgtttggacgcagttgtgctgtttcgatctacagagcatccaaactgtggacgtcaaaaaggatatgtgagggcttttattgaaagtaagcttctctctgagcatctgaaatcctgcattaatttacctgctgagatcgatcaggacaggaggaggagagacagtatactagttccatagaaaacagacagaaataaatgtcaaatgaagttccttttcttttctgaaattcctactagttcaggtggaggtttcaagatttctcctctcaagtgtcgcaacggaagaccccgcactcaagttcaacacctaatgcagattgatctcaggggatggctcctcaactactctccttcctttcagtatcattctttgctgcagatacaaaactgtgtagccggtactaactactgccactgctcgaaacttagtttgctcaaatgaattagtgccatcatcttactacttcactgttatcctaattaactctacttacttcaaggcctacgagaatacttctcccaaacagacgaaacacatataactccaaggattcctgtgatggaaaacatggttgacacatctgcagtacagaaagatgacaagaagagtaccgaagaagtagactccaagactaaaacaccagatcgaggacaagcggacagtaaaaacatgggaatcattgatgaagaaacagacgaggatgaggactatcaggttcctgaagctaacatagaggtgcttcatggccaatatataacattacatatgaacagtgaatgagttttttgtgtttcctcattctaactaaactgtgatcaaaattaattaatgtgcaggaagatcctaacaaagatgctaagcgtgcaggtatgattcctttttttttctgcaatttattttggtattaatctggtaagttccataggcaatcatatattcttcccctgtaacaatgacacggtttgccttgtgattatggcagacgaaccaccagaaaagattgatctatcatgcttttcgggcattcttcgttgcgatgcggatgagaaaagccgaaactgttggacagtacctgacagcaagctgtttaaagtccgtagcaagaacttcccgcatgataaatcaaaggtccaagcttttattgcttaatttgtttctttggaattgaatccagtgagtgagattatatgaagaagctgagcacactgctcacattgaaattacagatacctgcagcgagttacctgatggagcttgcggccattgactggtttaaggacagcaagcgtatggataacgtaggcaggcagaaaggctgtgtagcccaggtaaacataataaatcttgtgatcgatgatggcttatcctatctgaagttatcaagtagtatcatcacagaacttggcggcttggtcgatgtttgttttgtaggtagctgctgagaaagggatgcatacatttgttgccaacatacaggtaagtatgtttgcagattcagagctagctagctagctaggaggaaacattggcaatcaaagttatagttatgggtgtgtatatatatattgtgttgtagatccctggatcaactcattacagcttggtgatgtacttcgtgacaaagtcgctgaagaagggatcactgctgcagcgattcttcgatggggatgatgagttccgcaatagcaggctgaagctgataccctctgtacccaaggtaggtagtccagctgttggtctcaggtagtgaactgaactgaactgttggtctcaggtggtggggtggggtgtgcccgcagggatcatggatagtgcggcagagtgtagggagcacgccgtgcttgctggggaaggcggtggattgcagctacgtgcgtggagccggatacctggaggtggacgtcgacattgggtcgtcggcggtggccaacggggtgctgggtttggtgtttggtgtggtgacgacgctggtggtggacatggcgttcctaatacaggccaacacctacgaggagctccccgagcaggtcatcggcgccgcccgtctcgctcacgtcgaacccgccgccgctatcgtcccccaggaccttactccccctcctcctgcccttgccgacgacgacaacgccgctgcttcttcctccgaggatgatcatttgtccaagaaaaccaactaagctagcacctctctcaacgcacgcactgcaacttatcaatcatttatcttcttgtaatttctaattatttccgaggctcatagcaagctttgttttttttcttttcatctttttttttatctcgttaagttgtttgcaaagtacagctggttttcttctacgtaggaacaaagataaatctagctagtgacagtatttcgttggaacctaatattatagactgagatattttgtttaggcttagatttgctgtctttggctttaagtcagacttttaattaacttacactccctccatttttttaattgacgacgccattgacttttgaacacatgtttgaccattcgctttatttaaaaattttatacaaactatagaaaagcccgtgcgttgcaatgggtgataactattttaatcttattattgttatatggtttagttacgatgaaattcactgtgagaattcgcttggatttatatctctactgttttaaaattctgtagtggtgacggtgactccaaccctgacagacacgcgacttattaaccgtgggattggcagatcggacggtgctgaggatcccatcgcacgcgctcgctatccaaccgtcgacgccgctcccctcatccttcgccgcgcccccaccacgccttcaccgaccgccactcctgctcgcccgaatcgacgccgccgccgtcgcgggtcgacatcgccgctcctcctatcgcgctcctccccgccggcactgcctccatccatccgccgcgtctcgccgccggtcgcaccaccgatccattcctcctccgccgcctgctctcccggtccctcccgccccatcgccccaacacccccccccccccccggcaccgcctccatccatccgccgcgtctcgccgccggccgcacccccgcttccatccatccactgcagatcgccatcgcacgcctccgcctctcaaggtcgcacgctcatcgccgccgctcgtcgcccgacaccccgccgattggggaccggacgctgaccctgcatcgacgccacaacagccgacagatgggagatgttgaagacctcactccaacgacggctgcgcgcggtgacactaccaggcgttgagggagagaatgcagtgcgaggtgcgacggggttgttcgtccttgcccagatcaacgccgccgccgatccctcactcgcccctcgcccaggtcggtgccaagggcgaggttcgccaatctgcttcccagccgcctcgcccgctccatgggagaggtgacacctgtgcccgcctccagcgctccatgcccccggataccatccgagcacgatccctccggcagaacttctgccggagaagggacgcatggttaattggttcgttctctttacgttgcaatccattcatttgtcaagaatcatcattgtgagtgccgagggttattacagattacaggatcactaatgctcttttttgcccaaaaggtgttcaacgaaatgctgcttagccaatgtattaccagaaattgatttctctgtaagtgagaatgtcatattgccatgtcccctatgttgttatttatactaatgattgcaggattctctctgttgttatttatgctaatgtaatgaaatatccaattactatgtatagactctagagctatgaactgctgggaagttgagagtgttgctaccaagcagaaagattcaaattatatgttggagcaaactaatttggatcttgcagtctcaaaactaatctggtccttgattgtttcagagcggacgaaaataaaaaatggaacgatgcagtgaagattatgtaagcaatgttcgtgatatatcgatcctgaaattctcatagatggccattgcacaaatacaaaaatttgcaggttattaatagtgaactacatctctgtaaatctgcataacatatgttaaagctagcccaagaattaatatgttgtaaatctgctctacagttgacactgcttacattttctactattaataaccctcagttgtgatagatctgataccttcttaaaaatttgaactgagttttcatacctagcagtaggactaacattttatggttgtattgttcagctcaagatgaacaaccacaccaaccccaagatcaccaactaagcctatcctgcttcatgattgttgttgcaaactccaacatgcttgctgctggtgcaatctgagccggctggtggcagatgggagcctgccctatgttgttagcagcttttttcactccaagtcatgcttgctgcctgtggtcttggtagtttcttttttgtgttgtcaatttaattattaggatttcccatgtgctcggctattggtgttcttgtatctgttttgtttcagggtgtcattactatggagtagatcataatttttttcttatttttttccaatgccttgtaaaataaccaactagcagggatgttcataaatttcccccttttgtttggtttttttcagacatatatataatgaaggcatatatacacaaaaggaggagctgtttgagggtctaaaggacaatagctcaattgactgggaagttgttgtcatatgtcgagagcaatctgctaaatgttaaagaggtgcatctaacttttgtacccagtgaactgcaaatctgcaccttctcttttgattaatagtttctttggattcagatcaaaatagctcaacatgggaatttttctagcagaggatgggcaattcttggaaaatactatatatttcttgtcgttgaatgtgatcatgtcccattattctggcacttgctgccttgattttgttgcctgtgccagccctttagctagctctctatcacacacgaatgcgtgacccttgatggttgtatgcagttgggatattttggtgagttcatcccccttccccaccccaccctctctctctctctctctaaaccatcatttatcttcactattgacttacaatttcacttctagctgatgatgatcaatcaaagctagctcatacgtattagtgagtttatgaaaaaaaaaaggatcagatattcaataacagagttagctccttcagaacgatggcaaaatggtacctttataattttacttctcaacacgcacacatttttttatgacgagtttgaacttttgttctccttgtcagattttatctgaagcaagtatcatatacttctgtattagaatatggacgcaatcatatatctcctaaggtttagtacatactctcatatttggaagtgaataccaaacgtgtctgaaatagtgcatgcgatttaatctattctctcttaggcatttattcgcaaatgcaaagatttctgtaatttggtcgtagcttagattatggcaaccttggctttgtggtttgccatgtcatgtactgatatatgaatgtgatgctttaattaacgttgaaaagccatgaattatgtattcgaacaaattgattggatgtgtcctgaaatcggttcagactttcgttctttggttactggcgtgagacgtgggagaaagacgctgaagacatcaagcataacatggagttgataaaacatcgtcgactgaatcatggaccttgtcctggatgtagtttctttggctgctggtttattacactatagtaaaactaaggaccttgtaataggctctttgtgctggtctgacgtgaagtgaaaaccttcttaatgtaacttcgctaaaattagcgttttgtctgtttaagcagtatttatggtataaagaattgcatattgcattatattgtgacaaagagtattttctgaaattttgacaatttgaccattttgaaatttttatttgaagaatagatcgtgctaaaatcttattgcaaaaatggaccgaaacttattgcaataagtttagcgtggtctattctttaaaagaattgcgtattatattatattttgacaaagagcttctgtactcagctcattaaacctgcctgcttgaactatctgatacttaagttttaattaatgtcttgaatctatacttaatagccaatcttatgattgtttcatttacgatataaatcgtcaccatagcgttaacgcgggcttgtaactatattttataattataaatatttaacatgtccaggatggtgacgagctaaggcaatttttttttgctaaatctactgatgtaccaacaaaatgagtatgaaagcaacaccctagcggtgcacgagattttttaagtgtatcgcaagtgcacaacattagaatagttatttacctatatgtagtaatttaattttgaggtgatcatcaataagaaagtcttctatctatgttgtctttttataatttaataaacgccatgagattgttttatatatgtggcagaaagtttgcactatacttctataatgataacatatttcttgctttgaaagtaatctatagaacaataatgatttgtagtttttttggattgccagattttttttccgtgttcaataaattttcactcaatgattatttaatatcttttcacttaatataatttgaaattgatatatagcatttcccgttgcaacgcacgggcaccttactagtatttctagaaaatcatgagctgcggtacgactcctatatttctaaaagcggacgaacttaaaagccaactcaaaggatatatattttcaaaagcgaacaaatttataaaccgactcatacacggatgacgtaccaaagtaccgacaaaaacatcttaaattttttaatagtagagatatatataagttataaatcatgcttaaagtattttgagtggtgaaacaactcacaacaaaataaattataattacataattttaaaataagacaaatgatcaaacgtatgacaaaaagtcaatagcattatttgttaaaaaacaaatgtagtattattttataagccaatgcatttaaaatcttaagtttaataatgaagtcatacatctatctcacatattttttaaaaaagaatctctaatttagcttttagcttaatagtgtaaaggtggcttatagcttttaaaagacaaaaaaaatatttatttgtttaggtttaaatttttcttggctgataagctcccttataagcttcaacaaagagtgcccgatttacttagtactcacgccatctcaagatataacaacttttcgccattagaatgtgttccaaaatataaccacatcaacattctctctcccaaccaatcacaacccttcgtcattcaatttcctcacatatcttcacttctcaaccaatcacaatattctcctagttgattctatctactttctttatacttgtgtccaaccttaaaagtttttatattatgggatggatgtactagaaaataaaagccttggcatgtagaactcacctaataataactcagtttgtcagcttgccgtcagcgtcagcacaaactgcttcccaaaccttaaaagaagtcgatttacattggtttttaagatagggaagactcaatcgagaggaacaactgagggagatgaaacagacttattcctaatttatttggcgcaaatagctagtccgagttcgtgatcttaattagtttttctaatgatcagcgcccccctctagtctctctagtctctactcatagtatatacgtattatatacttatatatatacatatgtataaattttatatttatatatacaaaatttatacgtgtgtatacgtacaaaatttatatataattttttatatgtatacactttattgtataaaaaatatacacacgtataaaaagtttgtgtgtacgtataagaaacgaaaaaatatatatatatataaactttgtatacatgtttaccaagtttgtgtacacacgtataaaacccccaaaaatacacttatacaaactttgtatatgtgcatacaaagtttgtatacgtatgtgtatgcaaagtttgtatttgttcatatataaagtttgcatatatatatatatatgtatatatatatattataaaacgaaagataatacgtaaagaaaaaacagaaaataagaaaaaggaaatcgtaagatacggaaagaaaaaaaaaaaaggaaaccgtgaactacggaaagaaaacaaactacgtacggaacgaaaaacagaaaaaaaaaagagaagaaaaccgttccaaaaaaaaaaaaatcacgcggtgatgctttggcagctttgctcgtttcggaagtaaagcaggccggacggtttcaatcaagaaagaaaaagaaaaagaaaaagaaaaaagaagaagaaaagcttccttctagatgcttctttggagtgaggtggggcctacatgtcaggatgatcgcctcgccacggccacgccggtttattataataaaagcatgttcatcagtttattactccattgattgagcagccggcggcggcgatctttgcttaaaccctaatctcagacgctgcctttgagagaggagaggggggagatcttcttcttcgcttacggcgggtgcaggtatcccatccaatccatcttcccctcacctctctccctctctctcttatacaggttagattggacgacattccatcaagaatgttagttaaaacaatgtcaatgatggatggatcgaataagaggaatatagattagctgcgattgaccgcgatggatcaatcaaattcaatccatcgattttttcccctcgagtattttggtggtcatcttcattcgatctggcgttcaaggccaagttttgcacttttcatcttgtctcacagatttgatcgctcaacttctcttctaaaacatcctcctttacctacctacttcctcatctccctgattttccctgcttcctctttttgccgctattcccctcccctctcctctcctctccttgcagaacttgttttttttttttaaaaaaaatcatctcccttttattttcttgtagacaagcagtgtagagccctggtgctactctgttagagccaatcttacagatcatggatggatgcgaatgctattgaccagtctcggtcaaactcaaattaatcactacatatatatatgccacaacacttgaaacaaattacttcaacttttcaaccatctatttttccctatatatgcctgtactagtatgactgcttttccttgcaaagtaattgtaacctgttctagcaactagaaacttcttttctgtctgcttagtttgccaaaggtctctttcaagcatttttttttttaaatcagagtttcttcttcctctgttttctcccttcttgtgttcactcatgctgatgtagtctggcaacttctctgcaacagacaatatggcctcagcattcgggagcacctcagcatgtggcatcaagatcactcctaccgcttttgccaccaagaaacatctttgcctggttccacccccagtcgtttcacttccccggaaaaataggcctcagaggaagtgtaatttcagagtaaatgctgccaaagagttatatttcaacaaggatgggttggctatcaagaagctgcaagtgagttgtacattctaataatttctactagcatgatgctatcatctataacatcaacttctgagttgtgacttctattttctatgacagaatggagtcaataagcttgctgatctcgttggagtcacccttggtccaaaaggacggaatgttgtccttgagagcaagtatggatcacctaaaattgtcaatgatggtgttaccgttgcaaaggaggtatgccacgtatagtaaactgttcgtgttcttatgatgcaatcctatcattgcttaaattcagagttttctgaaaaatgactgaacatttggcataaactgtttgttttcttatgatgcaatcctatcatagcttaaattcagagttttctgaaaaatgagtgaacatttggcatgcaccaggttgagctggaggaccctgttgaaaatattggagccaaattagtccggcaagctgcagccaagacaaatgatttggctggtgatgggacaacgacttctgttgtccttgctcaagggatgatcacagagggtgttaaggtacaccaatataaaagccttgtatcttaattttacagcataaatattttacttggttctgggaacaatcgtggatctgtttactttcccaggttgtggctgctggtgctaatccagtacagattacccgtggtatagagaaaacggccaaagcacttgtgagtgaactccaaaaaatgtccaaggaggtaagttatggacttctgtttaagatcttattcttttctgcaacaaatcactatactccgctagtcatgtaatgcagccaaaatagggtgtgccatacatgagatacttctatagtcctatatacaatatacaactctatgaaaaagttaacgtggttctcacttgcccatttgtaaatttgtaaatcaactggatttgtatatacgtagctaagtctaatgattttgatatgagtggtgtatagtgtgccatgtttcacgtttctttttcagtaatactaaacatgagtgctgggaatcttctgtgctgatatttaagtaacacccatttgaattcaggagcattggctgccagtttgaatcgtactcatccgctacagcactatttttgcttgaaatttgaatctatcatattgcatgcaactttgcaggttgaagacagcgaacttgctgatgttgctgcggtaagtgctggaaataactacgaaattggcaacatgatagctgaagctatgaacaaggttggacgacagggggtggtcacacttgaagaaggaaagagtgctgaaaataatctctatgttgttgagggaatgcaatttgatcgcggctatatttctccctactttgtaactgacagtgaaaaaatgtcagtggagtatgagaattgcaaggtttgatgcattctagaattcggtgtacttaaactgtgcattaaccagatactcatttgtgggctctatgcatttgatgctaatgttgattctatcacccagttgctccttgtggacaagaaaatcaacaatgccagagatcttataacaattctggaggatgctattaggggtgggtacccaatcctaatagttacggaggatattgagcaggaagctcttgcaactcttgtggtcaacaggcttaggggtgcattgaagattgctgctattaaagctcctggttttggagaacgcaagagtcaataccttgatgatattgctactcttactggaggtgatattcagcttttgacataagttgtctacactctaagccacacgtgcgcttatatatcgttcttctttcaggtactgtcatcagggaagaagttggcttgtccctagacaaagctgatagagatgttctaggaacggccgccaaggttgtagttaccaaggattcaacaacaatagttggggatggtactacccaggacgaagtaaacaaaagggtgacacaaatcaagaaccagattgaggtctgtattatttaaaattaaaaattctatgtgttcctgtacttctcgtcaaaccactcctgtattcattttctcctgaccctgctcttttttgggggtttctttgcttacatgaatttacagggcagatcttttggattcacatgtctcagtatttttttgtggatttttatacaagttattttttcttcaggttgctgaacaggaatatgagaaagaaaaactgaatgagagaatagctaagctctctggtggtgttgctgtcatccaggtgatctcgatgttctgcaattgaaccaatgcacttgttaatgtactactaggctgcatttgcagaagataattgttgtgaaatgacgctacttgttatgtaggtaggagcacagacagaaactgagcttaaggaaaagaaactgagggttgaagatgcactgaatgcaaccaaggtgaatacttctctttgttaatataatttaattttgggattgcattcagagagccttctgatgcacatagagtatatgggtttgttgtttgttacttaatagtttgctctgtggcaggcggctgttgaggaaggtattgttgttggaggtggctgtacgcttttgcggcttgcatcaaaagttgatgccattatagaaacacttgagaatgatgaacagaaggtaggaaaacaaatgaaataatctttggttattgtttcatttcatcctaggttcaaggcatttgttttctattgtcaataattaaaatttctttttggcttcaaggttggggctgaaatcgtaaggaagtccttgagttacccacttaaattaatagcaaaaaatgctggtgttaacggcagtgttgttactgagaaggtttgtactctgacatttgttcttaagtacgatgaatatgcaattctgcagctcgtgtgtaacgaatttttgaacatgtatgatttcaggtccttgccaatgataacttcaggtatggttacaatgccgctacaggaaaatatgaggatttgatggctgctggtattattgatcccaccaaggtaattttctgccgaatcaatgcgctttcttattcgtagtcacatcagaagtaattctttcattattagaatatatattgaaatgcacgtgtgcctttgtgttgtgctgtaaaattaatataaccgatttaccatgttgaaccgatagaagtgatcagctgcatgaagatgaacctctgggatatggattttctttccttgcaatcaaacaaggatgttttccaccctattttttatattagtattttgagtccataaagctaacgttgtgtgaaacaggtggtgagatgttgcttggagcatgctgcgtcggtggcgaaaacattcatcacatcagatgctgttgtggtggacatcaaggagcctgagaaagcagctgctgctgggaacccaatgggtggatcaggtacacggacctgctcatcatgatcaaacagtagtatatattgtatgcttgaacagagtttgctaattgttttttgttcaggttttggattttagtttagaagaagaggagtaccctttttggcagttggcaaccatttttacactggaggcaggcagaatttcacagttgcatctgagacgttttttcttttcctgtgtgtaattgttgcgtacgtcaatgtggcagatgagaggagtagtaggttatgaatggccagcattatgacagtttattgttgctcgaccttacagaagagctgaaacagtgcaacataatgtttttaaggttgagaattatgcaagctgaagtagttggtaataaccgggagaggattgtgttgtcgttggagtagatgatgattttactagctagttagatcgagttacaaacatataattaattaattaagggggcattggcagattacaataataaataaattatttacatgataatcgagttagcagtgatcgtgtttatatagggcctaaggaggagtatatatatgtatttagcaagaagtgggttgttagttacaggcagggcagcaggagggtggggggattgaattattattattattaggcggcggtgttgttggcgcggaggtcctcgaagctccagtcacggcggacgccgccgctgcgacggagacgaggaggagggccgccgcctttacattccatcagctgcgacgccgacgcctcctccaccgtcgatttgcacttgcgcacctgcttctgctgctgcagcatcggctgcttcttcttcttttcgtcgtcgtcgtcgtggttgctgttgctggacgacgacgtgggcgtcatgggcgccggtggtggtggatcgagcagcagcaatgcggattggggcgtcctgaccggggcgtagcgcggctgcgcgaggagtccgtcagcggtgacacctcgtttcagggcggtgcagcaggtggccgtctgcggctgacgccgcccatcgtactcgtcttcttccacgccacctcgttgccgttgcctggtcaccaggttgcacgtcaggtacgacgaaaggctcatctcgatctctatagctcctcacttgatcatctactatcacaatctctctctctctttttccatagaattttatagctcgctcaccgtcctaattttgagcggccgcccggctaatttttggatggatggatggattcacccaaattagctaattaactgattaactgatgaccaacggcatgcatgcgtcaaaacactaataatattcgcccagctaatttgagcatccgcatgtagtccactagatacacatcttgttctttctttttatcacaagtaaccacatgttttttatactctcatgtacaattgagaaaatcattctgttcaaaattgtattgtgattcatgtgtttgtttttttttgaaaggagggcaaaagctttgcctcgtatattgatagagatggggaaaatacaggacgatagaattatgtacatggctagtctaaaaaagaactaagcccgcaaaaggtgatgattaagtgatatctctcaagattccgaactcttgaagcttagaggctcctactttaactcatgcctgaccttcctcttttatcttggtgaggatggatgccggtggcgatgcagtgtttcaaaaaatttattcatttcgctcacaccatatttcctaggataccaagatcaccagagtacgcaggggaatgcggaggttgttagcgagaattgtgattcatgtgtgacatttgcggcggaaattatgatgaatttgttgtgacttagtttcatctttgcatttgttgtgcaaaactaggatgttcaaggtattttacacttaggctgtgtttgatacttggggttgggaacccaactccaccgtacggaaaacagagcagtccattagcgcgcgattaattaagtagtagctatttttttttgaaaaatggattaatttgattttttaaaacaattttcatatagaaactttttataaaaatatactatttagcagtttaaaaagcatgcacacggaaaatgaaggagatgggttgggaacctttaggaacgaacgtagccttagtcatacacgtggcgggcagggcgcgacatggggcgcccgattttactccccacgtgggcgcccgattctaggcatcatttgcatttatgtatgcatgtgcaggcttgctgcaaagatattagttctgcatatatcatcatgcagtaagtatgcattgattaatggatcatcgatcgtacacactacacagacatgcatgcatgatagtactagctagtgatatttggatatcgaattaattggtagtagtagctggtagcaatatggctagagcaaggagatgatggcgagggagatgacgccgtgctggaagaggggcttggtcctggccttgatggccggcggcgtggccatgccctgccccttgaactcgtcctcgcaggtcaccggcgcgtcggtggtggcgctcatcgccgtcttggcgtcgccgtacctccacgactcgatcgccgccacggcgttgccgaggttgtaggcggcgtcgcggaacacctccaggcacgagtcgaggcaggacctcggcggcgaccccggcggcgccctgtcgcggagcaccctggcctcggaggcgatggtggccagggcggagcggagcggcatggtggagaagagggcgaggccatggaggtcggcgcctgggtaccccgacagggacgacacgcacagggtgtagttcacgttggggttgctcctgctgcattgcccgcacgtctcctccactatatcctcgcccgccgccgccactgccgccggcgacgacgcaatgaccattattacaaacaagaagcagacgctgccgcagagagtggccatgtcgatcgaccgaccgaccttatggttagcaacgtcgacgtactaccactgcgtacaagctagctagtgtatatatgcatgcttgtgggattagttactaatcaacgtcttctagatagtacacagtacgaatagtacacatgctacacttttttttttcgaggggacaggcagggagctcctgcgattcaccgtagaagaagagagttgatccagtttataagggaaatcagacctaaaaaccttacaacagcacggttaattaaaggaaaaccggcaaaacccccgacatcgacaaactgaacctaagtacagccgtccaacaagagataaactcctaaaacgaagccttcaagaaggttacgccgacagaacggcgacatcgtccgatcctaacgaatctaggttttcacccggagaaaactcttgaagtggagttgaacgagggctccagtagcaacgccttcaagaaggtaaacggcgcccaagggcgtcgccgttgctagcaccgagagcggagcaagactttcgccttggagcacccatcaaccatagcatccacgacgggagccaccaaatgtcacctgcacaccgaggatacctgcgatattcacaccacctgcacgacgatcggactccaaccaccctgttcccacccgaggacgcgttggatctgggcaaggagccagatccggccgtcttcctctccaccaatgccggccgacgccagtggcagccgcggggtgcctgcgtgctcttgcctccgccggctgccgcgccgccgccggatccgggtgcgccaccgccggatccgcagcctccaccatcgccaccccaacgccgtcgccatccccgccgccgtcacccacaacaccacccggcgcaactcacctcgaccgccaccgtcgcccgtccccgctgccgtcgtcgtccccgccgccagcccatcccgccagatccggccggaacggcgcggatctggcggacaccgccgtcgccattccgggcggctccccaggccgcccgagcgcgaggagacgaggagcgccccgctgccgccgtccttgcggccgcgcggcttcgccggcggtcgctcgggcgacggcgaggcggagaagggggtgggggtgggggagaggggcggccgggtcgtcgcctcccgagccgctcctggggagagcgacgccgtacacatgctacacttattcttatcaacacacatgtacacctattatataagtatctctgatagattgaaccggtatatatatatatcctgagacgaagtcattataaatatctcactgtcaatgagcatatatatgttaccttgatattgacaaagttatcattgtcacatcactgtcgatgtggacgtcacctatcactgatatatcttgatattgctaaaatcatcattgacgcatcactgatcattatctaaaaaattaacgcatcacttttgacgcgtacatcacctaacattaaaaaattatttatcgtaaatatgagcacatgtgttaattctaagactattagtatacactactcaagccgttcgttctgcgagtggttagcagttatgttgcaaccgaaacctgaacagctttgctctgctctcaactaaatagtactccatctatagctctagcttcttagttgtgatatcttagttgtccttgtttagccaaatgcatcccctttaacttttaaaatggaaggatgctttccttgaatatttatatattgggtccaaaattttggattcctcgacatggatgtacgataatctccgcttgtgtttgatcaatgtgatcacttatactctcgcattagttaattgtaatgatgtgtacagtactagtactagacagcgttttgtcgacattgatacaagttcagtttctcaattaattgcatggcaaataaatattgcatttggaaccgatcgaacagactcctgcagtatatctcaaatccagatattgttttctttagaaaaaaaaaagataatccagagattatgacaacaggttattcacttcatttagtctgacgacatgcttgtaatctataaaatttccttgcactagctagtagtagcattggctcatagagatcgttcgatttcctttttcttgttgatctgaatttcttagatcgatgagcaatatttttacatttgatcattgagatcgaaaccatgcacatgtgaacatatgtaccaaatcaacaggactgaggaaaataaaaagtacacagtaaattaatcgtgttattattcattcgtctttcatctgatgaacaattaaatcctacagtacatattcaattcaatcagcaattaataataataataataataatttaagtaaaagaagaagaaattccagcggatgatcgatcgatgagaatgcaaattaataaggagtagtagaaataaaattaggcagaggcaggcaggcgatagatggaagtaaggaagaaatggaggaagattaggcggcggcgtgggtgaagccgatggcgatgtgggccatcctgccgtactccctgtcgtgggcggcgatggggatgttgccctcgtcgcccttccacgcgtcctcgcagctctcggcggcgcccagcgcggcggacagctgctccatggccgtcccgtagatgcggaccttgaggttgtccagggcgtcgcggaggaggtcggcggcgccgccgtactgctcaaggcagtgctcgaaccgtgcgcgcgcgtccgacggcgacgaagaatcctcgggctccagctccgcgaggtcgtccatcttgcagacggtgctggtggcgtggtcgatggccatacgggtggcgagcatggcgagcccgtgcaggctgcgggcctcgctgctgctgctgcgcgggtccgccgtcagcgacgccacgcagtggtcgtaggccaccgcgtggtgcgtctccgatgccccccggcacgcctcctcgatgctcatcgggctagcgcactcctccgcctcctgctcgcccgcatgcgccgccgccgcaatcatcaacatcagcacgcagcacatcatcaccacgcttctgctgctgctgctgcttctgctctccatcggatcgaatcgaatcgacatatgatcgatcgatcgatcggtctccaagctagctgcttattctgatggatcgatggctggcttggatgatcgatcgatgttaacctgtcgatcggggattgatatgatgatagtagcgtggcgtacgtccaccgatcgaggaattactggatcagccgatcgatcgaagaagacgacgacgatgatgcaaatggatggatcgtgtaattagctggctatggtaggctagatggaatatatatatatataaacacattgatgcatgtatcgatcgatggatagatgcatgcggcagctagcgcagagtgcgggctgccggagacggtggaccaacgggagtccgggacgggcgctcgctcgttcaattcgcgcgatttcttcacgtccattaattgcttatcgacttgaatacttcaactctctatctgcatgcctgcttgccgttcatccattaatatgcatccgtcacgtatatatgtacagatttactactcatacatggattttcatctctcaattgacatctacatctgcatatatatcatctaaatacttacaaaaaaacattttaaaattttgacaagataaattaattactataagatatatcatcttatcatattaattaattcgacttgtataggctgtaacaaaaagatcaaataaaactacaactaaaactagttaacatacctgcataattatatttatttattgtttttatttacaatttatagcagttgaatttgaacatgtatattaatttgtagagtaatatattttatgttaatcatttaactatttagacatgcaagaaacaaaacaatatctcctaagtaatgaaaactatccttcatattagtcaattacgcaagctaggcatgcacactcatcctttcttactttcctcctttctttaattaaagaagggttggtctttaaaaattcatccttgactatgttattgaaaaaaatcatttatggatatatgtggaacgaatacattaataaggtgtatttttttcgcgaacgcacaaaaaattgcacgtcaatatattagaagaaatagagttttagttacatagcacaacggaatggactggcccttgcaaagatacggggaagagaggggttaaaagagaaggagattaaactaaaattgttgctcctaaacagagggagaaaagcgaaagaaaaaccctatcctcccaaaagatccccaaacaaagcggcactagctaaggaccagaggcgaccctcttggaggatggaaactaacacctccaagaccggcgagaggaaagactcgaaaaccctaacactccgctccttccaaagctgccaggatacaaggaggaccagaaagtcgaaggccttgtgaaggtgctctgggaagcggccctagcaaaccgcaaacggccaccagtcctgaaaagtgtcaccacgagaagggacgagcccagtccaaccaggaggggacaggatgttgtgccagatttagcgagcgaacacacagtcgagtaggatgtggttcaccatttcaagctccttgcgcgcaaaagggatagaccgagtggttgtcaatgtcgtacttttgcaaaagctcagcagtccaacaacattgctagagtgcaaaccaaaggaactaattgcacttggcaaggcccttggcctgccacggtaagtcggtgcaaggaaagggaagttgccctaggaagaaggcatggtaggccgagcgggccgagtagcactgttcccccgtccaacgccataccagacggtctccagtgctcggagagagttggataggacacactgcattccagaccatcaggaattgggatatgaccgggacagtgaggacgccacggatatcccttacccaggagttgccagcgagggcgaaggccacattgcgcgatgccctgagacgtgggggcactacaaggagaaggtccggcgccataaaggccatagagcggccatgtatccactggtccgaccagaagagggccaacatggttttgaggtaagcccagtaggaatggccggagccagcgattaataaggtatataattgcaagctaagctgccagatgcacaaatcaattggtccagattcgtggtgacgtccatagacgatagtataaattaagacgacgccaagagaactaatcaagcgaatctcagtgcatgcatgagcgagtgcaaatattattgttcttgtcttatactactatcttacagtttaaaaagtaattgcgtgataatggcgtggaataaagctatatatgtttactctcaatcacttcactttagttgcagttttggcaaatgcgagcatccatcatcggttggttgtgatatatcccacgaccaatatagtatataatcactcttatcttcttttcattgtccacttacagtacagcagatgaaccatgcattgggatgctatatatatactaattgatcggagatagatttttgtcccaaaagatgtcccctcatttcttctatgtcgttacgtgttgtctaaatagctatgaaaaaaatagaaaaaaataattaataaaatagataaatatgaggcatatcaccgttactctataaacatgcaattaattcaacctctataagttataataaaagaacaaatctgactctaactagtacatgtactatttatggtcatatttgttctttttctaatttatataggttaaatttaaaattacatatttacggagtgatatatcacatactaatttatcttgcctttttctcaaaatattttataaccgtttaggtgacactaagaaaacaaggaaacattctatagatattttagctaattgctcttggtctttgctaaaatataataatagtattggttagaacaaactatatacttatattaatttatggtcaattataatttgagtggtgaaggtggttgctgttgggctttgatggtgttgggcgcctcttcatcatcaacaggcaggtgcttgggttcaggacaacaaaccaccaccaccaccgaggaggcagctgcagcgtccttcttcttcccccacagcagaaggtacagacctaggatcatcaacactgatcctagcacgctgccatatatcatcatatatgcaaggatgaaatcaattaattatatatcatgcatgcatatacatatatatatatatatcgtcgtcaatgcatagtactatatacatatatacctgccgaggtggagctgctcatggaggaagaagaagtcgatgaaggcaaccatgatctggatgaccgggatgaaggctgccgtgaacacagggcccctcttccccacacaccatgtcattatcaggtaccctactccagacgccatcaccccctgcatgcatgcgcccccacacaattaattcatctgtatatatgtgcatggtgatagatgtactattagcaaggcatatgtaattaattgattaattaccgagtagatgacagtgacgatctccactttgttggtgagagtccaggcggaggctgtgagcctctcggtggccagtgtgagcgccccaccctgcagcgtgctgatgaagaacatgatggccgtgcaggagtagatcgccgggtatttcttggtcagcttcccctgcagcagcagccacagcgagaagcacaggcagttccccagcagcatcaccgtccccagcgtccattgcttattgttcttcaccatcactgacccaccatgtcctcctcctgcagaagcatccatggcagcagcagctgatgggtggtttgtgagtgccacgcccttgtagaggctcagcaacagcacacctgccatggacgtgagcgtaccaaggaccttggcacctcctgccatgctcttcatgttgagggattccacccctagcgcaatggcgatgaggaaggtgagcacaggagacaagttggcgaatgttatcgcgtacgtcgccgtcgtgtactgcaacccgtagaagaagctgtactgcgacagaccagcactgcatatacatatagccatacatccctagctctgaattattatcactttaatttaattaccatacttcatcaacaaattaataaactattgcatgcatttgaacttagaattgaaagaacaaacacagtagatgattacccaagcaatgcactgaagaagaggtacacaaatatctcccatgtcatcttaggccttgtgttcctgcctcaattaattaaacatactcctattagtacaataatgaattaattctctgagagagaaacatgcaattaattgttcatgtatatatataccgttctttgaaataggcaatcggagataggaagagagtggccaccagctgccggagtgtgatgaggacaaggcgattcagaccttgttccagcgccttcttcactagcgctgtcatcaccgcagagatgaggtcgaacaccagcattgtcatcaccgtcctacactcctcagcctgcaacatcatcctagctagcctgttagtgtttagcagctagctacttctctaattaacgatatatgtgattctctcaagtctcaacaatatatgtatgtatgtaatgtgctagcttcttgctgtaagacagtaaacacactctgctcatggactatatatacccacacacacgcatgctgctgcatagatagccctgtccctccacttattgatattcctccaaaaaaaaaatgaaaaaagcgatggctctcgttcatcccgggggggaatgctaatgctatctgcatacctaattgctcctcgatctagtggaatgttactgctgaaaaattagagtatatattttatccgacaaatgacatctgagggggacactcagaatataattttcagagcaaaggcgaaagtaaaatatcctgattcaattttgggtgcccaaacatcgatctgaaaatgatgcccataaagtgaagaaaaggtgagagagcactctacttacaaaactcttgataaagtcacctcctttttgcacaatcacctggtatgtacgtggattaatcgtggactaaatacattaacttagtatcagagtcaggaatactatgaaaggatcgagccaaggaaaaggagttctcaccttgtggttgtgggtgacagctctcttcaccctcacgcagcgctacctgttcttcaactccaagtctcacatctacattgcaaccaaattaatgcatcaatccgtgcctacgaaaatagagttcacgatggatggtcactgcgtatgcatatatgcatgcatgcgtcgctttgattagacatgaccatatagaaatctgcggttcaggagtgtgcaagggccaaaagaaccggcaaaagccagttggatctgcctgcctgtccatgatgaacaggtctctacttatagttgtagcccgctactgaccgtggacagggaaagacatatttcatgtttcagcagtaagatttcagactagtaaaatgtgcacatgtacagtggcaaatcacgattatttaccatttgggtttaggttgtagaaaatctgaaagacaagtcttactgctgaaatcaacctgattgagtgattgctatatattcagtcatttgcaagatcaagttaattcttcttagagagggaaatagtctgcaatgttatccttggcattgtaaatcttttttgccaagtccttttttaaccctttcattgaggaccaatttatgtattctataagcttctatatagttactacctaattaaacacctaaaactctacattcaaacatagcaattatatatgcaagcatagtaattagtacatcctaaagcttatatagaagcacgtcacatcctaaaactcaacatataaacataccaaataatcatttctcatatcattttcacaatattttaacttaaatccatctatcaattttttttcaatatttaacacatatatccctccatcgtttatacaacatttaggatatttttatttatgtattctatagcaaagcgcgggggtgccatctagttaatctggatcataaccttcgtgctaattgctctaatgctctccacatgtctcttgcatgagtttcaagtgtgaaagttgtgtgctattctattattggcttggcaatgctactttgtttttagtgaaagttgagcatgtgagcacatatggtatgttcgaagttagttcataatgctggagttgaggaatgctatgaaaggagtgctcaccttttgtgtgtgacagctctatatattcaccctcacccaccactaccgattcttcattgtacattatattgcaaccatatatatgcatccatctgttcctatgaaactagctagaactcacaatcgacgctatccatgatgaacgggtctctgctgctgctagctaagtaaaaagacctcttttcacgtttcagcagtaagatttcagagtagttaatgtgctcctcaagtgtcattttcagtggcaaatcacgattatttaccatttcggtttaggttgtacaaaatctagaagagaagtgcttggtgcaaatcactgcacatgtgcatacgagagcactgccaaaaaagaaaaaaaaactacaatgagttatttaggatgatcttttacaccacaaagactaactactacaattgcccattttatgcttccaaattttcctttttctccccgtcttgttccactgcttttgccaataaagcagtagctgatgcttccttgctcttaccccagaggagaagatagaggcctccaatcacaagagcagcacctatcgcactgcaaagacaaaaagaaaaacaaaagtgcgacttttgatgtgtccatctgcgtaataaagttgtcttttggccgatagttccttcaatttgtaactttttagcaacacgtcaatagtttaagtgatgctagttgatagcacaatgatatcaattctagatcctttcaaagaactagtaatcactaaatttatttgcaagcgtcaagcatgagctttcaaaccatgtgctatcataaactagtccgagtgcagttgtcaagttccaaaattatatacctagtacttgtgcttattcatgtgaaggtttatccttttcatgaaggaagaagagatcaaggaaaggccgagagtagtaccttccaaggaaaatctgctcatgaaggaagaagagatcaatgagtgcagccatgatctggatgagaggcatgaagcctgcagtgaaaactgggcccttcttctcgatgcaccaggtcatcagcacataccctatccctgatacccccactccctgcaagtgcacaccaataaaaagtgcaaggtttttttctcagtggaacaccaggacactttgcactgaatctgaatcactcccacttgggaactgtcctgtcccttcctgaattcagaaattctttgcccgggcccatatatctagtaatcctatcttgtactagtgtagtgtctgctctgttacttgcgcgtgacaactatctttgaattaatttccacaaaagttaattcgtgtcctccagcaatggcatgtactgttttactgtgtcgaagaataccctctttaccattttcttttaccagaatcagattcttttgcatcccaaattcagtgatatatataggatttagttttttattgtgagcatgattaagttagcacaatcaggtaacatgtttgtgccaaaacattttggttgatgtttagaataaaattttgcagcaagtccatggcattataaccgcgattaataaaagacagacagggaaagattggtgatagggagagttatcttactgcaaaaacaacagcaatgatctgtatgtttcctcgaatcaaccacaccgaaaggcgcctttgtgttgtgagtgcaacaactcctgcttgcattgagctgaacgaggtcatgaatgcagtgctggagaagactgcagggtatttcttggtgagcttcccctgcagaagcatccataacgagaagctgatgcagtttaaaaccagcaagaccgagcctagcatccatcgctccttgctgatgctgctgctgttggaggtaataccctttgcaccgtgctcttggactgacgatgttgtgtgagtcaaggcagctcccttgtacaggcccaatagcgtcgcgccaccaacagacatgagcgttcctatgacttttgccagccccgccttgctcctcacatcaactgtttccagtctgcatagtggaaaacttttctggatagtgttttgattaagtacaaaattttgcactgtgaatgcattgcaattcctctttattggtaaaaagaatgtaaacaaagctctgaaaatggtgtcagtctgcttcatacactgatttgactggatttgggggcacggcttcacaaactaagccccacgtttggtttgatgatctattatgcgtttggtttgaccaagtttccttacaactacagtcacatttgtaaacttatttcccctactaaaggggtatttacttcttgcccttattttgacaatctttcttttgttttgataaaatctttatttaactgttgtggttctctgtactctgacaatagtttcagtcttgttaatagattgtaaggaagaaggaaataaagaagtgggggatagaagaacttactggagagggatagcaattaaaaaggtgaaaaccggagtcatgttggagaatgttgcagtcagtgttgctgtagtgtagctcaaccccagaaagaacagatactgagcacataatcccctatatacaacatgataagacaaaagagcataatcatataacctttcaactcgtttttttcagttttttattttcattgcactgggcaagagaacacgatattacaggggaaaaacaaagagagcaagtttacccaagcaatgcgctcatgaacatgtaggcaaagatctctgttgtaaatcttggtcttgtattcctggaatcatttatagaaaaaaaaattatgcaagagaacttagagtgacatctttgcaggtattggaacagttccttacatttatataaaaggcatcagagggctcccaatttcacatttttcacttagaaaaatgcaaaggattcgtactaaaagctaaggtccggctagacattttgaagactacgagcgcactagtggtccagccaactagaccagtataccaggaaaaaatagctgagatgcagctcagctccataacaaccaatcacacaacctccaagcttcataccttaagaactactgtaacaccctatataacaagccatttgaaacatgaagaaagagatagttttgaagttcgaaaatatcacacgtaaccccacattggattggcaacagctctcgataaaaattgaagagttactgaaagatcattgaatgatgtatcaccatcggagtttcaaatactttggactagtaactactagaaatgcgaatgatataacaagaggtatctctcatctttcatgcgcttgcatgcacattgttaccaggtactaaacatcatcataaacaaactttgcacaagaaattcagaacctgataagacacttgagatcagattacttgtcacaaacctttctttgaaataagcaatcggagcgagcaggactgccgctacaaactggcgtagggtgataaagacaacgtggtttaacccatcagccaaagccttcttgaccaatgctgtcatcagcgcgaagagcgtgtcaaacaccagcattgcgactacgggcttcagaaactccacccaattcattctctgtgtctgcactgaacagctgaagcctgaaggggtggattaggtaagcctagagtgcctagtccccctatagcaagcttgcttatattacacagtttggctgcaggtggaacaaggcaatgccacacatgtagctatcttgaatggaacattttgattcggtctcaggtcattaggtaactagttcatatacaaacatttgtacatggatgaggtagcaatgcaataggttggcaagcagagcaccgctttgttgatgcagcaacagaagcctcctcacggaacagtggaacaaccgaacaagcaagctatatatgcatgatcggattgcgtgacctgaggaatattggtacaaagtgcatgaatactgactggttctagtgtcattcagctgatgttggggtaagaacaaagggcgatgaattgttccttgagagcatgagcattagatgctaacctgtagccattgctgaagcattacacggcctagcatagcagctactcaatcaagtcagtccattgacatcgtcaggtacgctctctttttgtcctgccgccaagggaagaagaagagtgttagtgatagagatgccagcgatctagtcaagaataagtacttgattttgtatatgttttccagacaagggaatacatgccagtatcagaccatatatctaccaatatattttgtcctatgctgctacgtatcgtgtacttttctcacactgatgtaccagcagcattccgttcgtccatccaattctgcacaacatatagcactgatgattccgcaatctcaggttgagattgtcgaattgctctttattttgcgtcttgacatgacgatcacggagtacatgtgatctcatggatttcctttgcatatttcttcctcatgcacgtacactagtagtatatctcaggcaaagcatcaaatatgttgccaggtgtcgaccacaagagtcccagcaagcgctgctcttgttcaagctgcacacttaaaagcgctactacctccatcccaatatccaatataaatgcaacatgcatatgcgatatatcttagagctacgaatctaaaccgagagaatactatttaaaacaaacgattttacagctaacttgatcacagcactggcaaggcaaaccatggaacattaggaattcaggctgcagcagaaccaacgagggcgagataataataacccaagttgcaggttctttcaacggtgtaaaaaagatccatcaagagaaataagcacagaaacattctcacaaacaatacggataccataggagcacatgctccaattacataataacatcctaacccagtagtacaaaatttcattgtcgaatgaccttgtaatttgactcaaaaacagagcagtaaaagttccttgtgcactctctctaggacaggttttgctacagctagtaaggaaacgcagctcactggtcctcagtgatggtgcccttgtcactgacatagatgccatccaggaacttcctgatatccttgttcttgacgtggcatttctgttgggagcaaaaaggaaatagacatggtttaggacagagatcaactaagcatcaggtagtaaagacacctaacaagatgagactcgtgcagcacagagtagcaaagatatcaccccacctattggtgatttaagtcaagtaggagcagaatcttaacactgttgttatacatccaactagcatggtggcctgtgcaaattgcgcgcctagcatcattatattttctatcatataatagcatatatgttttctcattatattattcaaatatattaaaatgacaacataattttaaattttgcaatatgtgtaatattcatattatattttatatacatgttagttattaattatttttaatatcaaattttagttatttgtaaattgtatatattcctatatggactctagactcgtcttttaatatttcctttttttaattccgaattttctgtaaattgtatttctatatagactctatgctcttcttccaatattatttatttttatttctgaattttcatattatattttatatacttgttagttattaatatcaaattttagttatttgtaaattatatatattcctatatggactctagactcgtcttttaatatttcttttttaaattccgaactttttgtaaattgtatttctatatgcttttttttcaatattatttatttttatttctgaatttttattatttctaattgtatttctatgtggactctaaactcatctttcaatattcttcaatttttaatttcgaatttcagttactaataaattgtattcttatattgaccttaaactcttcttcccatatttttcttaatttcgaattttagttatttgtaaattgtattttttatacagactctagactctacttttaattttattatgtttattccaaattttagttagttttaaattcctatatggactctatactctacttctagtatttcttttttaaattccgaatttctatttttttttcttaattgtatttctatatggactctatcctctacttctaatattccttatttttaatttcaaatttctattatttcctaattgtatttctatatggactctatactctacttctaatatttcttgtttttaattccgaatttcagttatttcctaattgtatttctatatggactctatactctacttataatattccttatttttaattccgaatttcaattattttctaattgtatttctatatggactctagtctcttcttctaatattccttattttttaattccgaatttcagttatttcctaattgtatttctatatggactatagtctcctcttctaatattccttatttttttattcccaatttcagctatttctaaattgtatttctatatggactctgctttttctttttctctgattaatgtgagaatttctaagccatgagagagaacgtggaagctcctttttctattcctttaattatataatagatagatttgggaagcatgaacaaactctaagaaatatacagaatcttaaagcatatgcacacagaacacctactccattatacagcagcaaattaaagtagtaacagtctgacataacgaagcattgtgatttacaggatcatcatagcacacattcacagagctaagagagacaggggtgcaagaaatctaacctggttgatcagtgccgcagaacgggagacaagctcgatatcattgccatcaaggaccagctcatccttgaccttctcagaacgcaaaattgtcacaccctcaagcatgtccactttcctcacctattattgaaggaaacgaaggatgtcataacattttttattatctgtggtttccaagctatatactgaatgaatgtgacagcagattgggaaaaaaacaatgttgaaggccagagaatgatttgcttttctagagtctaaaccacatgtctatgttgtgtagaacaaatatgagaaatattgaagcatggcagaaatgatgtatgtgcaagtgatccctaataatgtgtttttaacagaagaatcagcattttgtgttgcaagactaactagagcagaaatccgaagctgaatgtaggctaaacaggcaatctgtgaggcataaattaaatatttgcagctactagttgagatgaatcaatagaggcgtgtaatcgtggagtggagaaaatacattgcgcgtaggatgaaatcatgtacgtgctggtagatggtaatagaaagaaagggaaaggggtaatgggggggaccttcttctcgccgaggaagttcctgatctcgatggcggtgttggagttggtgatggaggcgttgatggggaaatgggcatagacgaagcgcatcttgtagcggtagcccttggtgacgccggtgatgaggttctggacgtgggagatggcggtgcggatggcggccatggtgcggcgggtgccgaaccacgcgtccacctgcagcttcctcaccccctccacctccagcagctggaagtccaggttcaggtgcttgaagttgcgcgtcagcttcccacggggaccctccaccgtcaccaccttcgccgccacgtgcaccgtcacccccgacgggatctccatcgtctccgaagccaagatcgtcttcatctctcgctctctctctctctctctctctctctctctctccctctccggcggcggcggcgatgcggggcgtggaagaagaaggaagaaggagacgagtggcgttttccgctttatataggtgggtgacgcacacggccttagggtttttgccatattgggcctaggctttctggtgggccgttcaatgatgatggatgggcccaatcaacacgctcgcgacttgtagattgtaatgcagcagcccagtcattttaattcacatgcgcatatataataaataaatgggacactaaagttgtcaaaatacagcagaaaatgggaaaccactttatagtcgacgaatcgtcagtataatatctacatgcatctcatcagatgagatcagatcgagtacaacaagatggcgtatgcaggttgcgcatgcatgcatgaaaatcgagataaaaagggattaattaattattaacatatatatatccatcagtagacttccacattccattgctccgacttcttcagctgcttcttgtagtcaagccagtcgatgcctacatacagtatataatgcaagaaagaaagtaattaggaatcgaatagagatggagattaaaagaagtactagtacagtaccgtcttttgcagcgaggtcgatcatgatgtcgtcgatgcctttctccatgcccttgaggccgcacatgtagacgtaggtgttgtccttcttgagcagctcccacagctcgtccttgtactccgccatccgcgtctggatgtacatcttctcccccgccgcgttcgtctgctcccggctcaccgcgaagtccagccggaacctctccggcgcgatctccttcatccgctcgaactcctccctgtacagcagcgtgctgctggtgggcaccccgaggaagagccacgccaggccgttgaacttgtagtcgtcgtgctcctcgaagaacatcttccacaggaaggacctgaagggcgcgatgccggtgccggtgcccagcatgatgatggtggcgttggggtccttgggcatcagcatctccttccccactggccccgtgatcttcacgtccgaaccaggcttcaggtcacctaaattatactccattaattagcacacaagtacaatctaactgctattacatgatcagactcctagcttacagaggaagttggagcagactcctttgacgatctctccctgatcgttggtgtacaccagcctcttcacgcacagcgatacctgatcgatcgatcagggacgatgtcgatgttagttagctcatgtcttgtggttgagatcgatggagcaagaaaaacactactagctagttaccgtcttggagtcggcgaagtccccgatggcgctgctggcgatggagtagaggcggagcttgtggggcttgccgttcttgtcgatgccgtcggggatgacgccgatggactgcccctcgcggtaggggatctcgccgtcggtgctgaacaccatgtgccacgtctcaccgggggcgtcgtcgccggtgatcctcgtgttcaggaggcaccgccccgtgtacggctccttgggcctgtacttgttcgtcaccacgccatccacctgcttcttcgacaccttctccaccttagtagtcacctccgcagccggcgctgcggtcgtctccgtcgtcgacgcctgcgcccgcacgccattaccgctgcttcgcttggaccagcaacgaggagggtagaatacggagcaggtcgacggcctcggagctcccccggctacggcggcgccagctttgctacagggcagcgacgacactgtgttcacggcggccatgtctgtgtgcctgtgactcgcgacaaaggaaggagaggagaggagaggagaggagaggattgtagtaattgagattggaaaagagagagagaggattggattgagtggaagagaaagcaggtgacgagcttgtggtgcccgtgcgcgcctccctccctccatctacttagtactagtactattcgatcatgggccacccaattttagcctagcaataagttcactttgggtccctctatttgtcgcacagtccgattttcgtcccttgaccgtaaaaccggatacgacccgtcccccaacttacgaaaaccgggcaaacaaggtccctcagcggttttggctgacgtggcacctacgtggctaatttaactcggtattcatctgacgtagcgcttacgcggcaattcgatccggaaaaataataaagcacgtgggacccacatgtcattttcacacatcaaataataaaaataaaagtgggaccacgtgggccccacatgtcatacccccccttatcttcttcctcctccctttccatctcccctctctccatctctctcccctcctctctccagcctccaggcgccacggctcacggggtcacagggaggtccggcggtggcggcaggcgacgcgacagccaccgcctgcggcgagctccacctctcggcgcataggtgatagggccggccttttgtttatgggccttttctcttattctgtctacttccattctgatgaatattctaagcagatgaagttacatattcagtacattacgattttatttttttttaaaaaaatgttaataaatgctaccctccgtattttaatgtatgacgtcgttgattttttaaccaacgtttgaccactcgtcttattcaaattttttatgcaaatataaaaatacttatgtcatgcttaaagatcatttgatgataaatcaaatcacaataaaataaattataattacataaatttttttttaaataagacgaaaggtcaaacgtttgtcaaaaagtcaacggcgtcatatatatattaaagtacggagggagtataatagtaaaacatctaccaataggcaagcaaccgataagttttgaaatttaaacagagaaagactcacggttacaggacaagtctctatctccctcttaaccatatccaactaaagtactccgtatcaaatacaaacatctatatgaactagtatgtaactaattaatgtctatatgaactacaccattcaaaagtagaatataacatctctagctactgattttaacggcccctttgatttgtaggaaaaatgtaggaattttggaggatttcaatcctatggaaaaaaatccaatgaaggcctttgaaacaaaggattgaatcctatccaatcctttaaaattcatatagaatgtgtaatcctatgcacattttggagaaaagttagcaagaggtctaacctcttggaacatttcctctgagtctctctctctctcatctgattcctgcgtttttcctgtgttccaatcaaacagtcattcctgtgtttttcctgtgttttgcaatcctctattttacaattgtattcctgtcagaatcttgtgtttttcctattcctctgttttttcattcttacgatttaaagggcccttagaattcctatgaatttaagagtgtagcactactacttataaaatcatgctcctttcgtatgaaagcatcaaagaccaagaatatatatagccctttagaagacaagaggatgacatgtatttggttagacgatttttttggttgttgaaaactgcactacattattacggcaccgccaaattactaagatttcactttaactgagagaacaactctacattacatgtatgatttcttttttagttttagcaacttgtaaacatttatgtacctacaagtctactaactaaagaagctgacctcgtgttaataattagaaagattttacgattggtgaattatcataatcgtgcagaattattattgtttaaacatgcatggtagacgcttgtgcacaaactcatccgatgttgtgtcctcgccggaggagcttcacggtgatggtggggtggctgcagagcacactaggagccgccatcgccgtcgtgtctggcccccggcggcatggacgggtgcccttcgccacccacgtacgtggcggcgccccgtgcagctggatactttgcttttctgcctgacaagctggagcatttccagaccaacacagcagtatgcattccgtcatcatcactacgtcagctcttaaccattcaactggactagtagatgataaattctttgtcaaggcaagcttggcacaaactaaattgacacaaacaccaatagctagtagtatgtttcggggatcggccactatcgccgtatctgtacaagcttttaatcggcaatcatacagagcatgcaaattttaaccctagttaggggctcataacacaaatccaacagatagactagccaaaattttcttccaccgcgctacttgacttgatacgcttaaacaacaaagtaatcaaatcagatcaaaaatgatattgcatgatacacaagtcacacattgctagctgtggggaatgtccagggcactggaatcaccgagcaccttacgagcgcgccagtatatagcatttgctgtttctgatgttcccaactgcccatgtgcattttcaatgtaatgtcagcaaataaaatacagataaggaacttaatcacgattaaaagaacaatcggatgaggaaacaagcgatatggatctcaccttcagctccatgttgtagtagttcctccaaagttctctttcctggggatagagatcgagcgctgcatcatacagcttacgagcattcacaaggctgtcttggtttccgattgatgcaaggtttgtttccaactctatgcagtactggaagaacttgaagcttggacgtggtaaagccagaaatctgcatcgatgcagaggtgtcagaaacatgcttactcaaacaatacatatgaattgattcccgcacatgtttctagaagaatctatgtgcacttatagttcatacacaaaaggcagaatctgaaacatggaatgtgcaatgaaaattcatagcacgcttcgctcagtttcaaagacaacactacttgcctaatagacaaaaactccaaatcttgcagcaaagcaaattcaattcatgcaatgaacaatattacagtgatatttcattcaaggaccataaagttcatacctcttatacatctttctagcttgcttgataccatctctttgtaaaatccatccaacaatagcagaagaaaccgaagctccacaatcatttccaccagcagaacttaatgataacattgcacatttcaccagcttttcgaaataaaccttctcatgagaaaacaatttcatggcctgaaatgaattacaacaagcttttgaacaaatatgcaacgaagtaatgcattgtgcccattacagatagtagaaattagtacaagcagtcaaacacattaatacatccatggaactattatataaatacattgcatcgttaaaggtaaaagaaacaaatcaacaaaagaaaagatgaaccataatcacagtgaaaatagaggagcagaataaaactttgtgaaacaagttcagagataacacatgagagtaaaagagatcgagaagggtctataccgtgtgccacaattcctcagcctcaggtatgggtaactttggaagtgcaacattaaatagatcaaatagagaactcaagttctccttgctgaacgaagaaatgccagtagaagtagcaagtgacttcatctcaatagatgctctcaggttccacaaatccgcagcatgtgaaagaggaccattgcagagctttttggcaagattcctagcttcctctaatcttccaggtgcctcctccaaacctccaagtctcaaataaagagacacatattggcaagcaagatcttcagtaagacaaccgcttgattcggcattttgatagactttcagtatacatgaagtgaaccctgaagcatcaaattcaccgccatgaaacaatgagatggaatcttctgtatcagcaaacagaacacccatccaaaattttgcatacagggaatacattctggaagttggcaacctcctgacagcttcatcatacacctacaatacaaaaaacgtagtttgaaatgtttaaatattgagtttgattattcgtaagtctagggcaggttgcattaatcaacaaccttttttttctcccaaagaaagcaggcaagattgagtgacagataaaaataaccaaataatgagtttttacctgtattgatttattcagtttatttgataaagcttccattctattcaaattactggaactagttgagtcactaagctgaagcctagcaagccaatcccagtagtcctcactgtcagagaactctttcttcaggtcatccatgacctctaccttcagttcgtcagaatgtgctaggtcaacactactcaatatctctaagaatttcttccgcaaggttaagcttgaaggaagagcttttgtagcaccatggtatatggtttgaatgattagcagcccttgctgccagaataggtcttccttcccctccaaagcaactccctgtgagccagactccttgggaccttcatcttgttcattcagtgacatgaacagttctttattttcctctttccaagtgcttgcatcattattcttcttttgcagtgtcttcacatcctctccaagagcaacctttcgagccttaagcttgttaagataggtaagctccatgcgaagatactcaatccacatatcctctgattctggacaagatctaagaccagtctgcataagagcacgtgctgcagcaacatttaagttctgatcaaattcccatgctgctgcatagatccagagcccaggaaccttggggtggtaacgaatagcttgtgccagagcctgaaaaataatacaatgaacatgagatatgtaaatttagtaaatagtgagatcaattcaatgttagccttccaaaaatatatatacgcatgtttacatatcatcggaggagaagttcaaacaaaaaaggcatgaaatggggcacataaatacacaacaaaagaaggacaaacaggcatcaactcatactaagatttaaaatgaaatctacatccaagaaccaaaaaaaagaaaagaaaagtttcatctctaaatagctttcaagctctggccacattatatatttgcaaaaggaaaaaaaacacaatttcaaaaacttcaaaagctccaaccttttgccagttatgactatatttctatgcatactgagtagccttcggaacacaatcagatctcaaacaagtacacactggactggggaagtccttattctttcttagctcgaatgttgtgaaaacttaaacaactaattccatatgaaacataaaaccaatcgcttacactacagcttttctgtcttacccttcaataggttaatgactggtatttaacgtttaccggatctggactggtgagcattgaacgatttcttttttctatggcttaccatgtccccaccgccgccttaacaaacagtgcacaacacaacagctccagtgatagctggatgcggggtctgtttagtggcagcactgtagtgtaatctcataccgttttcgcgacgcatagccagtgacaccagtgcagcctatgtcatattcaggattgcgcggtaatctaccatgaaccagacaatggttattcggtgtaaaaagcccaggaaaaaaaataaatttcaacaataagtggggtcatgactttattatcttcagcattcaactatttatagcgtattatttctgatgcacaaccagaagttcatgtgaaattgtcaagtaatctataaatttctatcagcaagacgtatggcctaacttgctgcccgataatcacaatgtgagtcatgcgacttcactcaatgccaaacttaaattcagagcacaagaaggcttcaaccgtaataaaattcttattgatcaaacagagacaaagagatgaaatgaacctatgcattcataaataagtgaataaagttggttgcccgtgtccctcactcactacggtgtggccaagaaatgaaagggcgacatatagtaatcagtactaaaccattgctacatcaatcaagagccgcatgtagaaaagctaacaaaattgattgaacaaggcaatgccgcagtatcatacatagtatggagaaagaagtaatgggcaggatgagacaggaaggtgggaaggttctggggagacttgcctgcttcatccgaccatggcgcttgtcgcgacagaactcgaggtaacggaaccagaggtcgaggtcccccttgtacctgacggtggccatcctgtagatgtcgaggacgcggaggactccggcgatgtcggagacggacttcttccacttcttggccttgcccttgttcctcttcttcttcttcttcttgctgctgtcgttgtcggtggcgtcagcatcgtggtcggtggtgtcgggggtggcgcgtatgatggcgcgcttgcggaggtcgcggagggcgtcgaggcggagctcgtaggcgatgtagtcgaggaagtcggagcggagcggggagcggcgtcggaggcggaactcgaagtcgcggcggcggcggacgacctcggcgagctcggcgcgggtgaagaggccccggcgctcgaggtcgtcgagctcgtcggacatccgctcgaggcggtactgcacggcgtccgccatggtgatgtcccggctgccggcggcggggaaggaagggtagactggggttttagggtttttgcgtgtgagcgcctccgcccgcgagggaggaaggaaagatgtcaccttctattcttctacatgggctgggctgggccagaactggactgtagcttccttacgcacaactgtagcatacgtgcaggcccgttagaatgaagtcattgcaactccctcaactattgacccagtctaattcgtacccctccaccgcaaaactagggtgacgcctcggctcgaattttttttatttatactttttttattaaaatatttacaaaaataattttttgtttcgaaaatttacaaatctaattgcctgccgcccttaagaagggcgatttttaaaaatcgccctctcaaagggcggcaagggacctaaatacaaaatttttatttgtgttcaaacccttcccaccggttttaattgcttaaaaactaataatgcttattcgatactccaaatgattttaaatggaaaagtgataaactacaaagttatagatctcatcaagatctacaactttatataaagtttatctccatccaatgtcgtttgaaatgtagatctgagattttttaaaatgtgttatatattttgtaacgaatatttagatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcgaaacaacaaattatttttgtaaatattttaataaaaaaaagtataaataaaaaaaattccctcggctcgggcgcccgatgcaaacgggttaaaattgacgtcagcgcccgatttacgtgtaaaactactttaaactgatttttctcttaaattacttatccaaatcatgatccgattgcaccattaaattcattgcaattaaatctttaaaacaagaccacgcatggatatatcctgacgaaaaaaaataagcttattattgaattatttttaaatgttgcacgatgttccaccaggtatatcgaaattgtttcacaaagtagatcgaaaatgtttcactcgtttaaatcgggtgttgtttcaccttatataaaaacaatgtttcagcaaatagcgaaagaatgtttcagttaactgcaacattagatctatacatagtgaaacaatgtgagtacactaggtgaaacatttttcggtggaacagaaaataacaaaatatgtgggttttttgttgcaatggaatatttcaattcactgtaacattagatttatacatagcgaaacattgtgagtacattaggtgaaacatttttggtggaacaaaaaataagccaaattcccttaatagagagtttccaaaatatttgggtttttgttgcaatggaatgtttcgttcactgcaacattaaatctatacatagtgaaacattgtgaggacactaggtgaaacatctttttgtggagaaaggggagggagaagtgggtggggcccaacagggtcacgtggggggagagcgaacgtgggggagcgcccgatccggctccccctgcgccggtcgcccgggattgagcaattccgcaaaactagataccccgtagctcgctttcccaagtattaaaaaactatatacaaaacaaatccatggctgttttagggtggttttggcttaattacatgatgtccatatgacaacccagtataaaaaaaagttttaaaaaatagacttgaggcccacatataagtgataaggagaaaaataaaaaatattgattgctagcctacaagtgtctaggaaataaatatacataaggacaaggtatttccacacaaatcaatcattttatcttatcgaattagtgcagtctgttggtacttactttatatggttataacaacatttagagctcgttttatacactggattgagaaaacaaaacgaataagaaaaacacaaaatcttgatagaattgtaattgcaaaacatggaaaaatacatgaatggtcatttcaataaaccgtatgagaaacacaggaaaccagaagagagagatatgctcgaagaaagctttccaaggggtttgagttctttctaacttttctccaaactttacatgcatttagccctttcttaggaattttatagcatttggaaagctctaatccattagtttcaaatgaccaaaaaggaaaaagtcctatataatttggatcctacaaaactcctccacaaatctgtgtgctctctatgcgtgtcctctaggtgtaacatctaatatgtatccatgctagctacattctatttttgtcccacaatataagaaatttggcgatgcatttgttagtcaaaatctcttactacctctgtttcaggttataagactttctagcattgcccacattcatatagatactaatgaatctagacacacatatatgtctagattcattaacatatatatgaatgtgggcaatgttagaaagtcttataatatgaaacggaggaagtatattataggatactgttagtatgagataaacactgtataatcatcaaataggttttgtgggatctaggaaacctgcactttgaaagcttgaagtaatgttattgggtgcatatatctagtattttatctccaaaagtttattgtctggtagcatagttttgttaagggatccaattggaccaagtggatcctccctactttttaaagaaatagtttctaacctcgtgatcggcttttaaagagacctacttgtgttaccttaggttagttagggtgggtgagtttccaatatgatttttttatgataagggccacacctccctttcccatctccctagttttcttgccccttgtttgtttctctaaagggacaaggaagcatgaatggttaatatactcaacacgtcatttcttcttttagacgccacggcgcgctcatcaaaaccattagtctcggtttagaccttacttgattaattcaacgataaagctaaccatgagagttggtttgcactatatttttatggagctaggaaactgaaacaggatcaacttgcaagcaggaaagcagaacaaggatggatattattgctagtttgaagtaggataggtgtggaatctgacaaatcaggcagatgtgtgatcttttttctttgaaaaataatgaaaaaggagggggaaagaaaaatcagattttggttggctcgccctccgtctcaaaaaaagacaaaccctggtttccgtgtccaacatttgatcgtccgtcttatttgaaaaaattatgaaaaaaattaaaaagacaagtcacgcataaaatattaatcatgttttatcatctaacaacaatgaaaatacgaattataaaaaaaattcatataagacagacagtcaaaattggacacggaaatccagggtttgtcttttttttttacggagggagtacgaggctcggtctgcaagatggtccacgtggaggtccccaccgcggcttttgatggcggtgggcccaggtcttccacgtgtcggcgcatgagtggatgtgtccgtacgaggccacctggtcctcgtacgaacgggcaagcgcaagcaagtagtgtgtcgacacgtggagccagtggtagaaacacaagcgtcgtgctcccttcatttctcactcaaattaagcagctcacttgcacgatgatcggtgcccccaaactagtataagtacaactatagtgtagcacaaacgcattttctatgcagggctgtctacatatatcattgatgcacatctctgcatctaacatgcattaccgtatatggagtacttcttttgagacgtcacacatgatatgttaattctacacatcatgatcattctgtttcttcaagcaccagtacatgcaagattttcctagacaccaaaccattttgtttccaaacggaccataagtgcaaccgcacaggaaaatgaggaacgggctctgggccgtcgcttgcacaggaaaatcaatttttgtgtgcggttcacttaacagtctcgcacacaaaaataagccgcttgcgggcttgctaattaagtgatccactcacgaaaatagcctaacccacgcgctgcccaacctcccatctccctcttatcctccttcccgtcctccccatcatgcgcgctaccattattcctcccatcctccctcctgtccatcgtcccatcctccctctcctcctccccatccttcctctcctcctcggtgacggcagcgccctcggttagggcagcggagatggcggcatcggcgggcgtggccacgacggcggcattggcgggcgcggcagccgcgacatcggcgagcgcggcggtggcggcggagcagatccgtctctggccgccgcgtggaggcggatccgtcgccggccgccgcggggaggccggatcagcggcctgccaccgctgggacaacgactcgacgacgccggtggccagcctacgacgtcctcgtcggcgacggcgttcctctgcgcccactgcgtgaccacgcggtacccggacatctgctatgactctctcctcccctacgcctccaagttctagatctgtggccggtggggaggccggatccgtcgccggcgaccgcagatggtggtggcggcgacgacgacgacgggcctcgagcaaggcagcatcgtcggcggtggcggtgttgacggcagctaggttagggtttgcgggtggattttaatttttttttgttttgtttttttattttcccgtgtgggcggtctaagcgcccgcacgcgaaaatcgattttcgcgtgcgggtgcgtcacccgcacgaaaaaatcgggattttcgcagacgcacccttccagacgggtggaagctccgcacgcgaaaatctattctatccgcacggaaaaatctttcatgtggttattgtcgcttttggtgttatccatcttgaattataattttactgtgcattatatacattgatagtctctatggtttgcacacgccaattagcagacaagtagacgagcagtttccaatgttgcgtcacacatcgatccctacagctagctcgattatattggcttgtgtttgtaatggtaccgcttggttttaccatgcatgcatggttggtgtcaatggtgataccactctggtgaccgtgtcactgctaggtccggtaaccctttcctcacagtaaccaacgcttgtttgttggtgaaaaccactgtaaaatccaccaaacaattactccctccttccctaaatgtttgacaccgttgatttttttaaacatatttgaccgttcgttttattgaaaaacttttgtgatttatgtaaaactatatgtatacataaaagtatatttaacaataaatcaaatgatagaaaaataattaacaattacttaaattttttaaataagacgaacggtcaaacatttttaaaaaagtcaacggcgtcaaacattttgggatggaggtagtaatatatatgaatattttgctagctactccatctgtttcaaaatgtttgacactattgactttttagcatatgtttgaccgttcgtcttattaaaaaaaatttgtgaaatatgtaaaactatatgtgtatataaaagtatatttaacaatgaatcaaatgatatgaaaaaaataaataattgcttaaattttttaaataagacgaatggtcaaacacatactaaaaagtcaacggtgtcaaatattttgaaacggagggagtatatgggatccaccacatgattaattggctccgcgcactatcataaatacatgctccatatgtcactcgatcttagtaattagattgtttaatttgattgcaacaagtcgacaaatactatcggctgaatagttatagttaagagtggtgttggtgtggcaagtaagctagctctcgtcccacggcaacttgtatgtaaaataagaaaaacaaaatagagcagttcaattagtatttaagaattcatactataataactaataagtttaaaaaggctggttacaacttacctagtgtttaacttaattattttgacctttcatatatgtacctgaactgagcaaatatattatggtatgggcatttaatttcatttatataggacacgattcattttgcacatacgtacagtatgtactccttgaccgctacacttaccatccttcatgtcttgtctagttgccttaattaattatcacaacagttaaccttttaaaatttgttttgtggtaaacaaaataaataacaatgaattagttgaagattatcatatataaaataaggttgcttggtattgtatattggtatggtgtagcgccgctccacttgattttaactcatcaccaaagtgttatctctatacatgtgtaaggtattttccagaccatctttccgtctctaagccttacaagctaggatttactgaactaagagaaaaagaaaatgactacaaaattaggatgactatagccatcatccactactatataaaaattgtgacagcgtctcttgagagaaaaccataaactgcggcgccttatttacgataaaaactagcggtttacggtgtaccacaagaaagatcgtacaggcgcaaccaaaaatggtaaaataaaaataggaaaaatgggaaaggggcatatggggtgaagggtgatgatggcaaccaggtgttggcagtataattgtggtcccgagtcatccttggagcctttcctttctaagtaacaaattaacctctctcctctttctttctttctttctttctttctttctttctttcttgctctcatctagagtaccctttttttattataattataagaagagaaattaagctgatgtgatttgtctgccccggccacaaatccattcatcgatctatggactaccagctgcagctaggctagatccatccatcagctgggtagctgagagttgagttgaagaagcacaagaggctaggtagctcatggcggcggcggctgcaggcatgggcggcggaggaggggtgcagcatcaggagacgacgacgacagtggtgcaggtagcggcggaggcgagtcggaagaaggtggaggtgagatctgcagggcggcgcgggcggcgggagatgcggcggatcgaggacgcgacgagcaggcaggtgacgttctcgaagcgccggagtgggctgctgaagaaggcgttcgagctgtcggtgctctgcgacgccgaggttgctctcatcgtcttctcccctcgcggccgcctctaccagttcgcttctgcctcctccgagtaattaaccttttctttctttcacatccatctacttacttacttactttatttactccacttaattaatttgttattactactcctaattaatactccagtactatacatgcatgcatgcgagcatgaaatatattcggagtattttcgattttattgatccgtacatatgttcatatagcaaacacatacgtgtacttcttcgtgtactgtgtagacgataatggccgccccctcgctgcctaaatatattttcttttcttgagctcttctatctatattgaaaaaggaggaaaacagtacatatgtacttcttatcgattgtacttatctatacgtacatgtacgtagatgtattacgacttcttaattttaactagtactagtaggagtggacatatatatatctatgtatatgcagactaatgaactaaaggctaagtcatggtcgaaattaccatcacatatataataactaattaaagagatgaattgaagtttatgtatataatggtcccttctgttagctttccattttggtttaaatccactcattgatactccttagctccattgatcctaatatatagatcaaacatatcacaaatatttttcttagatatttcataatataaacacacacatatatatatatatatacatgcaattaactagcacacatcccctcccctgaatttgtttatctttaaatcctctaccctcaaagtctctccaatctcacttagtgcatgtacgacgatttttttaagaaaatgtactgtgcgattttgttccaattaatgtaggagtattatacgtagaactatacgtacatcggcgtgtcaaccgtatatatatggcgtgcggttacttgttagcaatgtctgcaaaccctcaaccataattaaaacgacacacagtttaacttccgtgttattaattagttttaacatcccaacacaaataatagatgaactctgttattagtttaaagggagtaagtgaactagaagtagaagtccgattgtctttgtaaaaaaaacaaattaaagtacttattccgttccaaaatataaagattttatagttgtttaacaaataataatattaggtcaaaagattctctttcattcacttaagctgtcaatttttaaacagcttatagataatccctttaaaaccatatgactgtctgtgtaatcattaaatgatggaagttataaaatcagtgtggaaatccttaaattgcgatacaaaatttgaacctataaattgaacttcttatattttggaaccgagaaagtaacaaaagagacttgtctttgcagatgatcccaaaataaatcaacttcttctagagtttaaatttgtcccaaaataaatcaatttctaccttcttacctactacctatccgcaaaacgagaaattttattacttcaatacccctcacctacccatcattcaatacaacatccacattaattaagggcattgtggtcttttgtttccctccttaaaagcttattggaaagttagggtttgagttatttagggacagagagagtacatacataaataagtatatgtaaaaaatccatgaaatacagtgagcatgctgggagtacatgctgattatgttgttcccttttgcattgactagctacctcatacttccttcgcctcaaaataaacaaatctcgaagtggatatgtcacattattgtttaggttggtttatttttggaacggagggtgtacaattaatattcagaaaatgtgtatgatattagtccagaatagtactatgtaggatgacatgatttgcatatcctgctaataactatatataatttataattctcctttgattatctatattcgagagcttgactaataactgatgggaaaattccagttatcttcactttagagggtgatttgataatctcacgctacctcttttattaatttctggcttttaacttctcttggaccatatatatacgggacatgtcttcagtggacgactacttctattaattatatattcttgcattaagatacatatactaataattatactacagtgtaattttatatatcaatcttgataattttaaatagatcgatctaaatcagtaaaaatatattcatagttttgcctcgcgcgatcgatagctagagatctgcataaactgatcaattaagcttgaacgacatactaatggtttaatcttgacattatatagataaaataaacatataaaatatctagtgcattttatcatatcttcattaaggtcacctagcttatcttattgagccaagtaagccggcctgggcccgctgtggctccaccactgtataacacctaaaaagatttatcaacaaatttaaatgctatttatttataactaaatgtgtactcgataacgcatcaattctctttattcttgaattcattcaaaactgagctgtttactcttgaattatatataattaacatttttttgcgatcgaacaatttgaactaattaaggatcttggtaatgtatccatttttaaatactccaatcactatacatttttgtactttgaccactcgatcgtctttccaataacatatttgcgaatgctaaaaaatatgccatattatcgaagggtataatatcctaaatataagcataaaactttcattaatcatataataactatattcaggagtaattagtggtcaaagatgaaacaacgaaagtcaatattattaattatatttgaaactagagggagtattactaatttatatatgaagatcaacatgaataaatataccgatatatatcctgaggttgcacaagtcattaatttcatcattttttttcttaactgatttgtttgtgaataaaatacattttttattaagcaatcccttcatttgtttccatgcactattgaaaacaaatgtgctatatataactgctgggtgcattatttgatcacagaacatgtgagatcatgcatattttggatttttgaacaaagacatacgtgacgctttttatttttttgcaaatgatcaatgggttatatttatgctcttatagttatatctgtgtacttatgcagttaatttgcttcctatttgaaacgtgatcttcatcattttacatgatggtattgatttcatcagctgtaatatgttaggagattatatatgcatgcgtctctgttattacacatttcaccaaactgactgataattttcaatcgccagcttgcagaggacaatcgatcgctacctgaaccacacaaaaaactcatctgcacatgaagaaggagaggaatcatgcgtccaggttcaaattttattcgtcctatttaagtactaaaatatcacgcatgcacatatactccctccgtttcgaaatgtttgacaccgttgactttttagcacatgtttgaccgttcgtcttattcaaaaacttttgtgaaatatgtaaaattatatgcctacatgaaaatatatttaataatgaatcaaatgataggaaaagaattaacaattacttaaattttttaaataaaacgaacggttaaacatgtgctaaaaagtcaacggcgtcaaacatttcgaaacggagagagtattaattaggagggataccatatgatgggatcgaactgtttttgactgaagatcatgcatgaaacatcatgcttattctatatatgcatgatcgattagcacaagatgcatgactgagtatgttaatgcacgaaatgtatatattacatatataatatatatagttttcacttggaattacttattaattgtgtttgggtatgcgcgttattttcacagaagtggagatcggaggctacaaccctgggaaagaagatagaagcaattgagggctacaagaggtgactaaatatatatagtacaaatgattaattatattagatatttatcaatctaactatatattggggtagtttgagaattaatgcacatacataaacgcatacagtaagctgttgggggaaggcctggggtcgtgttcagtgcaggagctacaagagcttgaagtgcagctggagaagagcttatgtagcatcaggcaaaagaaggtataaatatatatgttggatctcatctcgatcgattgcttatttgcttacatatagtttgccttttttggctcgtgtgtgtatcgattcaagctatatataattataaggacatgatctatctccgagcctatatttcatcaagaaaaaaaaatctctgaaatctcttatccattttgttttgatgtgggaacaattattgtgagcagcaaaagatgctgatggatcagattttggagctcagggagaaggtacgtatatacatgcattccggtctgaatctgtatatatatccctactatctactaattacatcgaatgattagataatctccacctagcagctgacacaaacatattttactacctgaatatatatatacacctgatatatatcctaattaagtacactagaatagtagaattaatagtggagaagaaacatgaatttcatctagaaactgtagtactcatccatacgcattatatatagactgtagtttttggaacagatcgatcaatactgtatatgtccatgtgtgttttattaatgcgtgtttaatttgtttgcaaacatatacacaaaacatgcacgcaggagatgaacctcttgaaggagaatatggtactccgtgatcaggtgtgcgtatatatatacatggctacatgctttgatgtgattgaaaaactccaaattgaatgcgaagatatatatgtacacacagatggagtcacgcacgcgatgaattatatatgtaattatatatgcagtgtaaggctctgtcatcgccatggtcgacgtctgtgggagagctgaagaataagcaggcggatgatgatgttcatcgtcatgaggattattccggcggcggcgtacgcgacgacgatgatcggcgcatgatggaggacgtggagacagatctggtcatcggacgcccgggatcgatatgatgaacgagcagcgctggctaacttcatctatccaatcaagaaaactctgtatatgtagttcggctggcagctaagctacaatactgaataacgtaacaattatagttttttttaaaaaatacagtacaaacgcaggaactcagaatacaacaatcacccatctctataaactcatacatacactttgtatctctataagcatttttgaaagacttgatatcttgagattgaagaatatatatgtatcaacatacatatgtatggatgcagtgaaatcgatcgatcgttcgatatgcgtatctgtattgtgttttaaatcctatcctattgattctttgcatccgtatgtgtgcagatatatgattaactaaactgaatcagctggatgttgggcgcctggaaaagtagctagctagctatagctagctattagtaaagctaaaattaatcaagatgagaggtgagtgatcgatgtacgttgtttgcttgtcgtggatatgcatatcattcatgtacgtatgtatgtatgtacgtatgttgccaaaaactggagcataaacacaagatagatctagggtttagatataaagtagtgaaaaacaaagtgtagtacatagcatttctgtgagaaaattatgaaggtgcaaaacacgcgatagcgagcgcagaggaatccaatcccgggccaagagtggattcggcccaacccaccacggcccacgcgacacgttgtgcgcacgtgctccgttcagatcaggcggactaggggagtactcctacgtgttaattaaggaagaggagaaaagagagagagagagagagaaggaaaaaaaaaatccccaaatcgaatcgatcggaatttgcttctccgttgaggcgaggcgagggcgaagggggaacgaagtggaaggagatttggattgattggttggacgccggcggcgcagatccccaattcgatctcctcctcttcgatcttcatcctaccctgcctgccagtgccaggtaattcaattcacccttccgtcttccccaattcacctcacctgcttccatctccacccccaaatcacttgattacggcttaggcttcgggaattaatcaccccccgctgctagttacttagggatctgatgaatctcatctcctactccctcaacctcaatgaattgaattcttagtttgttgttgttccctccaattgactcatctctgtgcctctatttccccgaattcattcttctctgtgcccgcccgtcatcaccaattccgttattattattatacctctatttcctgatttgctttaaattatcaccacctaggagccaagtcaccgccgggcttgtttactttccattgcaacaacgatagttttacttgttacatgtcaacacaacaataggctgttcgcataaccctcatgtctagtatttgcaaaatcatacgtacttaccaccgctttgcataactctggagtactagggatatgatatcatgcggtctctgtaaattttactaagctgattgatctttttcttttaatttcctcctgatgcagtataagattcttatgagctggtcggctgtggttttccctcaattctggtgctactaagatgggtcaggagctcaccacaaacaagcctctcacaaccctcttaccaacggatgaaatagcaaccgcctaccatttctccctcctcctctcacctgtcgtctccttttgggactgcatcttccgcaagataagatactcattcagacctgagtgggtgtagcatcctgcactgcctgtttctttttagcgctagccagtgctttgctttctggcctggatcactccaaacaatgaactttgaagcttttgctttcccgtaattacaattacagtcactagtggagtttagctgaaaatagtacatagttgtcatggaaaaggccgcggccaatcaggcgggcaaagtcttgaagaaaggtaagaagaaacaagccaaggatgaattagatcgccagaagcaggctgagaagaagagacggcggctggagaaagcgcttgcaaactccgctgccattatatctgagctggaaaagaagaagcagaagaagagggaagaacagcaaaggctggatgaggaaggtgctgcgatagctgaagcagttgctcttcatgtcctcattggtgaggactccgatgaaccctgccatttgatgctaaacaagcacagaagatgcaaccattgggatcactcagctggttttgatttcgccgtggatgcacaaggcgctgatatttatcctcctgatggactgatacagtgcgctgatcatgtttatgctcccaaagggaggtgtattgattgggggattggccagccattgccatcttggggagaggtgaaggacttgcagttgcaggcaccgtgctaccaaggaatgttccaccagtcagttgcatgcccaggtttcatagcagctcaagcggtctcctccttgcaaatcggaggagattcgtcagatattacctctccaagccaaggagcgactgtcgttaataggatgcttggtgccaccaacaggctcaacctttacagagagatataaaaacatacacttcacgatattattattgtatatagtcatcaaacttgtgttgactactttgcctgcagtatatctcataaccaaagaagaattggatagaacaccttgtttactgtttctgtgagtctaaaaggatatcttatatcagtcaaattggtattgtaatgaacatattgttttgattccctgttgattttcttggaatgtatcctgtgtcgacttgatgttctgtacagtgctcttgtgctttcttttacaactattactatatctaacttgagatgtcattctttttgctttctgtctatatggttgtacgatcttgataaaaagttgatcaacttttgattcagattggcactgtaggtgctgacctgaaggcccagagaacagtagcagctgtaaccttgcctcgtgttagaagctactgttacatgtcagtttaacagagaagggcagctgcctagaatgtaattaaaactggatagtcaggccaggaaataaacttcttttgggtgagcaaacaaaatggcgaacccaagcaacgtcgcaactaatggtaatgtcaccaaggtacgtgcaaagagccaaagggctacataagatggagtgatttacctagcttaaacttgcgtcattgttaactagcaggaggaattcattgttgtttactacagttggttgttttgtaataattggcttgcacaaattttgttcaaccttttgatttgcaggggagttgctgcctactgacactttgggtgattgtaagtttgtaaccatagcccatagtagatgatgatatctcctgccctggtgagttgtgaggtacattttcctccctttaaaaaactcaacacctgcagttcttgtctgccaagcgtgtcatgcatgagtaaattgctgacctcctagctgtactatggggttcaactgcattattaattttcctgttgcaacaatattgtttgctagctagcttttcctggttgaatagcacacatgtaccccaagtctgtttaactccagtgcctccgctagcactttagtgaagctaaacagtattaccgtgtctgctaacactgcttaacgctggcatcagcataggccgttgttccgttcagtattgtcaaataatggaacccggtaataacatgtatgtgttgtcaatcctttttggcctacagacctgatgccccctgcatggctgcatgcttccactcttcaactgcagtacaaattgttgcagaagattcaaataaagaaattggcaatatcgatacagtaagtttctgtcattccacaaggttggagtactccaaacttgataaattttgtgggaagtgaacaaagtttagtgggctacccaacaaataagttttatgtattcatttctaactttttttttgttgtaggaacaaccatcaccactatggtctttttaagtagtaaatattttttttagaccatctatgttttatgtcagtcgtgcattataagcacttggtagtggaaatggaatttcttgtaggtcttttaagtctttctactactttttttaaaataaaataaaatggcttctgcctttggctactttgccaagtcattgatagattacccaatgtgattcaaattaagggtgtgtttagttcacgccaaaattgaaagtttgattgaaattggaatgatgtaacggaaaagttggaagtttgtgtgtaggaaagttttgatatgatggaaaagttggaagtttgaaaaaaaaaagttgggatctaaacccggcctaaggttcaaactgaagtgaatggttttaatagttcggtattcagagagtgtaaaacaaacttttcccaattcctatcagctcctaattcaatttttaatgagctgcatggtttactttatctacaatagcaaagcaatagctaaggtacagaaatttccttccttttttactctccagatctttctatgtctagacttccttttgaatgcagtttcttcttccttttgcagcagagagcttgctggtggtggcaatgcgatgcaagctgccagggccagggcagggcaggggttgcagctctgtgaaagaggacgcgacgcacagcagtagtagtacgttacatacagccaggtgcatgactgataaagacgcatcgatggatcaatcggcagcatatgcatttgcataacacgcactgctcacccttaattttgacttcatttcttggagctacaagtacctttatatattgtccttcaattctcctggaaattattttcagttatactctacatttactggagtagcctcttttctctttgcagcatcatcccttttattactgcgcgcatcagttccatttgcgtctaatgctctgaggccgagctttaatttacactcaagtaagtatatactcctccaatctcaatgtactccagttttttccgactgttcaaattgtcaaatactaaatgtcatctcgctcacaaagttagtcgtagttagtgtagtcttttataatgctatattcgaaacagtttgcaccaaaattactttcctaattcttacatatgaactaaagcagaggggttgtactacaatgaatcaaaaaatggaggttgctcgtataattttgccgtatcccgttcccgtacccataatataaaggatatcctagaaggaattagcaatcatcgctctttcatgaatttagcaggattcttgtgtaatttagggggatagccattaattatatctaattaatcaattgattaaggaaagaagctagcctagctagcatacaacagtaccagaaagaaaacaatagatatgcacaagaggaggagacggtcgaccagaatgggcaccgcaatgcagcagcgtacaatagtatattaataggggaccctaatccaacacgggcccacatgtcggccggccactgtcattatcattaccaccaaccctgcccttccaattcaattcaattgcaaacaaacaaaacaaatatcatcaattgtaggcggcaaccactcatttccatccgtatcttttccacgcatcaaactggaccaccgtccacctatacctatctacttctgctccattggatagatgtaacaccaaggttttgttttgcctcctcaattataattacaaataattaatatttaactttaagaacatgagtactcccttctattcaaaataagttcttttttctcctcccattaatttatcacaaaatagttttatttttaaataatcattgcatgagagtttgtgaaagcagatgataaatacatttggagcagataaaataattgcattaaaatctgataaactagaaatattctagtctttttttattggtatgtgtggatggataaaaaataaagttattttagtacagatagagtacattcttaccggtggataggttatcacttaaaactacttcagcccgtcacataatcaaaaattagaatctccgaattgatattacataaccctagctccttaatttgcttgatatgcagtttcttgtgtatgtggaggagtttaagcatatatatttcttgatattttttttacaatatactcataataaattaagtgtataaggacgttaagccttccttgatctttagtgaaagaatttatttattatatgatgattaaatagaaacagagcaagtgtcgatataggatgcctagaagttaaagaaaaaagagaggaaaacatccattattcttgtctgtccgaacaactaacttattactactccgaccgactagctacttgatcttataaaagctgcaggcaaacacccaccacacctctaattaacaagcgctatggtggtctataaactatccattaatattcatcttctcagatgtagtattgcttcttcttctatttttaagctgcagcttataagggcatgtccaattatgaaattcagaaacataatttaggtttttttttaaatcgttttgtgtcacttaaccttaacatttgttccgttaaaaacagaagtacaaaagttttactaaaattattcttttttaacattaataacatgttttttttaataagccaaagccctgaaatgcccacgtttagagactaaacttatcatatactctttccgtggacccaaaatatgacaagctttatttcagcattcaaaaattgttatgaaacatatatacttgtccacccgctagcttcttgtcatcttgagcaatcagacctgcatgtgtcgtttaatttctctagctagctacttatgcttactcatccttactaattacaataatctattatctaattcccgtgaaaaaaaagctatacaaatgttatttatattttgggagggaggaagtattatgtcctaggttatctatacatgtatctagcggtgagacatggaagagagaaattaacataatgggggccggcggggtttgagatagacatgtcatttgtttgggatgtacgcactccatgcatcatatcgtacatgtcgggtttttgaatggagatcttttgaatgcgtagtgtcgtccgattgatcgatggagctacaatagctagctggatggatggatgcagtgtgggtgtctactactccatatatatgtcgttgttgcatggggtacgtaccatcagactagtcttttaggttgtgtagactcaggatctaaagttgtacttcgttgggcctgtggtggagtagacccaatgaaacctgagtggcccacagtgtgtgggctggcctgcgcactctaacaagtgctctgataccacttgttataagactggccccgaaatcacattggaaaccaaaccgcggaagaaaacactataggagatccaaacacgatgacgacaccgaggcaccatatttgataacggagttcagtcgtagcctacatctccagggtattgataaagggcactcctccccgatccagcatattagagttacaatgactcacggccggtcgccgctggcagccgctccctctcgctatgttatgtcgctatgcggttataacaggtacgctcctctatttatgagagagcctataatagaatccgactgttactttagtccaaacacctattacaactccaagttttaaactgtaaccgactacatacatatattcgatgcaaactctaacaatggatgcagtgtgggtatctactacttcatatatgtcgttgtcgggtaccagtactactgtagctagccggccagcaggcagcgtcgtccggccggccggtgtgagcccagcaccagaccattagaccaacatatatataaacagtacatcgatcgatcgatatgacagagattagcatagcttagccacatgcatcaatatatccctctccctctgtgtgtacatgtgtgtctctgctctcgctctctctcatgcatactgtatggaccatacatgcatatacgcaagcaagcaaggagagagagagagagagagagagagggggagcgtgcatgcatgtttaaatctggccgggtttgtatgctagctaagctagccattaatattttggcaatttgtgcgtgaccatcccggccccaacatatatattcatttatttatatatagtattatattcaatgcatgcattgcacttattgtcacatctcgatccatccatgataccgatcgatatgcatataggtgtagtactactgcctatctctctccttcctagctctatattacttcctcccagtgaccaatcaaagaaacatccaagttcaatatagtacttattaattatctactccatccgtttcataatgtaagttattctataatttctcatattcatattgatgttaatgaatctagacatatatatctatctagattcattaatatcaatataaatgtagaaaatgctagaatgacttacattgtgaaacgggggaagtaactattaaccgatatatctatttattttaatataaattagttagaattgaataatttacccgagatcctatgtccctaggaagattaagatagaaatgtcattgcaccctctatcataaaatacgcaactaccactatcctaaaaatcaataaaataataatattattatcttatcatttcttttatcccaataaacacaatgtatataagtatccaacaaaattaaagatcttcactctattaaagaaacgaatttagagaataaaaatgtgttagctaattgtatctacgtatgtatgtatgcgcgtattgtattataacattagtaagatgctgttccttgattaggatggagagagcagtactagctgatcgtcctgcctgattgagagagggaggagtcaatctggacaggattgaaaggttggaaccatatacacatagtacaattaacctctaattaagtatagctactactagtgcagtatcctttcattccaatataaatttaaccgagtataatgtgatatttaaaactatgaatctggatatatcgtcacatctgttttagattgtacttatatattggaacgaaagggagtagcaaattaaaaccctagccaccaatcgtcacatctgtttggagttgtgtttttaaccgtcgtggtagttcctatcttcaagtttttttattttgcctccccctctccttttttaggtataaaccagtctggctgattgctttgtgtaacaaaagctttttttctgctaatatattgacgtgcaatccttttgcgcgttcgaaaaaaaatcgagccatgcatatatgcacatgtaagcccaatttaaatcccgacatgcgcacagtaggatatatgtatacgcatgcatccatcaatgaatccaatcaacgaatcctatctatgctatgaagaacgtactactatatgaatcaattgaatcacgtattcatcgtgcgcaatacgtacgttgtgttagaagctagcgtcgttatctacatactgtacacagtacagtacgtatcaaagcaagtttgattaataaagtagtactagctacttccatgcatgcatatatatttgtgtaaagtaatcggtttttcaatccattaattaattgattgtcagcttaatttgctattctcattgagcgagagaaattaatccaaaatacatacagctgtgttggatttcgatccaacgcctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagacatcatcacatctctagtctcttcaattcatctcgatcgatgggtcgctccaatggtgctcgttggatcgtgcatatatatgcttccggtgaccattgccagcaattaacagatgcgatgatgatattcggcaggcaacagtacgtactacgtgcatttgagaggacaaggacgacggtagactagctaggacgattcaagattcaatattaactgtccatttatagttctactagtaattaagcatttttttagagcttcgtgtcaatcggaaagaactggcgttgatgagatgaaacgtattatgatcgtggaccatgtaatatcccatttaatctgcacgttataggaaatatttactgtatcccatttaatctgtacgtacaaagaatacaaaactcagtttttactggttccaaaatttaaaattatcgaaacataataaagggtacaattgcaaacttgaatgcaactcgataattagtaattacaatttcaaaattattaagtcgtgctattttattatttctaaatattactacacgatttgatgataggatactacagttcttcgcaagaggagcatcctatatactacaatagtcgtgtgcccattctttatactaactcagttccaaaatacttgatatttcaagtttttgtttgtaacgtttgaccattcgtcttattcaaaagattatggaattataattaattttgtttgtgacttgttttattactaaaaatattttaagtatgacttatcattttttatatttgcattaaatttttaaataaaacgaatggtcaaacgttacaagaaaaaaagctaagcgaaagcgatatctaatttgggacggagggatcaagtatgaagtagatagtactccctccgccccatacgagctcttagttaatacagtacacatcacttagagaaatatactcttattgttcagataacaagctctctaatatatatgagtaaccattaatgcaccaaaatattttttatatccttcttttcttttctccatctctaatgcaataaaatttcctttaataaatactaagaatcaactctgagttgttgttatgcggagcaaccatatttcattttccccttctctcttcgacgtcatcaaatttacatcatggcaacggatattaaacatcattgtatataccctaatataagggattattcccttttagtagattaatgatagcaagaaagactagaataccctattaaatgagatttggttgtgcttgagtgggtagattggtgttaaaatatatactgtaggtagtaaaaatttaaattaaagttgatggatgcgataagtagcacactaaaatatcttatattatgggataaatagaatgaaaaaataataaaatttcccctttttccatgtgcgtgaatggtggtagtgtactatatttctattgtaaaagagaaaaaaaaaagtagagacagaagagccaaaaatggagaaggccagcgttgatttgtgcttccttcaataattcattcactgtcacaggaggtgactccatcagggaagagagagaaggagaaaagaagagaaaaagggaaaaataaaataaaagaaagaaagaaaaggagaggacgaacggactgactcatcagagggagagaggagacgatggataggtgacggacggtccttccttgtcgtacctgtcctgacatgtccaacgctgggggcccctaccgtcctttcctttcgctgacgtcacccccctctctctccccaccctcgtactatacggtataccgtatacatacatcggcatattcaggactacctggagcagaattttgtgaatatatatagcagtagggaacaagaaataactgaaatggtactacaacatccgttctaaaatcgacatccatgtcaaggttattccatgacacacttgtatgtacacctactactagtttacaccttaattttaattttaacacgcctagaaatgttttaagatatgaaaagaaatacctcaaggagatcaagcaggccagcactcgcgtatactcttatatacatggtcatcatatgcatatattcgcatgcttcccgtgcttgtagaataagtgatttttttttaaaaaaaacattttatatatactatgttcctaaataagtatctaacgtatttttttaagatagagagagtatattttttggaatatcattttaaatccatattttgactttatagtagtagtagtgtataacatcacaatccatttagatatatatccagctatttgaaaaaaaaaaacccacataattgggctggagaatacacgcaccagcatgcatctctagccacctcgctgactgacctggctgacctgacctgcagtttccagttccatgcatgaactcaaaaatggggggaaaaacgctgtgctgacctctccctgaacatgtggcacgcacaaatcccttaatcaaattcatcgagatgtgggacgaaacgaaatagtggtagtaatacgtgtgcagggcaacattattatgatatgtttagattgatacggagtgcagaattaattagtcactttatttatataacagacccctgtggtgtgtgattagagacagacagcatcagcatggcccatcacctgacacttattttatagtacctctacacatgctcgcatgcacgtaattgtatattgttcgcaagattttagttactccgatcactcacaagttcccaaaaaggaatcgccccactaaaatatactgcaccacagctgactggtggattaaactatagtgctagctacacgtagcacgtattttgcttaattaattgtgtacaaatatttatgcattattcgtaattttgtttcctacaaaatgtaaacaccgcacactccctccgttactttattgttggcactattgaccagtgagtatcatttaaaccttaactgctaataatttttaatagtcagcgtatgatgcatactagtaaatgttactcgatccaataatataagtatatatcgtttcaagtctttacgatgttttttttaataaaatgaaggatcaaattaagttaaatataaataatgcgatggcgcagccaaatgtcatcttgttttcttcgcaaccgatgctggtgttgtcggcggcggtgcagcttggcattgctgtcgatcacctcctcccttggccagcatagcaagcctcctctccttgttcgtcagttgagttgatgccaccagcttatccctctcaatgcaaaccatcacgtgacgtgcatcatgcggccggccggctcgccggatctagctcgagtagtcctagcttgttgatgatgacacagcgagttaaatttgtatctggccggccacacaaactccctctcgtccgtaacaattaatgtagattaggcaacaatatatatatggtgagctcgacagcgataagagggcaagcctgagtacgatcgatgttggggtaagctcgatcggcaatggtgtcgggaggacgagcgcgtgcacagtggccgccggcaggagggagaggacggcaagtgctattgtatttggtgataaccacatgtagagctgagacacccgtgccttctgcaatacaagggtggctctgtgggatgggcaccaacggtggagctaagtggtgagccgagaccactactagctaggtaggagacgagcattgtggatgtggattgccatggtaggagtgaagtatactgtaggaagatactcgcctcctggatctggagtatgctggtgggtgccaggaaaaaccaaccgtacccatggaacaaccgcctagcagctggctggcgatactgtgagctcactctctgcatattcattcagagtgatgtgtctgacttactgacagcctttctacgaagtaccagactctccactccacacacgtgcctaaaatggcttcttcttcttccataatcttgacacggccaacggaagaaataactaactaacttccataatctcatggcgataaactttgcttatactcctgtccttgtccattgataccccgtctgaatcttcttctcttacaaacttgcacggatttccacccctcttctgtgcattgttactactactttaaagttggattttttttttgtctatgaaaatttactttgaattttatagctataccgaattgactcgctgaattgttcgagggtatctgttaaatgcagttgaaacatcaatgatatgttgttaatgaaactcagctgatagtgtcaattattattatgataatgaacaaagcagggagtgtgataattccaccatgaggagcgcacacacaggtagacagtcaaagacgacgactagctagtactccttccgttccaaaagttccaaaagataaaagcttttttttatccttacacgatttatgagatgttattttgatcaataatatctataaaaataagatacattaaataaaaatagctgtatattataatagtttatttaataataaatctagtaatatcaattttgcaagattgatttttttatactaatagttaaagttaaaaatatttgacttatcaccgtactaaaaatgcttatattttacgccgagggagtacctgttttgttttaattaaaaaagagaagaaaatgattaaaacatgcatctaccgacacatcgtctgacatttgactattggacggcctcctgatcacattcacatctagcattgcagggacaaattataaaccacaataatcctcctccttgaacagtgagagatgatgagtaggagctgattaataagctaatctgttgtagatgatcatatcatatataagcgaaaaagcagtactcactaattaacatgtaaggattaaggaataatggatatagctaagagagaccaacagaagcaacaaaagaagaaaaatgctgtgacttgtgagcccagccaagctatcactatctctctctctctctctttgtgcagatgagaatgagaggagacgatgagacgagagagagagagctattaagcagcagaagaagcttaattgcatggctaatgatgagaaggaaggagagagagcaataagcactaaactagttaattaatggccgtcatggctctcatccacttggtcgtcatgatcatcggtcgctctcccaacgccaacgccaacgtcttcctcgtcgccgtcgccgtcgccatcatggtgcgcctcgtcgccgtcgtccttcgtcctcccttcctcgttctgctccccgtcgaacgggaaacccggcggcgcgcaccgcacgtctgggtacttcaccaccgcgtccagcagctccgagctgcccttcgcctcctccccgccattgccgcccgccgaggacgacccaccaccgccgccggagccggagcgggagtagaggcggtcgagctcgtcgaagtaggggcacgtcttggcgtgcgccggccgcttcttgccgctctccttggccttgcggaagtacttgttgatgttctcccacttctccttgcaccgcttcgcgttccgccggtagcccgccgccgccatgcgcgcgctcacctcctcccacagggggcccttcagccctggctcctggaacctatcctccagccccgtccgcacccggatcagcgcctccacctcgtgcttcggccaccgcgacgagctcagctgcagcgacccctcgccgtcgtacgccaccacctccttccccacgccgtcctgctcgtcggcgcccggagcggggttggcggcggggggtgggagcgtgatggtctcgccggagatcttttccaggtaggcgatgatggcggactcgcgtgcagcggcgctggcgcggtcctgcgcgcgcgcggcggcctcgcgcgcgaacttgtcggcctcctggcggcgccacgcctcgtcgcgggcggcgcgctcccgctcccggcgctccatggtgtcgaggaactgacggtggaggctctcctggtgctccatgaggcgctgcaccaggcgctcgaagaaggaggccgacgcgctgagctgctcctggcgccgccgcttgcgcttgcggcgcgccgcgtccgcccccgacggctgctgcgtctgcggctgcggctgcaccacggcgtgcgcgtcctccccggcagacgtctcggacgtgttgaggtgcggcgggttggcggcggcggcgtcggggaggtcagccatgggcggcgcgagcatggcattgtcgtccccggtgaggccggagccggagcccgtctgggggcctccgctgccgggcttgtagatggcctccagctcgctgaagagcttgtagttgacggcgccagcggaggcggcggatgcggcggcggcattgtcgtcgggcttattcttgaagtaatacgctgggggcggcggcgcaggggagtcgggagtggcgggtttgtccttgggcggcgccctcttgctgctgctgctgctgtgtatgtagtcgatgtcgagtggccgcctgcacagcaaatccaacaaaacaaaatcaatgtcagcaacagctcgctccacagctaattaatctgcacaatttggctgcagctctgttgctaattgatttgcaagaagaatatggcgtgcgggcggggcggggcggcgaggaagaagaagaagaaatgatgagtgcatgcaatggcgaattgaggggggcggttgggttggcttggcgctttttggtgagtgaggtaatcatcaagtcgaaaaagggggagacgaaaaggtgatagctttgcgttgttgtggatgtggctgtgaattctgttgatggagaagaagaagatgagatgagaggaggaatcgcgacgcatccatcatcatcatctgtgtgctgtgcataaatcagagagggaggaggaccctgcgcttgcgagcgatggctccctttctcaatcatgacactattattggccgtcctctgctcccctctcccgagcaaagagagcatcctaagcaaaaaaagctctcctccttttcctctctgttcttctcttctccaccatggatggatgcatgaatccactccaagcacgcactcactcactccaatttcaactcaattttaggctgagtaaggataacttgtacgtaccaggtcggttctttgatggaagtttcctcgtcccccggccaccgccggagcctgctctccgtggccgcctcgtcatccccgccaccacctcctcctcctcctccatgaagcatcatgccgctgcccgcgccgcccccgtcgttcagcgcgtcgtccgttccgccggtggcgccgctgccgccgccgccgtcgacccccagcttgaagctcatggcggcggccaggaacggagggacgcccggaggggcggcggcgccggaggcagcgctcccggcgccggcaccggagctctccggaacggccgcctcgacgtcgaggccgagatggtggtgcgggtggtggtggtggtggtgctgcggggcccacctagccgggggcggtggctgctgctggtgcttctggtggtggtgctgctcgtggaagagctggaggtgggggtggtggccggcggcggccgcctggtggagcagctgctgcgtgaagggaatcccaccggcgccgccgaagtgcgccaagtggggaggcatctgaggcggcgggtggtggtggtggtggtgctgaggcagggcgtggtggtgcagcggctggtacctgaacggcgcgcccagctcctggccaccggccgccgccgccgcggcagcagcagcggcagcggccgcctgggcgggctgcggcggcgcggacatggcgaaggcgccggggtccatgatgtactgctggaactcagagacgccgccgtagccggactgcatggcgcctgcctgcagcttgctactccactatcttcacctagcttgctaccgagtagagagtgtcactcaccttcacttcacctagttcgctgcatcaagtggtttacatgccggtcgggtaattaagaaggtttgacctgagctaaggaagaaaatgcagccagccaaaaatctcactcacccctcacaacggtctgagctggagctggagctggaggtggaagaagaggatgaggcagggcagtgcagagtgcaggggtgaagagaggaggaaggaagaagggagagggtagcacaggcacagggaaggtagtcaggtttggtttccattttgcatctctggtggggtgctcggctttatctcctgcctcttttcgaaaggggaccctgctaatatccatatttgtatctccacccatccaggccagcccagggtgctcattattattctccttcaggtccttgtcccggtttgaatggactgttgctctttcaggaaacccctcctcgctttttctttaacaatcctgtccgggttttggggcgactcctttttttttttttctctctctctttcaattcctatgttcctatctattactatcgtcttctctcttttattttttacgctgctccagttattagtatttctttatttgtttgtaccaagggctcattcgaatcacacgatagaaaaaacataggccgagtttagttccaaaatttttcttcaaacttctaacttttccatcacattaaattttttctacacacacaaactttcaactttttcatcatatcgttgcaatttcaaccaaactttctattttagcgtgaactaaacacccccatactttagggaagatataggaataaaaaatgaattcaaatgtaaaattgaggatcgaaaaacagagaattatatataatgggagaacttgaaatagaggataagaatagaggaagatttataaggaaatgagaagtaatctaactctacttttccccggactcttctttttctagctgacgagcaacacacctttgtcccgttgccattgccaccgaatgcggcccaacacgccacaactacgtggcccaactccacgctgtcgattgtgctgtccggcttcttccgccgcctagcttcctctaggaccccttcatgctcttcccctcctctctgacttttgcgtctgcccaactttgagagtgagcccgtcggccgctatgtcgttgactctctcatgcatcattcactctacgtcgaaaaccgacctaaaaaaacaataatagtactacgaaaatgcagttgtaagtatataacaactttacaatatatacactatgggtatgttcggtagctgtttctgtggcagcgctacggctgcgatgcatactgtgtgtggttgtggctatattgcttgttgctacagtcctgccagccgaatagaccctctagtaattcttgtgtttgttcaaactgaatgttagtgtcagtgtgtcactaccattccaaatcgagatgatgatttccacacaaaaaataaaaacagcagcgtcctatgaacactgcaatatttaaataatgcatgaacaaggggagtaaagtgaaaaagacctgtccataaaaaggaaaaagggaaataaaagtagagaagaaaaaaaaaggggggtttagtacaggctacagaggggaagcaggtgacgtcagcgccactggcaccacacacgtgccatgcacgtgtgaagacaaaggacgatttggtaatgtattggtgcatgagtatgatgagatgcctagggcactgcagttttattactagtactaatcgctctgcttcttagaaattgatgatccctgtctgccaaacccagattttccatctctaatgatcttcttgaatcatctgcttgcttgtctgcatgcacgcacctcttcatcatcgtataattggtttttggctcaacgattcaacgaattacgcataacagtttggagaggaggacactgtcactgaggatgcagcggacacatgagattagaggagatcaaccaaatggtgacggactcattagattggtggtaggcctcatgcatgacgactcgatgaatcgatcgatcattatcgttgtgggatacacagtacggagtagataaagacgggcgtcaagtggtgattgggctacacagttgactaccggtccgtacgtagtacacggtggcatctgcctccactattacgtggcatgacatgctactttacgtgggtcaaatcgacatgacatctggccgccacgcacagctcgaccttctcctataccatgcgagaaccaacatcttttttttttttttacaaatgttattacttaataatgatatttataacatgatggcattacgaatgacctcatgctttcacgtcggagctaagcggctttattaaacgggagagtggcatcacatacaggatacatacgtcttgccgaagatatgggggtccatgcatgcttaatagaaagtgcctgtggcacaaaattaaagccaccacacaggatttatatctcatcgcctatctttcttatacattcgttctctttcattgtcctctatttaattaatgacgatactgatgaggatgacaatcaacgctcttccttcgctcgtccgaccaccattgcccctatctccccgtagctcgggcttcgggcactaccattttctttccctatggatttgacttacataagcccattctcattatacccaaaatgttcccacttaccatcggtatcatcctccatacctccaaccatcacaatcgtcaccaccacccatttacggatcttagacaacctcaatggttggtttgctctgggcgatagactaagtgaaaaatctaactagtgcgatggcaaaggggataaagtggattggtgaaacgacggttttaataatagagaactagtgacatagcggcctagtcaatagcgtctataacgaaagatcgacgacttatcaatttgcacattcgttgccttctccccaattccagaaccatccatttctccttgaccattgcttttactctcaagccacccatcttctttgcaaggaacattgatacattttaagatactccgctcgttgttaacgcgaaacgtgagatacacatcagagtagaacgttgtaaatgcccttagtttgtgtttgatttggagctgaggtgggatgggttggactcatccttgtttttaggacgggatcgtcacatctatccgtttggcgtgagggatggattggtcctatttttcaggggataactcacatatcagtgaaacataacagttcaacccagattttaggataatattctctttcagggatcatctcctacatatccttaaagcaaaccatcctggaaaatgggttcaactcaacccatcccttgaaccaaacgcatgactagagactgctaggaattaaagttaaaattccaatttgcaccatttctcaaaacatattgctgcatttgtatctccacgttctagctagctagaagatcgattatgatcagctccaacaaaaccgttcgaatagaggaagaagacggatgagaagcctgcacggcgctatctatgctctacacacactacagtagagtgaaagctagctagagtccaacgaaaaggaaaaagaaaaaaaactaaaggctatatagataggagtagctgctatatatgcatgcgcaagagacgctagctgccacaacgagctgatgatcgatcgagctcttggcctccgtgcctcacaaagtaagctacgcctacctacgggctacgtatacgtacgtacctgtagaaatcaagaaaggaggactcatcagtcaacctctaccaagctaattaaattcagctcaaaattaaaggtccaacatccaagaaaataagtttagcgtggcttagctccattccgctgcttggagtctgttttagccgccgtagtttctctaagcttaagttttttcttattttgctttttcttccctcccctagcataaaccagtctggctgattgcgtggtgtaactaaaactctttttttcctaatatattgatcgtgcaattcttctgcgcgttcgcgaaaaaaaaaacatccaagaaaatagatccttcggcaaagtgccaccatggctgtgtttagttggtgtgctaaatttttctaagtatacagacacacatttgaagtattgaacgtagactaataacaaaacaaattacggattccgcatgtaaactgcgagatgaatctactatgcctaattaatccatcattagcaaatgtttattgtagcaccacattgtcaaatcatggcgtaattagtctcaaaagattcatctcgcaatttacatgtaaactgtgcaattggtttttttcgtccacatttaatgctccatgcatatgtccaaatatttgatatgatggaaaagttgaaagtttgaagaaaaaagtttgaatcttgcatgtatcaatcttcgtcaagaaaaaaaaatcgctcgactaaatatcattgcattggtttcttatgtactatcacttaaataaatatagcatttttctttataaaagtggtaagataaattagtatgagatagatctctctacgaacatgcaaattcaactcacttcatttcgtattataaatcgttttgattttttttaatcataacttattaccaacatatatacaacaccaaattaatatcgttgagatgtaatattgaatatgtttgtttttattaaaaaaattctatattttcctacacatctactagccccacctaaagaaaatatggcacatgcacacacataggattgttcatttggggactaattagggaaagaagcaacaatggaaagcagggtcgatgttaattaactattgatatcctatgtgtaggtactgatttgaggtatagacctgacctaccaatcgagagttggagacagtattgtcatccatggtcaatgtgtgtagccggcctgcttgctgctcgatcgatcgatcgatctctgtccatatttatcgtgcttatgcatgacagcatacttcatatatatactagctattgcagcgctcgagcagagaatttgtcctgaacgtgtacagtatacaatgatctgtcatatttaccagctgcatgctagctgccgcaagcatataggagcacaccggatgtgcgtgtgtgtgcacgcagatcaggcggccccctagctagctgtacgtgcagcctccatagacagatctagaggggagagaagggaggccggggaagaagatcgagaggaagacgacgaggctccctccaagctaaagctaaatccacctctgtttgtagcattcatattttaaatttttagatctaaattcatatgtgttcttaccctaaaaaaatcatttgtgcttgcctcaagattacaagatcgatatgtattgatccgtggaagaagatctgtcaggcggagcaagctctctctcgttgctgaggtagcagtcaagagtactgttggttgggagtttgacggtgggccttcttcgtggatgttggctgggcatattggatttccctccttttgagaggagcttcatcggtacgatgaagacggtggctagacaaaatgaaaatacttaggatgctaatgtagaatcgaaacacaagaactaagctaatcagaagggggtgaatggttggtatacctaaaaaccgaaaacttttagcgaaaataaaagttaccctccaattcgacggatcacggtctgaccgaagtggatgcgctggtctgaccgcctgatgaacgtcggtctgaccaatgtagatcgatcggtcgaaccgccgaaatcgcttgccgccgcttgtctgtgccgccggtctaactgcccttgcgccgtcggtctgaccgccgcttgttgccggtctgaccgccagtgggatgccggtttgaccgccgaaacccggtgaaacacaaatcgaagaactctcaaattagataacaactttattacttctctctgtgtttacaaagtgcaccaacaatactccttacaaaaatctcgactaaactcgaaaccctaactaaactagcaactcaattgctctcaaaagcgataccgggaagcctcacgctccccctctatttacacatgaggtaggcagcctaaagccacgaaccaaactcatactaagagtcctaaacaccttaggaaaccctctagtacaagacacaaactttacataaccaatcataccaaatttggactccttccaaattcgactccgcatcccatacgcacacaatacctccatcgtatgccatatgaaatcttcaccaaccacgtgcatcaactctagccatgaaacaaacaaagaaaccatattccgaaaccaagctatccccaacttgactcattagtagcaaacaacagtattacatacgtatagtatccatctagaagccatataaccatgaaacaattacggatatccaaagaaacaacccgaaaccgaaaccgacacagcgtcggccggtcagaccgcgggccggccggtctgaccgctcgatcaccaccggtctgaccggcatacacagcccggtcgaaccggtcacataaaataacagtaaatccaatcatctctgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgaggcgccccgacccctcgtgggtttttgctccgcgtgtatgggttaggtgagcacagtggggctcacctaacctcatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcaaacagccacgattccacgtcgcacctgctcccggtgaaagtggaggtagttgtgggccgtctcatcagaaggtgactcggacgacaactatacaaatctccgtccatttatgaaaagggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccctggccgaaccggcaaaggggggcctgcgcggtctctcggtgaggagccccacgctccgtcatcaggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacggagggcgcctcctcgtctggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtaacgacagggtcatggcgaatttctttcccatggccctgaaaggacaagcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgatgacgagggtcatgtcctcgccgtcgagggcgcttcgcgggccacccgaaaggggaggcctgcaggaggcaaaaagaacgaggccggcgctcccaacagggagcacccaaccggcaagtggtgcaccgtccacaacacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttagatcacatcgacctaccggtcaccttcggtggatccgccaacttccgcacggagcgggtgaacttcgatgtggcggacctcagtctgccctacaacgcggtcctggggaggcccgcgttggtgaagttcatggcggtggtccactacgcctacctacagatgaagatgccgggccccggtggccccatctctgtccatggcgacctcaaagtcgcgctcgcttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggtgtgcgaccttttgtgttttctagatgcatactctggttaccattagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattaaggccaaccctgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacagttctcatttcacgcttccccaccctgtgccgacttggcccgggagagagcagggaggagaggctcccgagccgaacggtgacccaaggcccccgacgaccggagttggccctctgcccacttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttctaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgtcgcctcctggtgttaggtgactcccagctggtcgttaaccaagtctgtaaggagtaccggtgctctgacccgcagatggacgcctacgtgcgccaagtacggcgtatggagcaccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctgaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgtggcgctaccatcagcgccatgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggtgtcaagtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgcctcgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactatcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattacggcgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtacgccaccagcgttgcttcccggatggtgacggcggcctcgcggtccgccagatccctctccacgacgtaggcgcgctcttccagcgccatggcgcgcgcctcaagggcctcttctcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctctgccagcaccttcttacgagtttcaagctccgagacgtgccggcggtgagccttatggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttctagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatacgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggcacctcgcttctcgctcccactatttcgccccctcgtttctcgcgcccacgcttccactaatcccattcgcccgcttgcggcgcatgaggtgggtatgcggttgtggcagtcgagatagatcatatcgtgcgcgcgttaattacgctcgccgaccgaagcgacgttaccatatcttcagacgaaacgaatcgccatgtccagatttgtgtgctactcaagtaatgtggcagtcttgaagagaccgctcattgttgacagccgagttaccattgccgatgtgcgtggtttgtgaccgttgagtttctgcccaattgtggagaccggtcccacctgtcaccaggtcttaggagtggcgtcatgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgaggcgccccgacccctcgtgggtttttgctccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcaaacagccacgattccacgtcgcacctgctcccggcgaaagtggaggtagttgtgggccgtctcatcagaaggtgactcggacggcaactatacaaatctccgtccatttatgaaaagggggggggggggtaagtccccacaaaaaagagagaaatggtgcatgtggtatccccttaagatataaaaggaggaccttgcccacagagaggggggactggacttttccagattagaaacccagaacaagggagaggctggctgatactttgtagctccttcatacacagatctcccaaaacacaggagtagggtattacgcttctcagcggcctgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcaatctccaaaactacttcgtgaataaattccaaatatcaaaaccaataatcacatataccaattgttcatcatagaataagaatcaaaacacacattgatcttacagctaagtccaagctatccttggcctccagtttctttaatggataacaatgtcatcttttggcatcgcatccttcacggaggcatcgtttttttgagtcttctctatgtggtgttgttgtagtaggctcgacgatgattggctggtttagtgcttgtgtgtgtatggttggcgtgtggttttgagatgtgcactctgatgcacatcctttctttgcactggtggagaaaccatctttggtcggtcgaccaaattccacaatagtcccgattgcaataaaaaccaagactaaagattatctttagtcccggttgaaaaggttagagctactttttgatctttagtcccggttggttgactaaagatcatttttagtgccggttcaaaaaaggataggtgatatcagacccctctaatatctttagtcccggttggtaacaccaaccgggaaaaaagatcggcatgcacggagagatcgaggcgtacgcgtgactcggatcgagataaatatctcctcctctcctcacactctatctattcttctcctctcctccgatccccttctcctcgccatcttacgcgccgaggatcctctccttctctcctctcccccactcatcctctcctcctcccctcccctcccctccggcgggtggcgacggaagcagcagcgagatgaaggccgaccggtggcggcccggcgtgaggtggcgggatgagaggctggccggcaccggccgggcgcggggcggtggaatggagtccggccggtggcggcgggatgggaggccggccgggcaaggggcagtaggatggaggccggcctcgcactcccctcccgggcccagatctgtggatgattttttcttttcttttttgatgatttgtggatgttgatttctgaatgttgatttgtgaatgtgtttgcgaatgtttatgtgaatggttttgtgaatgtatatgttgtgaatgaatctgtgtgaatgtatttgtgatgttgtgaatgaatatgtttactgtgaatgaatcgatatgaatgaaggaaaaaactgaaaaaaaaataaaagagaaagaaccgaaggaggaaaaaaagtctttagtcccggttggtaagatcaaccgggactaaagatgcctgcgtcagtcacgtggctcaaccatctttagtcccggttggtaacaccaactaggactaaagatagatttttagtcccagttatttcacccgggactaaagatgggtatttttagtcccgtattcgtagtcccggttgtataaccgagactatatgggggttcccaaccgggagtaaagcccctttctccaccagtgttgacatcggacttttgatgaaaaacttttttataaacattttatcttatatcttaacaacattcggattacctctctcagtcatcgtggaaaaaaaaactgtccaagaagagcaatgcatatacagacttacagtacgtgtatgtagctggctagcgagtgcatactagctagtgatatcatctcagcgtattctgtttctctgtcctatgatcgatggattaattagctcattatatattgtgcaaactgcaagtaataactggtgggaaaatgttgattcagctgcaagtcatgcaggtatataacacatggatgaattaattaatgaatattaatgtaacgctattatagttgctagatggatatatatcactgtactagatataaatacatggatagaacacgatggggcatgtactgctgcttgcgttcaatctagctagatagatctgtgtttgtttctttagtagtactatatattttctggcctgcgcagcctcgacgatatatcatgcatctatatatgcatgggtaattaatgcctctagaaattaatcaaagcacattgtcgtgcatataagtatatatatatatatcgcatgcattctgtgtgcgtgtagtacgtaagtatactgtagttggtaaccactgccttaattttgctagcttgtctcgacaatttaattaaatgcctgatgaccaatgcaggtcgatcagtcatctctatatatagagtattatatacatgcatgtacgcagcaagtacacctgatgatgcaaattgagccgaccaaatttgcatgcatgcatatatatacatgtatggacttgatgcataattgattcaatataagtattagctacgacaattagcaagtcagtttttatgcatatatatgagtatagttttctcgaacagctagcgtatagtgtgcaaataccatgtatgatgtatgtaatgtgtacaaatgcaccgtatgcagataaatgtgtacgtacacatttatatcaataatgtatatacgtgttgtatatgtatctggaaaaaaagagagggggaaatggatggaaaggaaaagaaaaggaaggagtggggggcagatggagaggacgacggcatgcacaagtgacaaaaattgctacagtgaggaggatcgatactattgtgggtggggcccagtgggcttgaaggtgagtttggcccaccccaggcccaccgacagccctgacccgttactgtcaatcccccacccgggcccactgtacgtcaccccatccctcctctgcactgcattgctagcctaattcactgttcattgtcattttgtttgctcattcctatacccccgatctcgatccattttcgatcgatgtcgatggtcatatacaaatttcgcctcgactccatttcaattattaataattactccatacgttttcaaaacaaaatggcgtagctagttcgtttcaaaacagtaattcgttcacatatgcctgtgccctcctatgtactatcacacaaaccatgcaagttaacttgcgttcaatacaatcatacgttgccccgccggcaacctggcctttttcctttggagctacgctgtcggatggattattagtttatcctaaagccgcattagtatagctatatattgaattgaagtctacccatgttgaccttgcttatttttcaattatcatttcatataacagagttaattatacaaaaaagtgttatatatggagataggttgatcctgtccttcgagactaatctacgcgacactatgggctatacagccgtctacgtataactgtatatggagcccgtctcaaattatcacactagtacattttagccatgtgatggtttcttaggcagtactcccatccccccgtctcgaaacatatattagtagaatgtgttctatttatctctattcagatttcgttcttatattataagatgatgaagggaatacgttgtttgctttaccatagtaacttgctttctgcactttcatggacgcgtctcgtgtccacatatagtttacctaatttaactttaagcgttatatttgtgaccatcaattttattattgcacttttgtaaaatatataccagcttagacaattaaaaattgatacatgatgcatacgtaacacacgtacacgacttaattataaaatggttttcactggtcttcggttgctgacggcgccgcaaattgccagctaacttaaacccatttttacctctaatgaataccgattttgtagtagtgatgtgtgtcaggatcgatacacatatatacatggatgaaagtagtagatatattaatatacccgtgatccgatatttcaggatcgatcgagcgaggaagggatcggaagaagctatggggaggaggacgctcacgcatggacctgctggaccgtccggagtccggacaataataaaatcaagtgtaggagtacatgctgctccaccccgaccattgtcctcctgcattggacagtagcaatacattgccacattgcactgctgtcccctcctcccctctatctctatgctcttgctagctgtcccagctacttctcccgttttaaaatatagatatatttaaagttttagccaactgatatggaaaaataaacactcgagataacaaagtagatgaaaagttaagagatgattgttatcgaatgtaataagaaattaaacgaagagagatttattattgtatgaatactaagaatgtttttattttaaaataggagtatgtcgcgtgcaataggcaatgttggctagctacctattgcagcttagggttactttgaatcgtacgaataggaaaaggaaggaatataaaaacacatgatttttaatagtaatgtaagtggaaaatataggaaaaacataggaatttgattggaccgcgggaaaaattgtaggaatcggatgagatagatagatcgactcaaaggaaagattctcaaaaggttgaaactattgctaaatttttttcaaaatctttatagtattgtccattccatataaaatttatataaaatttttctatatgattaaaattctctaaaatttttatgtgtttcctttaaatcaaagtacgccaaatgtctccaaacaaaaaccatagctggcccctacgcacgcatggacgcacgtacattggcagatttggatcactagctagctagtgtttttcttttctttttcgtttacactagttttgattaattccctgctacatactcgtatatgtacgccgttaattaattaattaattgccattcgtcccgacatgtacaggttaataaatccatttgcacagtattttatctactgttttttaaatcttcatcgcatagtgtatagtactagctactctacatgtgttcgaaaagtttcagtgcacacagtacctatcgaaattacgttactgtggtagttacgtcacctatcgaatatatgtacttcgtgccatttactacctctaccttcattttctaatatataattttgttaaccttttgacatatatttaacattttattttttttccacggacatgaacaaatatataagtattcattagtaaagtcgtatcaaaataagtaacaattacatatttttaataaggttaatgatcaaaaataccttaaaaatcaacatcatatttttttaataatgagaagaatttcgttagaaatgaaattacacctaacttctacatcgaccagagaaactcacaacctaggacaaaagaaaccaaagccaaacataaacatattatgttatcttataccggtagaatcctaagcatctagtaaaaaaacaacacctctaagaaggtcctaacatttgtgtgccattgccatcggaacaagacgatattttcatccaaagcccgagatgacaccttcaataaaaaaataacaaacaagcattgacattgaatatagataaactagataagagttttcatcccggagtcattgtcactactttgtgccaccgtctggatgaaatgagcatgatctacgatgtgcagccaatatggacaaagtgcaagcctcctctacccaccaccaccgagctaatggaagaagtcaagtcatcgtcaagccgaaatcttggaaaaaggaaaaactacggacgaatatatcacagtgtcttgcctgatatattatgagaatggaactcgttggctcaactagatgggagggtgccacaacgcacttcaaatctcccttgtttgatctcgcttggattgcaaaccatacctggtgtcgatctggcacgtcgtggtgttgggcagagaagaaaatcccatcacaactaccgccggcggttgcagtggcgaagacggtgcataggtccaatggtgtcgtagaagcagaagctcactgtcgaggccatccccgacacaccccatcgtcacaaccgcgtcgaagttgccccgtgcccatgcagccatggtagctagcccggcaacgacgagataccacccggacgccatggccccctggatggatggggtggcggcgctggtgaaggttgatgtttgtcgccctcaggtatcatgtggagcggattactagtttatttgtgatatagtataaaccgtataacaaagttttaaatggtgcaagatgttttaaagaaaaatgatgctgccccatgcgtccatcgaggttagttagtacaattaggcattctttaaaaaaagtacaattaggcgaatgatgtctgctattatgtgtgtacgctattactccctttgtccctaaatatttgacgccattgacttttttaaacatattagaccgttcgtcttattcaaaaaatttaagtaattattaattcttttcctatcatttgatttattgttaaatatacttttatatatacatatagttttacatatttcacaaaagtttttgaataagacgaatggtcaaacatatttaaaaaaagttaacggcgtgaaatatttagggacggagggagtattatatcagtgagcagcgaaggcatcatacaagacactgcttgagcgtttcatgtacacacaaaatgcattgttaattttatttgtctgtacgtactttgtttgtagctacaaagtatcttgcataatgttcggattaatgtggtctgaatttaattgtgaattttgaacaggggaaggaagtgccgtcccgtgtgttaaattactagatgaatccgaccacgaccatttcatagatttaatttgatttgagctatatagcactgctgcaacggtttgcacggatgtgtcccactgacgcaattaaacacacaccttgctgttagcagtagatcgattcgaccatgcatagctccaaaaccaattttgtgttgaataatataaggtcagatgaaattaatatagttagctggaaactgatcaatccaatatttcgtgtcatcccggccgtcggcggcgagtccgtgtgaaggccaccgccaccagctagcagcctctgctctgccgccgacgaccaccaacgttgtttatttcagtacgacggaattaaccaacattcatgcatgcatggtttatttaaaccgattttctggaggagattaccgcccggacgtccgatgtaactcaaaatatcgaactctacccactggtggagaaaccctttgtagtcccggttcgtaacccccctttagtcccggtttccaaaccgggagtaccaatccgggactaaagatcgctatctttagtcccggatgaaataaccgggagtaaagatcaatctttagtcccggttggtgttaccaaccgggactaaagatagagctgaccttttttttttttgcatgcccctgttgctgcatggtttatatatatatatatataccatgcatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatatgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatcaagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattccccttaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgtgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaaactctcatgatctccgcgtgcccttgttcttcgccagtacaccgtactgataggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatataaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctagcagtcgcaccagttccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatatatatatatatatatatatatatacatgtatatatatatatatatatatacatgtatatatatatatatatacatgtatatatatatatacatgtgtatatatatatatatatatattgcattttacgttaacgttcgtcctcgttcgttcgctcgttcacgttccctagctcgttcacgttcgttcgatcgttctcgttctcgttcacgttgtcgtggcaacgtacgttgacgtgttcgttctcgctctcgttcgttcgatcgttctcgttctcgttcgttaacggcggtgtggcggcatcggggcggcggttggcgcggcggcgtggcgacggcggcggcggcgtggcgttgtggggccgtggcggcggcggcgtggcgtggcggcggtggcgtggcgtggcgtggcggcggcggcgtggcgtggcagcggtggcattgcgcgcgcggcggcgaaggcggcggcggcgtggcgacggcggcggcggcgtggcgttggcatgcggcggcggcattgcgcggcgtcgaaggcggcggcgtcaaaggcgacggagagagatcgagatcggagagatcgagatgcatgaagggagatgcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattatacaaagattgatgacaattacttcgaaaaattatttttgtctgtaataaattaagtggataaatcgtaataagcaaatatatgacttataattaataaaaattccaatatatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgagagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgtttttccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctatttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgtgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaataagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagtcccggttggtattaccaaccgggactaaagttaagatctttagtcccggttggtgctaccaaccgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgacccgagtactatattagcaagctgatcacataactgctacatgcatgatgatactacatacatgcactgattaacacatactagtaacctttgagataatttatttttatttatttgattgtcattttgattatatggttgtattcgttataattaaatctttacaacaagatctcagaaggttatattttgattgaaaaattatatatgttttaatcgttaagatttaatgtttcacgtgttagaaataaatgttccatctagaatttgattatgttgcacattttaagttttttatctgatagatgttgttttactgttgcacacgggatcaataaatatattatgatgtttcattacttatttgtggatgttgcacatcgtattatttgaatgtttcatcaagtatattgtgtgcaacagttacaaaaaattagtgaaacataagaaaatatctattaaaacatctaaataatactgtgatcgacattttgttgcaacggtaaacttaaaatttgtaatacaaagtgaaattccatttgaaacgtttatttctcacacatgaaaatctaattgcacatgctgaaaaacacacacacacacacattatttttttcatcggatcatgtgagatcttattacggtgatcttcctataacatagaaaaacaccacatgcaatattacaaataagtatctgaaacatcaaccaatatttattgaaacattccaataacaccgtgtgcaacactaaaaaggtcatcagaatacaatgatgtgggatattgttccgaagatttgattataatgaatccaactacataatttattcatagtttggataaataggtggaggaaagaaacatttgaattctccaccattatgaacagttttactaaatctgagtgcatgcacggatgcacctacaccaattgatgtgtacgttcgatttcttccttccacctggatggctgatgtgaagcatttttccgattttgttaacacagtaagtaggagtactccattggaacatgacgcataatactactctacttaatccgtaatatgcggaccatatatatacatatgcctatactatactccctccgttaaaaaaaagccaacctctctcgtaggttagcttttgtttttttacggaggaagtgcatatgtagagtgggtatgcaacagggtttatgttaccgtcggtaaccgcgcggttaccgcttttaccatgggggtatggtaatagaaaataccgcggtaatctcctttaattcaaataaatttaaaaaataatttaaatttttaataaattttacacggttatcacgtgctgcgcggtaaccctagcccggcggtttggaaaacctggtatgaacaagccgtgacgacgtgagtgaagcgtggcgtggattggataagggaggagaaacaataactccctcctcctcctcctcctgctcctagtactagtagagcagcggcggcaatggcggcgcctcctctgctgagcctgagccagcggctactcttcctctccctctccctccccaagccacagctcgcccccaacccctcctctttctcccccacgcgcgccgcctccaccgccccgccacctccggaaggggcgggccccgccgcgccatcccgcggggaccgcttcctcggcacccagctcgcggccgaggccgccgcccgcgtcctcgctccggaggacgccgagaggcgccgccgccgccgggagaagcgcaaggccctcgcgcggaagccctccgccgccgcctgctacggctgcggcgcgccgctgcagacggccgacgaggccgcgcccggctacgtccaccccgccacctacgacctggtagtactattaattcttccttctccacccacccatgacatgattactactcctacgtagtaagtaataatatgcatatgaatgcatgcgatgcgagcagaagaagagacaccatcagctgagaaccgtgctatgtgggagatgcaagctcttgtctcatggccacatgatcactgctgttggtggccatggcggctatcctggagggaagcagttcgtttccgcggaccaactcagggacaagctctcctaccttcgtcatgagaaagctttgattatcaagctggtaaatcacaacatgccctgccctgccctctaatgtaatcaaacgcaatggctgatgcaaatccttcacatcttctatgcgtctgcctcttgccgctcattctcgctgtttacatgcaggttgacatagttgacttcaatgggagcttcctggcgcgtgtgcgcgattttgctggtgctaatcctattatactagtcatcacaaaggtgattcttctacatactgcatgcatattcgtgtttcaggattaaaagctcattcttttgtaattgtaggttgatctccttcctagagatacagatttgaattgcattggcgactgggttgttgaggcagttgtcaagaagaagctcaagtaaaacttcttcgcccctctttctgttccagtaactattgcatcaggttttccatttcattaattggaaattaagcgtgcttcttggcatctgtagcgtacttagtgtccatttgacaagctcaaagtcactcgttggcgtcactggggttatatcagagattcagcaggaaaagaaggtcagcatgcaatctgtatttgttttcccagttatattgtgctaacctgtccccctgtaagccttttccaacacttgccttgcacaattgaatggtagtttttattgtgtcatatgtacacttatttcttcacttccttggctgttatacatttcataatactgatcataatgttgttcttcctttcttgttagggccgagatgtatatatactggtaagcaataagcactctccatctccttttttcaattatttatgaactcttgtgctacagattttacaggcataccattgtatttttgtatggcaaaacactaagcttgctgccatttgtacaaacctaacaagctgcattcatatatcaacaaatgttgatagcttgatgcttataatgttctattgatacctgatcattatgttagtaatattatggaaagattcagaattggatgttacccactaactaacatacatagacccatcttcaggttctctccttcatttttcattatttacacagaatgattgaaccttgcaattcataatgcttcaaataacatgagtaatttatttatgcctaatgaatctagtacaccattacagggttcagcaaatgttgggaaatctgcatttataagtgctatgctaagtatgttcttaccattcttgactactattgctgtctccctttttcaacctattacttgttttgttcgctcattctgttctttgttacactaatagttagagaccataatttgtagggacgatggcatataaggatccagtggcagctgcagctcaaaaatacaagccgatacaatctgctgttcctggaacgacccttggtcctattcaaattgaagcatttttaggaggcggggtacggttccatcttttactctgtacactttagttttaagatatataatatgccaaattttcttgttgacctgctgtaccaactttatctatgtagctagagaatgaacttaaatgttgtcttatatattgctaacatgcccaaccaattattatacttctctgacacatgaaggactataataatcttgaatacatgcagaaattatatgatacacctggagtccatcttcaccaccggcaagcagcagttatccatgctgatgatctgccttctcttgcaccacaaagtcgtctaagggcacggtgttttcctgtatgtatttgtattcagtggcacacatgtttctttctcaaaacatgcacactaatcttttcttcagaatataatgttgtgttcaggctaatgatacagatgttggattgagtgggaattcattattctggggtggactagtccgtattgatgttgtcaaggtgcctagttgagcccaatttcaattccaaaaattttctaccacttctatttttttccattctgtagtacttaccactgattattaatcaatcaatcaatcaatctaggctcttccacgcacacgactgacgttctatggacccaagaagctaaagattaatatggtcccaaccacagaagcagatgaattttatgaggtacacctgtgtttgctaatcagacaacagtatgcagctaatcatttgttgctaggttgagctacttagaaagcatcaagctactggcatactgttttgttctcaaagttctatcaaatttagattagtatttgcaacccacatacatacctcttcctttaaatatatatgctcatataacttccatgccttccacaccgatgctcacttgaaatctctatggatggtataataactgcatctatttgccatagttcatgctttctatatttctgttcatctaagaaaactgaagaccataacatgtaaaatagccgctaattaaaccagcttctgttctatgtgctatgtgaatcaggtaaataataatagtatgtgttctgctgatcagggtggggttcgaaatggcttttttatttaacgagttgtctatttcacctttccagagagaagttggagttacattgactcccccagctggcaaagagaaggctgaaggatgggttggtctgcagggtgttcgtgagttgcagataaaatacgaagagtctgataggtaactccttgcaagatgcaagatggcttcaattattcatctagcatgcagtaccagggggctttaggatcagacaattagtggttgagtaattcagatctcatgtttcatgaagaatatggtgtgtgttctctccaagcatctgctttcatatgttactgacatttgaggatatgtttgttgtgcagacctgcttgtgacattgcaatttctggtctcgggtgggttgcggttgagccacttggtgtgccatcaagcaacccagatgagagtgctgaggaagaagacaatgagagtggtgaactgcatttgagagtacatgttcccaagcctgttgagatctttgtccgacctccattgcctgttggtaaagcagcatcgcaatggtacagataccaggagttgaccgaggaagaagaggagttgagacctaaatggcattactgatgcttatagctattttagttacgatgacagcatcgtgtagtccaaatagagcacgtaattatatatgttctcagatgatgtgatagggatgacagttttagcatcagctgattaaaattactccaataatgattcaggaaggaattttggataaagacatcgacaagtgaagctcttgcgggtactctctgtttctaagatcttcgtcctagcacatataccatcacatcatttttcctttgcaacactatgtgtgacgcactgacgcttaaagcgaatgccgtaatgaatacttgaatatagttaagaggcaacaattttttttttcagatctgaatctaaaaccaaccaaacacttttcaacgggtctccaactccaacgagagctatcttccaccagagttaaagtttggagccctaccaaacgggccttcatattcggccaatgccttctatatatgttctagcttagcattcgcaacgtgtatactcaactgtcaactttgtggagctatatatagaatttatttagcaaaagaaaagaaaaaggaagaaaaaagccctacccagaaaacgtgtatccaaaatacgttttcaaagttagaaagcgcattaaaagcactacgcaaaagttcttggtagattttggttcggcccattggatcttccgactcacacgcaccaccatgaccgacgggccctcgaccaccggcgattcgccgccgccgccgccgccggagagcggcggctccatctcctccatggttgcctcctctgccgcctccgctgcggccgcggccgcggatttcactcgccgtggcgaggccttcggcgccgatatggcctccgcagctagggctgccatggacaccgccatcgcccactctcagtcaaccgccatcgccgccgcagaagctgcctcctcggccaaggccgacgccctcgccgccttccccagcctcacgctcaacgcaaaggtgccaccttcttgccccccattccccactcgctccgatctcagcaaatttgctaaagctcgatttcttttggccttttcccccctctaatctctaatgttaggaggagttcgaatggttaaagaaggagtacacggttcacgagcaggtggtgttcggcaagatcaaaggtgcattttcctgttacttccgtaactcaaaatccagaaatttacagattgatttgtattgttggcctgttttattatgtataacaattgaatttcgattgcttatagatcgtgttgtctaacatggttctgttcttttgatgttcgatcaattattgactttcagttaccgtgtttgcagagggtgccatcatggccatcgagcatccgggaattgctgcaggctccacagcaattgctggaattgtgctcttcaaaagtaaataccatctcctgaaagtcatttctttggtggcttacttcttgtttgttacattcacaaaagaatacctgcttctgtaatgctttacacatgatacactttagatgatatgaagagggtacctgtcagtaccatatgttaaaaatacattgaatccttttatgtaacacaagttagaatgttggagcaaagtgttccttaatattttttgtaacaacaaagatacgctattggaagtgatttcttatcatgctacttatagttgactgaaatgtactgagaccttcttgagctaattaattagatccaacttagaaatcacaagcagattcagttcaacctgtcttattataatcatcacattattctgattaattggatttcattaattctataagagtgttgtgaaattcactttcaaattatcagcctgtacatgcagagctagttgcctagcatctgatgagacaaggatgttgatgcaagtttggtctgtgattgtttcaagaatctaaaatgttcggccttttcttatatatcactaactttagtgtgactaaattcgttgcagggccaaggagctacctgatccaacgggtgcgacgcatatttgtaagcaaggaggtacgcactgactgcctgtctagctataacatttctatgaattcttgacattgctacttgctacctgcctacctccatgtctcgaaagttgcatacaccatcttgtttacagattgtcacctccttactacttgctgactagcttcacagttcgaacctatcagatgtaatgctttagtgctcattattactgtcatggacatgttgtgatacaattctttgttctgaaacagagcgaaacacaaattcgtctaaaactagcatacatttttttaatgaaattcatgcatgctacctacattcatgaaaaaaaaatacagggttgattttctttagaatgaatacaacctatgttgattgtatttcataagtttccaaattgcagaccctactttctggcatccaagctggcgtgaatcacatgagacaaactgtcaatcttgtgtccaatgaaagccaaaagttgctggtatatttctttattttgttgaaaactgaaccatctgttgtcaaattggccatttaagttcaaacattcttcatgtctgattttgtgtatgcattccaggatagagcagcaactgctgaaaaaagatttcagaaaggatggaacacactcaggcaagcctattttttaaagccttttaccatttatttttgtcttcccttctctaatacagcattggatttgctgtctacttgtttcagggaagaagggcgtgccattcaaagtgagctgaaccaaataagtgatattgagaagcaagcagtaggtgtgtaataatttcttgcgctattgccttttcctatgtcaatttgaattttagagcggaaattgcctcatcttgaatttgacatataatgagttgtgtcctataggtctcaagagcattctcaatcagcttcccagagcacatgcatctgagtttcaatcagaggtcagtatattttctggtatctgaacactatgatgtttactgaaacgattaggtgatgttgaagctgtcactgcaatttgtttttttcccatgttgtgcaaatctgttggctaatttctttgccaaaaggagagggtatagaagttttattcagtcaatgtcggcatcgattttataagtagtgtgcagaaattatttttcatggtttcatatctcataattgcagcattacattattttatcacaaaccagttttacactaaagataagatagtattttgaagatgggagttctgtaatgttaatttatagcaagcttatttttttaattgcagatatctggcctagcctctcaggtgaagaaggagaagagagtacttaacaacaccctcacgaagattgcgaactatggtgtccctatctgactgtcgaaacgcagcttcatttgctgtagtttttatcaatgaagagattctgaagacatgggtgaatcttttactttatactacttgtccgcggaggggaaaggaaataatacgttttatcagtcttggcgagatgtaaatttgccgctggtgctgcagcagcaacataacatttttgtagtgttttgcatcatatgggcattctctgttgcattgtccatgaagtgaaatggacatactgcgtcgaccttccctgcaattaatcaaattatgttttttttttaagtgtgatgggtgcgagactttatgtgcttcagagcgttaaagtggattcaagaaaactttttttctttatcaaatctgatgaagtggttacaattcttcagtactgtataacggatatgcttatgatactattatggctggaaatagaggattgatagggaagatcgccctcaagtcgccggcttctccggaagacggaggctctgatctgattgacttagtgggcaaggcccttaatatctttattgcttagtccttaatacaatagcaggccccctttatatactaggtgccaatctaatatttaggaaatctaagacaaactaggaataggaaacataatcctaaaccaactagaattagatatatctactgattattcctattcctattcctatacctatggtatttgattccataacgccggtctataacatttccctcctcctcatgaaacagctcgtcctcgagctggaaactgggataagcttcgcgaaaatggtccagcgtttcccagctagcctcctctggagatgaacctacccattgtatgataacttcttgaattccttgattccacctagctttgatagcagcagctggtgcagggataacctggccatgaacaatgtcaggaacctgaacaatatctgttggggccacaccttcaattttttttagtaaagccacatgaaaaacattgtgaataagagctcgaggaggaagcttgaggcgataagcagcatgaccaattctctcctcaattaaacaagggccataaaatcttggggcaagtttagagtgtgcttggtctgtaataccagctgccatgcgatggtgtaaccgtagccatgcctattcaccaacctcaaattcaatgtcgcgatgagatttatcataccaactcttcatatagtcctgagcttgaagaagtctctctcgaatttcaaccaaaaatccatttcgactcctcatctatttgtccacagccacaacacaggaagaccctggctggtaagcagaaatagtaggaggatctcgaccatacacaaccttgaaaggtgtctcacgaagggaagtttgataggaagagttatagcaaaactcagcccatggaagccactgtaaccaattctttggatgatctcccgaaaggcaacgaagatacatagtgatgatgcgattaaccacctcagattgaccatcagtttgcggatggaaggctgtgctcatatttaactttgtattagtgaagcgaaatagttccttccaaaatgtgctagtaaaaactagatctctatcactcacaatagaacaagaaataccgtgcaagcggacgatatcatcataaaatgcctttgcgactgagagagccgtgtatggatgtcctaaagcaataaagtgggcatacttagaaaaacaatcaaccaccgtcaaaatgactgacttccctcgaacacgaggaagaccctcaatgaaatccattgaaatatcctcccaaacagcagaaggaactactaaaggttgcagtaagcctgcaggatgtcgatgttcagtcttgttttgttgacataccgagtagctcttaacataatccttcactaatgaactggcatgaggattgtaaaatgatgcacgtaggcgatggagagtcttctgaattccctcatgtcccatcccgtgcgcatcagccaagagcaagggccaacatgcagaagctgtaggaacataaatcttgccctcaaaggtgaccaaaccatccactaaagaccaacctgtcgtaagtaaaccagcctgaatctgatcccttttggtaatgagttctagcagtgtgttggtctcttgtcgcaataaatcaaatatttcaaaagatgggccagaaatagcgtgtaattctgctgattcttcacgacgagataaagcatcagcagctccattgtgttttcctggccggaactcaacttcaaagtcatacccgaataacttactgacccaagtatgctgtggaatagtagacagccgctgatcaagaagaaatttcaagctataatgatctgtacgaatcgtaaaggatcgtccccaaacataaggtcgccaatgacgaacagcttttacaagtccaatcaattctctctcataagctgcaagcttcgcatgatgaggagccactgcacgactaaagaaagcaattggtcctgctccctggtgtaaaacagcaccaaaacccacaccagaggcatcacaatcaataataaatcgtttagtaaaatccagaagttgtagcaaggaagcagatactaaggccttctttagcgctagaaaagcaccatgggcctcagaggaccatgtgaacccttccttcttcagaagcttggtaagaggagatgctatggcaccatagccatcaatgaactttcggtagtaaccagtgaggcctaagaatccacgaagagcgcgcacagtgcgaggttgaggccactccgcaacagcctctaccttgctaggatccatggccaccccacttgcagaaacaatgtgtccgagataagtcaccttttcttcaccaaagagacacttggatcatttaagcaccatttggtgttcttgtaacaccaacaaaactgctctaacatgttgaagatgttctgcccaagaagaactatatatcaaaatgtcatcaaaaaatacaaggacaaaccgtcgtaggaagggagccaatatgtcattcattaaggcctgaaacgttgctggagcgttagttaatccaaaggccatcaccaagaattcataatggccatggtgggttcggaaagccgtttttttgacgtcatcaggatgcatgcgaacttgatgataaccactacgcaaatccagtttggtgaagaagcgagcccctttgagctcatcaagaagatcatccaccaccggaattggatatttgttctttatcgttttgctattaagggctcggtaatccacacaaaaacgccaagttttatcttgcttcttgacaagtaatactggagaagaaaattcggaatcacttttctggatgataccttgggtcaacattgcagcacattgtcattcaatctcatccttcaggagttgtggataacggtaaggacgaacagccaccgctgctgtgtcagaaatcaaaggaatacgatgatcatgacttctttctggtggtagtccacttggctcattaaaaagatcatcaaattcttgcagcaactcaggcaataagtcacgtccagtcaaagcatgagcctgcggcggaaaagaatcaccaccatgaccatgccaagctacttgatgatcgtccctccaaaaagacatggtgagcttatcaaaatcccacaagatgggtcccaatgtacggagccactgaacacccaataccacattatagcctactagtggaataacataacaatcggtgatgaaatcctccgagtcaatttttataggaatacctgagcagatgcttgagctagtgacttgatcaccatttgctaccataacgttcagtccagattttgtggtaggcgagaggccaagacggtgtgctgcctcagtagccacaaaagtgtgggtagatccggaatcgaccaaagcagacatggttacacctccaataataacagccaagcgcatggtcttgctagtacggatgccggtcaatgcatgaagagagatggtaacggtgtcatcattgatactatcatcgtcctccccctcgtccatctccaagaggtagatacctttcatagagcactgacggtgatgatctttagagaatttctcgggacaattgaagcaaagccccttttcacgacgctcagccatctcagctgctaacaagcgacgaaaccttgtgcctgtagtacctggccttgtaggtgatttggaagcaacaatcgcagcagaagaagacgtgctactacccacacgggaaggtgctggagcagaacgaaaagaaagtgcagaacgctgtttattctccacgatacgtggagcagcgactgcatcatcttccaaccgctgctcataagagcgtgccaagctcatggcggcctgaagattagctgtattttgaagctcaacatcaatacttaaaggcttgccaaggccggcagtgaaaagattgacttgatgcatcggattgagagatggggtaacacgacaaagaagagccaaaaattgtttttggtattctgccacagtcccggttcgtcgaagtgcggacaattcaccaagaatattgttacggatgggaggaccaaagcgcatattaacaaagtgctcaaaaactgaccagttcacgagtccattatctttggaaaattgaatataccattgttgcgcctcacccgtcatgtgataggaagcaagccagaccttctcatcctcaggcgtccgttggccttgaaagaattgctcacaccgattaagccaggtcaagtgatcttcttctccatcaaatattggaaaggttagcttgtgataacggggaacaccacgtttgtcatcatccagattagcaccactgctccctttttcccatgaatcttgccgagcctcaaggttatcaagtttcttcatcaagagaacaagtgtcttggccaaatcagccatggttgtgctgtcttccgacatggtggagagctaggtataggtggtggctggggttggttgacggtggaacacaacagatgtagcggcggaagtgacgcaagcagcgcgaatgtgaggcgtgctgcgtcgagcggaacccagcgacaaagcaagcgctggatgagggctctgataccaaatattatggctggaaatagaggattgatagggaagatcgccctcaagtcgccggcttctccggaagaccgagtctctgatctgattgacttagtgggcagggcccttaatatctttattgcttagtccttaatacaataccaggccccctttatatactaggtgccaatctaatatttaggaaatctaagacaaactaggaataggaaacagaatcctaaaccaactagaattagatatatctactgattattcctattcctattcctatggtatttgattccataacgccagtctataacagatacagtatgcaatcagattttgtatttgcatgaacacctggagtcaaagaatccacaggttagatggagagaattttgtaatttgaattgagtaaatttcatcattagcacaaagatgagtcagtttcaaacagtaaaaccataaaattttaagggtgctaataaaaaccacaggaaacacgataaaaatgtttccgaaaattaacaatcgactatttttaatcatcaattgatatattatagtactatatatagttagcagatccaacaaatgacagctgtgtttagtttcacactaaaattgaaagtttgaaaaaattaaaacgatgtgatagaaaagttgaaattttatgtgttgaggaaagttccgatgtgacgaaaaagttaaaagttcgaagaaaaaaaaattttaaaaaaattgtcctgctcttctcctctccccctcccttgtttggagaaatttaatatggcaacgccgccgtcgcccgtccacgcgcagtgtcgacttcctctcggccgcgctagggacccacgccgccgccgccgccacgtccgccttttccccgctccgctgctcgcctccccagcctccgtccgtgctcccctaaaagcaggaggcggccgccgagaaggagaaggcgccgcgaagagtgagagcggggggctagacctagtgcaatcgagccttcatcggcgccaccgcgggccatcgcgtggttagccgccggagtcgggggtgggggggatgccgcgggagccggccgccatgcgcgtctacacggtctgcgacgagtccaagtgcgtgtcgcatcacaaaccctacctctcctctcctcttccaatgcattgaatccctcttgatgattcaggtacctcatcgtgcggaacgtcccgtctctcggctgcggcgatgacctcgccaatctcttcgccacctacggcccagtagacgagtctgtctcttcctcctcccacctataccataccaccacctgcctgtgtgaatgatttgcttgcttattcaggtgcacgcccatggatgccgaggactgtgacccctacaccgacgttttcttcatcaagttctcgcaggtcagcaatgccaggtgagtaaccaaaatagtaccttttctttcagtcctttttcctgttcaggaagaaccgacgttcacagaatgagtgaaaaatgttactagccaccattaattccaacaattaaatttgtgtttggtagtcttttctaagacaaatttgtctccttctcatccctgttttgagctctgtgcttaggattacagctttagtttagtttgttagcaattgggaacaaatctggacctactatttgccaaatcgcaagtttattttctcaatgaaagcaagaaacggcattaattgcaggtttgcaaagaggaaattggatgagtctgtatttcttggcaaccggctgcaggtgtcatacgcccctcagtttgagagtcttctggacactaaggagaaactggaagtcaggagaaaggaagttcttggccgaatgaaatgtgtgcttccatgttcttcttttccccctaactctatgctgtttagccttcgttgtttcaatatgtaaccgttttctttctacgactacacattgctagtttatcttgcttggatagttatatataaatgtttgctttcatttctccagcatcttctggaagacctgaagggttatctcatcattctccaggtcagggatcatctgctgcaaactcacaccgtcagatgagctctaataaaaggttaacatattgcgtactactatcagtttttttttgtgtgtgtgtgtgtgcaaacattgctaaggagaacattggtcatcagttactcattgatcggcccagtcttcaactaaattctatccctgttaaccatgccatttggaattggaagttaccctcatatccacatctttattgatatatgacatctggtctgaatatttgaagatggatacccagtctttatgaatagcttagcagctaagctacagtgggtttaccgaacaaaactgagatctttggcacagtaaagttgaaagaaaaaccagcaatccttattccttaatcaaaagactgagacacttcttctagctttgtgtttggtttgctctttagattttatgcatcagtttgtatatttcatactcagcactaccatgtaggagtatcaaccaggatttggtttgttcattttaaggaatgaacttcaattatgatacaattacatacactcgccttttatggaatattttcaaactttataagtaatattgaatgatgtggaactaagatggtaacccaaaagcccatctggatcttctctgattagaagtgtaaacactgtatatgacttatctagtgaagttccattttgccatcttcagggaatacacaaaaacacttcatgcttctcaatttgaagatcctcgtttcactcatgtatcctctaataaggtatgcagtacaacagtatgtatcctctaataaggtatgcggtactgcaaagtaatataatgtttggaatttggactctaggtgagaaaccaagaggttattcattgagaaaaaatatggcattaaattagcagggcatataatggtgtaagccaactttcttttcagaaaaagaaaaacagaaacaggggaattaatgcattgagtcatacatagtacctggaaaggcaaattctgcaataatttggaattttgtatatcctgccatattattgaacttagtattcttaccaatttgtggagaaaatacttctctgtaggattattttccatctgagtcgatgaatgcaacagtaaacctagtcagggagaagcttgataaggtaagagtatctttgttaagtgtattatcatattcactgcaatatgtgcatttgtggataagttaaaggttccattttcaaaatttcagatacaatccagcagcgacaattccagtgctatagttgcacccaagaaaccaaggaccgataaccgtagacgaatttgatatcatgggatggagtagaacatgcatttttttttcttcatctactttcttgtagtttgttttataattggcagaaaatagtgtactataatgctaaatgctgtctatattctccctcagttgtaaaagtatccccttttaggttttctgcggaagtaacgttagtatcatgttttgacgtggattaatgtcatgtttgatgagcacatttctcttcgtgaaaagtccacctttcttttgaacaatttatatttgaaacatcatgttctgttggtatactgatttatctctacagttatgttctatttggatctcaaatggttcctatgaggttgtgacatctgtgttatggcatgaagaatttcatgatgtctgatataggagaaaaagatgacctctgctgatcagatgtactccctccgtaccacaaaaaaaccgaatctaggactggatgtggcacatcttagtatgtatgtccagattcattgtacaaagatatgtcacatccagtactaggttttttatgggacggagggagtaatagatagcttacatatactctattcggtcataaattgttgacgtctcggacaaaatttagccggagttttgaaattccctaaccacccgtatccttttcttttcctaacttcaagttcgagtcggatcccgatgcctatgtactatgctaagagcaagtacgatagggatgactcaatactccctccatcttataaaagaaaaatctaggactgaatgtgacacatagtataacgaatctagatagatctgtccagattcgttgtactagcattaagaacaaaagatagtgcagtcggctgtagaattataaccaggctatagcacgtaaaaagagaagatacaataacttgtccgcttctattagctatggagcatagatagtgatgggcctaataaatttgtatcaaataactattgtgcatgctagctactaaaaaaactaacttagactatagttagctgttggctttattattgtacctgctctatgtgtggaccttgaacatcaaacaatcagatctcgataggctattatacttaaatatagatataatattgagccgtacatttcgatgcctatgtatatgctactatcttcgtcccaaaatataacaatttctaactatatagatagaagttactatagtttataacatagagagtatgtaagcgtcgtttctcaaggtctaaaaacaactgggaagatcaaaatgggaaaatgagggagaaatatatagagatggaagagacgaaatggaaaggggaaatgaataatgcataataaaggaaaaaaaatgacaactgaattttttttagtcggacgacctcattgcccaacttcttgtaaaaagaaattaattaaatccggaaagcacaaagtaatagaaaaccatctctctcgcgatgtacaaagttgctgacaaccataaacgtggcaactttctggtctggaattcttgcgtgggaaagccgttaccacaatattaacaggaatagaagaaaggtggttactattaagtcttcgtgatagacgtaccatgacaatatttatattaggtgaattttcaaatagtggaatataaaatgccagcataaatatatctttacctctactattataaaaattaaagatgtttttgccggtgctttggtaagtcatccgtatatgagttggtttttaagttcgttttattttgaaaatacatatccgtatttgagtcagtttttaggtccattcgctttcgaaaatatagaatgagttgtataagaaatctcttaaaaaaactcgcatactaacttgaggcgatcggaatcctaaattcataattgaagctcatgattttctaaaaaagggcttgtttggtacagctccaactcctaaatataactccaggagttgagtctggagtggagttgtggagctgccaaaacccagctcctcaactctagtacattttgtgagagagctccacccaactccactcccaattttggtggaactgaaactgattggctgagctccagctccaggaggggtgaagctggagctagagctgtgccaaacagacccaaagtatatatccaaacaaatttctacagtgaattttatcttaactaaactgtataacaataataagattaaagtaactttcacccgtttgcaacgcacgggcatttttagtggaaataaaagagaaactcaaggagtaaaagaaaaagaaagcgaggaaaagagaaaacagggggagggagaggagagagagacatcaagcaagctaggaacaagggaagggaggggaaaaaactgtaggatctcccccgacaacaaaagaagaagaagagaaaaggatggcgatggcgatgcgacgtcgggtgtcgtcgtgagcgcagccctccctcgcgatccacctaccccgccgccggtaagcctccacctccgccattcctccccccacccaaaccctagatccacaccctcctctccgcccccgagatctcctcgatcccgtccgcgattccacgccgacatggctgaccccttcgtcgccgacgaccagaccgacgccgacttcttcgacaagctcgtcgacgacgacgacgacctctcccccgcccctgcccctgcccctgttcccgcccaacagtcggcggaggcggccttgcttccagctctttccgacctcagcctcgccgacgatgacacagacccttccccggctcctcctcccgtcgaggccccgccggagggtgcctcaccggagtcggggaagggcgccgtccacacaacggtcaagcaggtccagtgggcctcatttggaggcgccgccgacgatggggctgatccgttcagtgatctgtctggaggcgccgctgatgacggatttctcgggaccatggccgggaaccagagcttccagacctccgtcattgggagcgtgggggcatcagctcacgggatctttggcgggagccagagcttgactgccgaggtgacagatcaggattttttcggtggtacctccgatcagaacaccgatacccagcagcagcagctggagcagagcggaagcagtgctttcgactccacagatcccaagtatttggagagcatttatcctgggtggaaatacgacgaggcgacacagcagtggtaccaagttgacaattctgatacgcacggtaacgccacccaggtggacaccagcactgagaatatccagcagcagcagcttgccgcttcttacatgcataatccgacacagtcatcgctagagacaattgcggaggagggtacgacgacagggagtgtatcgacatggggacagggtggcacctcggagtacccaccaaacatggtattttacgccgagtacccaggctggtactttgataccaacacacagcagtggcaatcgcttgagtcgtaccagcaggcagtgacagctagtgctgttcaggatggagcaaacaatggtgtcgttgcctcttctgctgagacaaattatagcgtcaaacaaaccgaagatcttcctgcccacaatcaggtggcccaacataactctttctctaataactatagttatcagagccagtggcagacaaattcatttagtaactctatgcaacctgaaagtgcaacagctagtctgccagatagtttccagagccttggtcagcatgctatttctgaatctttcaattcctctacaaatagtcaagttagttttaacaccgctgaaaccgctacaagccattatggcaacgtgaacttagattcgtcaagtactcagggtggctacaccgcaagtggtggtcaacaaactggttacaagggcttcgaacctttcacaggtcatcaggctggttacaaggggtttgaaccttctacaggccaccagacaagtcataagttatttgatccatcagcaggtaaccaaaacagttacaagccatttgaaccttccactggtcaccaccagcacaaggggtttgagccttccacaaatcaccagggtgattacaaggcatttgagccatccacacataaccagggtggttacaagggattcagtccttccacagttcagcagcctggttacaagggatttgaagcttctacaggccttcaaactaatttcaagggatttgaaccttactcaggtcaacaggctggttacacgggatccctaccttctacaggccaccagtctagttacatggggtttgagacttcttcaaaccagggttatggtgatgccaacaatgttgcaaatagtcaaggctttgttccgatggagagcatgtacggaagccataatcaagctcatacaaacccccaagtgcctttgtcaaacagttatctcagtgttgataactccaagaatttctctcagcaacaatttcttggtccaaatgcttcacacttgcaatttgggcagtccccacatgaagagaggtcatcagctggacgtccaccacatgctttggttgcttttgggtttggaggcaagcttatacttatgaaagaaaccaactcaatggccacaaactatgactctgggaatcaggtatgctaagagttcctgtgtgatatatttttagtcatcaaacaaaattatggcatatgttaaagtaactaaaatattctattttaattttgcaattcaaggggaattctagtggcacagtatcagttcttaatttatcagaggtggtcacggacaaagctgatgctttaagcgccagtaacggtagcgcacttagttatttccatgctttatgtcgtcaacctgttcccggccctcttgttgggggaagcgctgcatcaaaggatgtgaacaaatggcttgatgacatgattgcactgtatgaatcatcgactagtgaattccagaggggtgatcctcgcaagttgcttatttctttgctgaagatactatgccaccactatgggaaactgcgttcaccttttgcttctgacccatcacatgaggtactttctgcctttcatgctcttttttgttgcatctatagtgtattttaccaaaacagaggctgatataatgaatgctccagttaatcaactcttagtgttgtaataacggcgcagagggcaagcttttaatactttttaatgtgatgaacatgtctgaattagcagtttaccttttagctcatcgtgtgtgataatttgggtacttgtttcattgtttgtcctttcacctttgtatctctgactcatttgaattctcaataataggacacagacggtccagaaatggcagtaactaagctcttttcatcttgtaagagaagtagctttcaaatgggcgatttcggatcccatgtccgttgcatgaagaatattccctctgaaaatcagatgcaggtgattgccatttatattatatggatgtgaaatttagctaaatcctaaatgtccccagttgaggcagctactttgcttgtaggctgttgcacaagaggtccaaaatcttctagtttctgggagaagaaaagaggcccttcagtgtgcccaagaaggtcaactgtgggggcctgcaattatacttgctttgcaacttggtgataaggtttgttcgacttaatagccttctcttgtttgcatttgaatagtttgcttgattttcaatgaggttttcttttccttaattttttttatttatcttttctttccccaccggtggtgcagttttacgtcgatactgtgaagaaaatggcccactgccattttctatctgggtcacctttgcgaacattgtgccttctcattgctggacaacctgcagatgtttttaatgcagacaacaacatcagtagcaattatggttctcaacagcctatggaggtaatacataattatttttcactttctagatgcgcgatactttggtcgtaggattattctgtagttagatgtaatagtaataattgttcttaacttttcatagcacttgcctgtcccatattgttgtacaataatggcttttcatttctttgttactgcagtgtcatggtgctttggttttttttttcttgaagaaaatgttttgcttcattgataatgcattctactgttctaccacctcgttgttggctttctgtttaaatagtggctcactttataattcattgttttgtcacacagcctagtcctaatggcatgttggatgactgggaggagaatttggctatcataactgcaaataggacaaaaggtgacgacctagttattacccatcttggagattgcctttggaaagagaaaaatgaggtctgtatgatatgtatttgcagaattaaaccctttcttttttgtggtcaagtaccttatatgccttttgatacaggttgcagctgctcattcgtgctatttagttgctgagttaaatattgacccttactctgaaagtgcaaggttatgtctccttggtgcagaccaccttaagtgccctcgaacttttgccagccctgaagccattcaggtatattactgctagccattaacccattacctgtaaatatattgaatcttagtgcaattttccctcgaagctctatcttttgctttttaatgattagttaatgcaagcatactgtctcagtgttttataagcaattattgcatagatacatagactggaaatgcaagattgtgtgtaaccgctaacctgttgcttcatctttttttactctgctgtccactgttctgaactaatattttgaaatgcgataacagaggacagagatttatgaatatgcgaaggtgcttggtaattctcaatatatcctgctaccctttcagccatataagctgatatatgcatacatgcttgcggaagtgggaagggttgctgattctttgaggtatgttgttgatttgtgcatggccagcaaatgatttcaatgctatacctaaactcctgctttcacattatgacccatttgaatctccttaaaggtactgtcaagcatctatgaaggtgctgaaagcctctggccgtgccccagaattggaagcatggaagcaattattttccaccctggaggacaggatacgcactcaccagcaggtaaatccttacagcttgttttgcaatgtagctgagttcctccctctccctattaatgcacttgtgttgattgctattgtttagggtggatatggcacaaaccttgcccctgcaaaattagttggaaagattttcacctcactcgataaatctatatcgcgcatgatgggtacaccttctgctccacttccgccattgccacagggtgctgttagtgatagggagagttacactgcacctggggctacaaagtttgcaaatagccaatcagtaatgaccatgtcatcgttaatgccatctgcatcagtgcagtctatgagtgagatgtcagatagtggcaggaagattgcacacaacagaagtgtttctgaaccggacttcggcagaaccccgaaacaggtaattatgccctcggctgaggtagacacttataaagacagcaggttctgattagtgaatgccgagtgataaaattctaattcttccgtttgtttgaaaaataacagggtgctggatcggacagcacacagagtactgctccaggatctggtagttcacgctttggttggttaggctccacactacagaagacaatgggatttgtttcaaaatcccaccggcaggtactttaactgagctattgaattggagccactccacttttgttcagtttctcttccatatagtaaagctaatactgagatccttcctatgtcttgaaggctaaattagggcaacaaaacaagttttactatgacgaaaagctaaagcgatgggtggaggaaggtgctgagattcctgccgaggagcctcctctccctccacctccatcaaaaccctcattccagaatggtgtggtagactataaattaaatggccccatgagtgcaagtcatactcccaatggattcatggaagggaaatcttcaacttcttcagagcatggttcgggaatgccaccaattccgccaagccagaaccagttttctgcccgtggacggatgggtgtccggtccaggtaatctaataattctgccacttgctcatgtctttctctatattctataaaatattgaccagaggaaagttatgtttatttttagatatgtggacacattcaacaagggtggaggaggaggagcagtcccatcctataacaagccagctgttgcatctgtgacaccacccagtggtgccaaattctttgtgcccactgcggctgttgttgctgcagagcagatgcctaaccaaacagcggaaacacatggtgaaaccttccgtccagatgagcgttcatccccagctgaaacgtcattttcttcacccccaccagcaacacaattttcagcaccactgatggtgcctaccattcagcggtatccgagcatggataacatcactaccccgaacaatggatccggattatcatcgggaagtaacagcagctcattctcaagatcacgagcagcatcgtggagtggaacttactctgaacaaattaatgctgtggcaggtgctagatctcctgaccagcagaccatgccatcgcccctcatgcctgggaagcagtcacatagtcgttccaacagcaactcatctgttcagttcaacagtttgacagaggatcttcatgaggttgagctctgatatgctgcgactgctcagtatgacccatgattttatagaaacaacctgggtaaaataccttgatcctctcagcaaaccccctagaggagggagggagggagggagggaaaaagagaggaaatgttttacagtaaatgaagggaatgccacaagtgaaatggatatctcctgtcttgcacaaagttgtgggatggggaagtaaagcaaggtgtgcccgccctgtactcgtacaaacagttgtttttttgggagattttgtaggtattgttggttattatgggtttagagaaggggataaagagtcggatgtccttttttacatgtgagaagcagagagcatgtggacaccattgtacagataatccaccccagcccagccccagccctgcccccatattataattcattgaagacgcagagaattgggaattcatccgccccacatccttttttgtcattgtattattatcattttttttcttcataattttggagaaggatagaagagagggagaggtcaagatgtgtctggatattctagtgtaagaaagaagaaagcttttgactgcgtagagtgttgttatacttactgtaatgttcctataccatgatgatgataatattattctttggagtcgaccgatggatcaatcaatactggagtaagtagcatcctttttgttttgtttcccagcatgcgtgatgaaagaggtcaatatcatgtggtggtttggtttgatgtgattcatctggtagtttaatttgtgctgtgtgttggtaaccaaaggctctctctaaaaccggagaggaagaatagatcactatttccttcattccaaagaaaatctataacagaaattgagggcaaagaatctggataattgttttaagtttttttaattggttattctaagatacttcctccgtcccaatatattgcaacctaggatagaatatgatgcccaggttcatataggttcatagtattaggatgggtcaatcccatcttagttgcaatatattctaggttgagtttttaggatgtagggagtaggctactagagtagagagattggtaggaatcaccaaaagttgagggcatttttttatttattttcactaaaatatttaaaaaataatcttttgtttcaaaaatttatagatctggatgcctcatgccatttgggagtgtaaacgggctttaaaaaaacatcaaacattctgttagagaatgatgtggcatataactgttggttactcctttcccgccctcccagagggtttttttttataggaggaggacgcttgtaaatctgcttgataagatagaaaaatctaggccacccttataccagtattttgggggttttttttataggaggaggacacttgtaaatctgcttgataagatagaaaaatctagaccacccttataccagtattttgcgggtagcctttcctcagtaaaaataataatatattttcaaagggcaaaagggctccgtctgacatgaacaccctcttttttaggctgctattagacggagccaacagtcatctgccagataaaaaaaaaagtcctctcaaagtgcatgaggcgtctagatctgtaaatttacaaaacgaatttttaaaatattaaatgaaagaaattaaaaattagaaaaaaaatggtgaggtgaggaggtaggcaagtcaagtcgaaaaacatgatgatgacgactgctaattcggcccaacaagtagtcccctcccctccctcgacgagagaagacaagacaagtcgcgacctgacgacccgaccttcctcttctctcccgctgccctccgccgccgacccgcaggggatcgtggggacgatcgatcgaggaggagagacccaaaccctagccacccaggcgccactcccattgcccccttcgccagccagccatgtctgcggcgcacctcctccgccactcccgcaaggttccttcctctccctctcccctctcctccatctcttgtttaattctccgcagcattctctcatcccaacaccgaacgcatcttgttccgatctgtcgtgcttatgccattccaggtcgatcggaacatcaccagattcccttcagattcccaatctaatattcctactgcagatggctcacattccaatctacggctctcacttttgtactgcagctgcggactctacgtgatgctctagattatgatcggtctgctcttgtacgctacttctccgctgcttctgcatcctttcccacaaagggaggtgctgctgctggtatgtgctgtactagtagcctttttctctttttctcaattgatttactggagtatatgcatgcaatctgtttgtttgtttgtttgtttgttcaaccaatctggagatgccctttcacattactaattttctgtgctcattatttatttctcttgtttaattgtatcttctgtttgtaatctatgtaattctgctgcggctgtggtcactgcttataagtcctgcattgtcatcatcgttcaaactgatgtggtgctttgcactctcacttcaatttaatcagaatacaacttttgtatcttgtatcagttatcctggatcctccagaggtgcttcttcttttgcacctacatattatcagtttcacaagaatatggggcattcatcaattatgtattctggactgtaatctaattaatataggcaaattatcaattgtttacactaaaatctgtacaaacaaactattttaacacaagcacaatgctttctcatcttttttacctctccactccgttattttccgtaccttcgaccaaacatgttttggcttcctgagccaatatcatcatttttatttattaaggtgtcatttgccgttgacttagtttaactacgctcatatcctccagtgcagacagcagctatttttgtcacgtggcagcttatttttacagagagaagtttctgttgttcattgtcacccgtgcttttggtttctgcaggtgttgagaaaagaattggtggcgccagattccctcagtgcaagcagcctgggaaagagcttgagaccttcaaggttatgttcatgaaaaataatccgcattctgagatccctattgtcatatcctgattgtctagtttgtcattttatcttttcaggtgtcactaggaggactaaatggaagatatgcttgtagaagagcacctaacaattgtatcccaaccactattaccggtctcaacggttcattgtcatggtatgttttgttttctgctatgctattgttagcttatatggctgtgtaggaatatattgaattagagaaccacccttgaaacaagagaatatgaactagtaatacttgaacattgagctaagacaaaccataaaaaaattattgacatcttctgtaaggcccctgagatatgcctctctgctctttagtgctcttttaccagaagaaatgaccccatgacagttctaatttccattgcatcttggtaatattcctcttttcctgtttcttttcccagtggacaggtgtcttcagcaagatctttctcaagcagtgcaggtacttatcccagcagttagttagtcttaagtgggtttattggttgggcctcacttatgtgtgatgctttttgggaagtgttcttggtgggaggggttccttgaccctttctttataaatatttctctcttcttaatgaaatgaagcgcagttctcctgcgttttttgggggaaaaaaacaggatatcgcatagcagctcctcagttttttattgatcttttttgcacttatctacaatgttgtttttttgccatccttctttttgttctattatttgcttcactttatcccgtcttcccatgtaccaattgtttcatgcatgtgatcctctattctgctacttttttttggatatttttctccacatctgtatctccgttgaattttcaaaactttttttttgtatgtgttatataagcatttaggttatttgctacaaaataagtatatcccaatctcacaccacatctccccattgttttggttactatgttaaaattttctatgtaactccaatcaatggttccttacagagcatgtaaagtaaggtcctctgttagctctcttaattcttgacgcaatttgcttattccagacctgccaccacatcaggaaattgggatgccatcactctctcctacaatgactgaggtatctgttacgcaaaaaaaaaaaaaaaaaaaaaaaaaaaaaaccgttgctccttatctgtatttcttgaattgcatccatcggtgttacacctttaacaccagaagtattacaccttacacttgtattgtctgtaggggaacattgcaaggtggctgaagaaggaaggagataaggtctcacctggtgaagttctctgtgaggtggagacggtaagttttctaatatgtaaggctacatgccatatattgtttagatttatttttagttatgcagttagccagttacttctattaagctgcagtagaagctaaatatcctttgaatgcattcctgctgactaggataaagccactgtagagatggagtgcatggaagagggctatctcgctaagatcattcatggagatggtgccaaagagatcaaagttggtgaggtaaaaatttactgatcaaagaacaaccaatttatgactctcattttactaatatgattattacagttgcctctgcctataaatttttctgacgtaatcttggttgatttatggccccactgttccttttagatcattgctgtaactgtggaagaagagggtgaccttgagaagtttaaggattataaaccttcaacttcagctgcacctgcagccccttctgaaccgaaggctcagcctgagcctgcagagccaaaggtgaaggagacagagccttccaggactcctgagccgaaagccccaaagactgaagaagcttctcaaccagggggtcgaatattctccagccctcttgcaagaaaattggcagaagataacaatgtagtttttttttcgtgttacctatctaggctattaattggtagattttattgaatcatacttaataaacacaaaacaggttccactgtcaagcgtaatgggaactggtcctgatgggcgaattttgaaggcggacattgaagattacttgggtatgccctttctcttgtcccctccaccccccttctctctctctttctcctcccttaatgatgaaatctgcgtggaaaaatgcaattaactagttttatatatttaccaatgactatagattaatttattttcaactatatcacttcctagtttttttagagaaaccgctggggaagccctcattttgtagctagtcatgtgtgctcctggacatctcatgctaattctgaatggtggactcataatgtcgaattttattggggtgtcctccccttgccagctgtcttcttgttcaatctttaaggctcaatcacaagaaaacaagctgtatcactcaatatctttgtggttggctatcatatccattctaagataaccatattcagatactatttgatcacttaattcaatatccactggaccagtatatcaagttttcagaagaaaaaagaggctatttatctgactcagttttgcacttatgcttatttgtgtacactgtgttagtagcagcactagtttgattcaaagtaatattaatgtaatttgcttgagcttgccaaggttcaagttaaatgtgtggctgtcactagcctgttatgtatgtcagatttgctgtgcttttattctgtatgagaattcaatcagcatctaactatcattttttattaacaaagcttctgtagcaaagggtggcaaaagggaagctcttgcggctccagggttaagttacactgatgttcctaatactcagataagaaaggtaaatttcaatgatacagaatcttgttaggttgattttagccgatgctattggtctgatagtgtattatcttctattcttcacaggttactgcaaaccgcctgctaagctctaaacaaactattcctcattattacttgacagttgacgcccgtgttgataatcttatcaagtatgttgaagcctagctttgtaatttaaagcaatcctatattacataggaaacctatgtaatgattcaattccatactgctggttttgtagctttttaaaatagttctttatttcaatctaatccaggttgcgaggggaactgaatccgttgcaagagtcatctggcggtaagaagatatctattaacgatcttgttataaaggtaattgccgttttcttgtttcttatgtctaccaaccattgagttgtcgcagattgggtgtatgatgtatatcagttcacagactgttaattttctcctgacctccagatctgaattgatcttaatttgatgtgcaggctgcagctctggctcttcgaaaggtccctcagtgtaatagctcgtggatgagtgattttatccgccagtaagttgtcatggagcatgtatcctgggattagaattatgttgacaagaaggtgattatggtaaatttatttctcgtgcagataccacaacgtgaacatcaatgttgctgtacagactgagcatgggttgtttgttccagtaattagggttagtaatctgaacttgtctatttatatgaaaaaaaaaaaacattggtttctagcttgtacctgtgtttcaggatgcagacaagaagggacttggtacaattgctgaggaggtgaagcaggtggctcaaagagcaagggataacagcttaaaacctgaagattatgaggtatatggatcgcatggtagctaatataagcatgagacaacatcatttttccttgaaaattctggtgcttttcagggaggcacattcaccatatcaaacctaggaggtcctttcggaatcaaacaattctgtgccatcataaatcctcctcagtcagcaatcttggccattggtactggtaagtcatgctaatatgtttgtgtaataataacggtagcatcctgtattatctgcatttctttctagtatcttttgagaagcatattatctttgttgccccatcctattatttttaagtcgggcttctactcagaaatttggcatgatgttacagagtgccaactgcttagtagcatttagccttttataaacagggcttaagcatagaattcaaggtgtagtagagtagtatcctttcgcttctgtattctacgtttctacattctagataaacttctgctaagaaggtccattcacgttgcagtgttcttgtgatgattacatagggtgtcattatttacttaatggccttttttttgtttggacagctgagaagagggtgatacctggcagcgtagacggccagtatgagtttggttccttcatgtcggcaacaatgagctgtgatcacagggttattgatggtatactcttaagccttatctgaatacatgatagttctacggaccataggctagaaaataactttgttcatgtgtgctttctctaggtgctatcggcgcagaatttctgaaagcattcaagggctatatcgagaatccaaactcaatgttactgtgaagttaaagatcagcaaaactattcttctcatgtgctcgaataacgcagagtggtgctatctcattttgtataataccggcacggtgttctgtcaaggaggacccgaaaaccaagagcacataaccatagacagaatgacctggtttttggattaaaagctttttctgtttatcttttttttttttgtttgtttgtttcgttccagttatagtgggaattaggaggatcaacttacaagcatttttagcacctttttgtgggtttaccctcggcaagtgtgataactggagagagtaaattcccgggaaacaatgcagtatagcctgtatacgatttgtcccttttctttttccccttcatagtgcaaaaccaagaggcgcagaaggatctttcggaataaattggcaatcttggggagtatggcttatactgtttcttaagcttttgtgtagagaagtagattattggtcataataaatcatgcatttgcttatttcacatacatgtttgatgtgctggtttaattttgggcctttaatggagtacaataaaacaaaaggaagcttgttaagaaagaatatgcctgtgtgttcttctcctccaagtcactgattttcttttttggctgcccatgggaagtttgatcgtgtattgtctgcttggtcggtgcattgttattttcttccacgtgagttggcacaagtgcgtctcatatttcttgacctactcctatgtgcgttgattggttgtcattctttgaagctgcaggaccgagaaggtaagacgaatcttgtccctcgcagtatgcatttcagcgttcttatggaagaagcttctaatcaaaaggaaatgaatcgctctagtaatcccaaatccaacacgcaattctgaacgtcaaatggaacggaatgctagaaagcgaagggagactagaaggtcaaaaacttggaaaaaggaggagatgaaaaatggaaccgatttcataaggagctgagcttttcatagctccgcttttgataatttcgatagcatagcataattatcctccaagaaacgccggaagcaagagcaaaaccagcaaacggccaccggttccaggacagggttgcttccgggaaagatgcatgatgcacagttttccatcaacatccgtaccaaattaagtgtttctttgacagcgtgccagatttggatcggtcattcgttgcggaaagtagtaccaatgacttactgctactattaatctactactgtttcgcttaagtataggtaaaggaaatgtaaccctatttcgagaaaatatattagtggtagataggatagctaggagatccaaagagcagaatggtatactgcattagatatatccaatgtgccacgatgagtggtttttctttatctgtttgtactaatttgcgcacttttgaccgataagcgggccggcatctttttaaatagagaaacacgcgatatgatgataggcagtgagatttcttcacaaatactgtacagaacagtagagcagtagtagtagggcacaaattgatggaatcaacttagcaacctttgtagaccgtcgtcaattttacaagggagagatatagtagaatgcgggtacaacagttcatgctgtgttgagttatatattgtttttgggtttgtgattaaacagtgtaacaacacggaaaggttcaagacgagcaaacacgtcagcatgtacaaacgcagtgtatgagttaattaattatatggttagcgtgtatcgacattctcgataccagtttaaaatatgtgatgatattattagaccttgcacccctataaattagggccggtgaacaaaaccatcaacgccttagtttttgattttgaagaagaaattgttgtcagcatcattagatcttgtgtgagtatatttgagagtcaaatcagcatgagcggtttggaaaaccgccgtctgtagtgtagcggttttgtctccagagcgacctcttctctataaagaggaggagaacttccatggaatgagccacaaaaccaccatcgatcatttccatttccattttcaggagagatccacatcgccgttggcctttcatccagtgagtgagggagggagatctcgatctcggtctcgcgacatgaagaaggcttcgtctctgtcggagctggggttcgacgcggagggcgcgtcgtcggggttcttccgtccggtggcggacggcgggtcgacgccgacgtcgcaccggcgtcggctgacgaagatatcggtgatcggcgcgggcaacgtggggatggcgatcgcgcagaccatcctgacccgggacatggcggacgagatcgcgctggtggacgcggtgccggacaagctgcgcggggagatgctggacctgcagcacgcggcggcgttcctcccccgcgtccgcctcgtctccgacaccgacctggccgtcacgcgcggctccgacctggccatcgtcacggccggcgcgcgccagatccccggggagagccgcctgaacctgctgcagcggaacgtggcgctgttccggaagatcgtgccggcgctggcggagcactcgccggaggcgctgctgctgatcgtctccaaccccgtcgacgtgctgacgtacgtggcgtggaagctgtcggggttcccggcgagccgcgtcatcggctccggcaccaacctcgactcctccaggttccgcttcctcctcgccgagcacctccaggtcaacgcccaggatgtccaggtcaacaccttacccctctctctctctcctccactgccattgccattgcccattgtccattggccattgttgctgtctctctctctctctctgcgacaaagtgacatgtggtgtggggcctagctaaagcatatggttggctgagtggtggtgtcactgcccacccacatgtgatgacatggcagcctttagcctttatcctatttccatggatgactagcttcctgcacacatgtgacaagagcgaacacatgcttctgacaacttgataaaagcccaaagatgcttagttagtgctgatatgatattattaagattcaactgaatagaatcgaatgccttgggttgatgctcctagctactactatatgtggaataatacaacttaggatccgcatacgggagaacgttttggctaaaatttccaacaagacaaagttattatcatttgactaatcgaatattagtaactacaaattttaaaattagttttttatatataaaatcaaattgcgcgcctagcatcattatattttctatcatataatagcatatatgttttctcactatattattcaaatatattaaaatgacaacataattttaaattttgcaatatgtgtaatattcatattatattttatatacatgttagttattaattatttttaatatcaaattttagttatttataaattgtatatattcctatatggactctagactcgtcttttaatatttcctttttttaattccgaattttctgtaaattgtatttctatatagactctatgctcttcttccaatattatttatttttatttctgaattttcatattatattttatatacttgttagttattaatatcaaattttagttatttgtaaattatatatattcctatatggactctagactcgtcttttaatatttcttttttaaattccgaactttttgtaaattgtatttctatatagactatgctttttttttcaatattatttatttttatttctgaatttttattatttctaattgtatttctatgtggactctaaactcatctttcaatattcttcaatttttaatttcgaatttcagttactaataaattgtattcttatattgaccttaaactcttcttcccatatttttcttaatttcgaattttagttatttgtaaattgtattttttatacagactctagactctacttttaattttattatgtttattccaaattttagttagttttaaattcctatatggactctatactctacttctagtatttcttttttaaattccgaatttctattttttttcttaattgtatttctatatggactctatcctctacttctaatattccttatttttaatttcaaatttctattatttcataattgtatttctatatggactctatactctacttctaatatttcttgtttttaattccgaatttcagttatttcctaattgtatttctatatggactctatactctacttctaatattccttatttttaattccgaatttcagttattttctaattgtatttctatatggactctagtctcttcttctaatattccttattttttaattccgaatttcagttatttcctaattgtatttctatatggactctagtctcctcttctaatattccttattttttaattccgaatttcagctatttctaaattgtatttctatatggactctgctttttctttttctccgattaatgtgagaatttctaagccatgagagcgaatgtggaagctcctttttctattcctttaattatataatagataatttgtatataggaaacttttgcatcaaatacaccatttactagctaaaaatgagttggtccctctttaagaaacgaaacgcagctccagcattaaacaaatggagagaataaatcttagaatgactatcagaaagaacagtctaatctattatgatgtaatacggcatttttattattgaaccaaccagagagaaagatgtgaaggtgcatcagtagtgattaacactgaatagttacggggggaaaaagtccattttaaattgggcctaacatttcatcgctccacgattaattaaatagtggtgatattagggttctattgaacaattaatcatagtgctaattactattgactagacattattagtgacatgttagttgaggaaattgacaaaataatgaatgaaaaataaaaaaatgcaggcgtacatggtgggagagcacggggacagctcggtggcgatatggtcgagcatgagcgtggccgggatgccggtgctcaagtcgctgcgggagagccaccagagcttcgacgaggaggccctggagggaatccggcgagcggtggtggacagcgcgtacgaggtgatcagcctcaagggctacacctcctgggccatcggctactccgtcgccagcctcgccgcctccctcctccgcgaccagcaccgcatccaccccgtctccgtcctcgcctccggcttccacggcatcccccaagaccacgaggtcttcctcagcctccccgcccgcctcggccgcgccggcgtcctcggcgtcgccgagatggagctcaccgaggaggaggcccgccgcctccgccgctccgccaagacgctctgggagaactgccagctgctcgacctctaataaatcttattattatcatcgtcgtcgtcgtctcgtcacggaattaattaaagtacctactccgtacttagctagctacaataataaggattcattgatcactacaagagtgatcgactcgactgtagtatgtgtgtgcaatataatgtgctgtctatcaacaactactagtattgtcatttttttcgaaccagggaactttttaatgataagaagaaaaagacaagtacttattgtcgagcactcgtggacaacactgtgattgattgccttgatcaatcttaccaatttttggtagctgtaaataatttacatagtttgttggggcggatgagcaagcaagcaagctgaatgggctgttgatccggacgaacgagccgcgcattccttgcttaattaatgggctgtcagtgggcgaacgaacttggtggggcggacgtcaatcttttggcccaaaatttcatgacaagtgcagtgcggtggaaggaaaggagttgggccaggccggtaggattatttatgatgggctgggccggaaaaggcagcgatgatatagagcgggctgggcctcccaatggctagcaactcttcataggagaagaatcgtgcaacaatacacgcccaagagaagaaaccgcggcatggaaggaacaaatcgtggtgcgctctctgcgtctgcgtgtgcgcatggcatcgtgcagtccacaggacaggagacggcggatcgcaagacatccgcgccgcatcgggattccatcctttccctcatgtatactatctccgttccaaaataagtgtagccataaatatccgtgtttagcagtttaaccatccgtcttatttaaaaaatattaaaaaaattagtcatacataaagtactatttatattttatcatctaataacaacaaaaatactaatcataaacttttttcaaataagacgaacggtgaaacgttaaacatgaataaagctaaaacagtacttattttagaacggagggatcagtactctgcgtgagtgctcgtggcgtgctggttggaaacgaccattgactgattacgtgctacacgtggcagacagacatgtgggccctccccactcccttccatgcttcagcttcacacgatcgatcgatcgatggagatgcggcgatagttgcgctcctcctcattcacagtccacactgccatcagccatggggggcagccaccacctcttccgcttcctcgccgccgacgaccaccctttcttccccaccttcccaacctcctcctcctccttcctcctcgacgacacccacccatttttcttccctccctcctcctcatgcccactcggtttcacctctcctccttcatcgtcttgcccactcggcttcacctcctcctacgacctcgacgccgccttccaccaccatctcgacctcgacctcgaccttgacctcttcctcccaaccccgaccccacctgtaaccacctcctgccccgccctccgcgatcccttccttctccaccactccctcgcccaccgcgtctccgcgcttgagctcgccgccccacgcagcaagtacacctacgaggccgaatccgccggcaggaagatcaagtggaccacccacgacaagcccgacggcgaccggaccttcaagtgggaggcccagatcgacacccccaacgacgatggcttcgaccgcaagtggaagtgggagtccaaggcctccgccgccggcaccaccaagctcaagtgggccaaggaggtcaagggcaagggcttcctccacccatggtcgcacgcctactccgtcgaggaggtcttcggggacgacgaccaccaccacaaggcagacaagacagcagaaaacaaggtcaagcagcacaacaaggatacttctgccaaggaggagaagaagaagacgaacaagtctaatgttcagatcgttgagatcgacgacaacactgccggatgcgtcgccatcaacaaggtcacatcttctcctctacatttatttcattatttatttattcaattggacttggtcctagatttttcctattcagagtttcagatctaggagtagcagcttgttatctcaagcttgcgacgtgaggtttgcgcaccgatttgcacaaatccgtcatgtttctgatatgcaaagatctaatatacggagtacttaactactactccctccgtcgttttgactttaagattatggacaaacataataatatttacagtactaagttagttccatcaaaccaataattaaatatattttcataataattttgttttgggttaaaaatgttactacctttttctataaacttgatcaaatttaaatagtttgacttttaccaaagtcaaaacaacttataaactgaaacggaggtgtatttccgatggcattttgtaagggaagccatacccataaatgtgattagcaattgctagtaacagatagtagatcgtcaattttcgtgtgcgctgtactgacaacacaacactggttttctcaaggcgtttgcaagcagctacgccaagggcaagagaaagcagctgtccccgcaggatgctgcattgttgatccagatgaactaccgggctcacctagcccaccgctcgcaagtgctgcgctgcctccgtcatctggcggtggccaaggccaagctcaaggacattaggtccttgttctacaacatctcttaccgccgccgcatttcgcatgactctgaagagcgtcagaggtttgccgacaaaatcattgccctgctcgccactgttgatgcccttgaggtattaagctcatcaccctttctgatcatgccgtttttcattaacaagtggcccccatcaaaattttgcattccagacaatttcttcttgttatatagttatttttatttattactatgggtgacgattggtaaccatgccaatgcatgtgttgttatttacgcgtttatcagcaatgttgtttactaccaaacgttatttgattgatgaaatcatcagtgtagacatgacagtaaaccacacccaattttcttccgatagtctagtttagggtcctgactgaatttatggatatcaatacctgcaacaacatggctctcatacagtacttccatgtaagataatctaggtgtaagtgaagaaggatgaaaacaccagaaaaatattttctagctttcttcttcccccaattcttcatcagaataaactctaaacaataacacatttgttgatagctacgtgagggtagtttcttaaaaagaaaagaaaaagcatctaacagccataaaaaaacaaagaatactgtacatatatattgttttatcatgggctctataaattggaagattaagtgccatgaaatgctttgatcttttgccatgtgtgaatgttttgtgcttacagggaccagactatatggttcgcaatgcaaagaggtctatgctggaggagctggaggggatgctagagatcgtaggtcctcagtcactagggaagccaaggactctgagccgcagaaagtttgagaaccatatctaatgatatgaggactggtgtcaagggcaagtgaaaggcaccatcggttctatttcgtagtgcggcgtatgaagatgcttgatgggggacctacctttctgaatgtgtttacggtttagacagaatgttgtgtctgtaactctagttgtatgatctatcttctgcttgaactagtacttatgtgttgctagactagttagagcttctttataacctcttgttgtttgaggaagcttcttgtagaaactgtttcataatttgtcatgaaatgatgtgcggcatgtgccccctaataaataagaccattaccatatggtatgcatattggcatggtgcttttcaaccgatgcatctaaccgtgcggcgtgttgccaagcctccgcgttaccggccacatccaatacggataactgcaaaaaaaaaaaaatgctaaccgattgggagaggcaatgatggaattttttggtattccgggtcgttgttgtgttcaatatgtgaagcatcccgttcctctcaggcaaagaaagttccaattcaactggcaagcactgcaggtgactgctgaaacccccatatgttggtgtgtgccgtgctcatggttatcttgtgccgctttaagtttctgtagaaggtttgcgtgatgtcattgcatgcactgggggctgtacttatactgatctaattgtaagtttgtatattataccatattcatcaggctatgttcaagtttgtaccacttagggtgtgtttgaggattggggagattggggagattggggagattgggaagatacgcaaaacgaggtgagccattagcacatgattaattgagtattaactattttaaacttcaaaaatggattaatatgattttttaaagcaactttcctatagaatttttttgcaaaaaacgcaccgtttagtagtttgggaagcgtgcgcgcggaaaacgaggtgttttctctctcaatctccctcaatgtcctccaaacgaacgctgccttaggttgtatttctcattgatcagtatattgacatcgaagtatgattctttgtattttggtaaccctgtgcacatgttaacgagcgcggcgtgcttatacttcttgtaatataaatgcttgactccgcccgccccaatcgatcccgagctcgagcaccttggtcacccatcccgttgtttccccactctgttccaagctggtccttccggagcttcgagtctctgccttggcttgggccaccactccataatttttttttagataatggaatgaaacattcctacctttgctcattagagctaaagccaaccacttcctccctacattccattttccacatttatttaactggccgattgcaccatccccatccacccccacgtctcttctacatctccctcccggacccaaccaccttccttcctattccttccacccccaagacccatggcctcctccccgccgtgacgtttaactatttattactcctagtctatgatatgtggatggatgatcttatggttaacatatactatcatctatttaaatgcatattacaactaagataagttaagacatcttccgccttcccgcagcagaggagcatcatccaaaggcaagggaatgacagcgcgtgcaaggctccacaagagtcagggttgttataggtgaaactttatcctcgatgtaccttcgtacagcaatggcagctcttgcggattccttgagcacagcgttgctaacaggccagcaaatcttcccattactttccccacaacacctatcatcaccacctctaagtgtgtccaacacaagacgctcaagtgagactgcggccttgacgatgccacatgttagctcaaccaagctctttgcggagttgaaccctaagatcttcacgctcttgaggcagtcatggctgagctcgggcagctgcctcaaatgtggggaagaactttcaataatcgattcatgtgccatatcgtcctgacaaacctggaggtgataaaaaggaagattatatatgaatgaatcaatggtccatccgacagatatctttctttgcaggatggaataatggatgaacagcacagccttacatccaagtataaagtctccaaggaaggagatgcatcgacgaaagaaaccagaaagaaataatcataggatggggaaaaggtccctcccgcaatctgaattgttaggtgcttgaggtagaggaatttggtaggcaacattggtatattaaccgcctgcacaacaaatgcattgtcacatgcagaatatttctactgtcatatgcatatgtatagctactatatatgcagggtcttagaacatacctcagagtccgaacctaattccatagtctcaaggagggcgataggcaactagttttgtaaatttttcaaatagaaaattatttcttgttaacaaccaaatttggtaacatctgtgtcaggaaagaagattggatcaaagcgaagtcggaggcgaagatcgagttcggaaacagagtaggaatcggctggagtccagatcggctatgattaggatcggctgggtctgagtcgggctaggtaagccgatacagccgattccgacaatacgacttgtgtacgacatcgggttcaagttaatgtgcttcaagatgattgccacgcatggatagagtcctgggaaggcaattgtatctattaattaagatattttatgtagattccttatagataaatgtgggcaaaagtctgccgcaaagacttatggtatcttagagtttgtaagagataatagtcatgtccggtatgggcatatcttgtaattctcgggtataaatagaccctgagccctatgtaattgataacacacacgttcaatacaatttcggcgcatcgccaccctttttgctttagttttgtttcgacgagttcttgcttttgggttgagctgcatcggtttcgatcttcaacaagaggtaaaacttgttatgatgacttgtattctcgggattagtgcttccatctttatgatactctaatcttatttatataattcgtcgagttatcatatatcttacataatctctagcaatatcgccatctaacctactatcggttaacatctgttagcagagggcaaccgattaggttagattttgacgttgatctagattatataagatatctaccactctatgaaacttctagcggcttgattgtctagatatcgttcttcatttcatacttaatgttgtatcagttaagtttgatctgttaagtcgtgcttagaatatcgatctctagcctgccttctagttgccgattagaatagcatcggagtttcagccgatcttatccgatttaactatatttgttatatatgctttattgacatgttaaatctgctctttatatcaagatattgttgtatctaagtatgttaggcctttgtttgatatattatacatgctttaatatcctgatatagagtagtatcagagtattagccgatacatgttagatctatttgatcggctacgctataaacatatatagtcctgttattgatatatatttcaatctaagtgatttatactgtctcggcatggtgactgatctatcccaatcatttgatttaagtatatatcgatataaggagtatatatcgttaatatctacagccgatcgagtagatttagttcttctttacttattcatgtctgccgatcgatacacagatgacatcggctcaaaggtaaatgatatgtcatcggcatctagccgatcggctatcatttatagatttaaccacggtttctttgcttctatttcttgttgattacaggatcaaatcaactggcacgctaacacacctgaaggtgagctttggacctgcactggagttaagcagatctcccgggccacgtgttttctgtcaacacttttgtaaatatttcaataaataaaattaaaaattaaaaaaaaaatcacaactagtgcaccaactgcatgtggacaggagggagtatgtagtatacatgtagattgtgaatggcggttggaccgcccggctcaccggtcggacaagtggaccgctgaaacgagagttcgtccgggtcatccatcggtccggctttttttactaaggtttaaagggcgaaaatccgattcgttgtaaaattaagggatctcagatgaacttataccatttcttgaaatccggggcgggctggcgtggattctacccggcctgctcccttacttcggccccatatactaccagcccacgaggcccatgcatccactcttccagaaacttccggacttccagagtcttcgacacggatagcgcctcctcccagtcccatcgcacaacgaccgttggattgttgagccacggatcgcgcgttgatccgagcaatctgaactgttgctgcgccacggattcgttcgctgtctcaaattcattttcagatttcccgctccccggttcaaaatattcagcccaatttctagtataaatacccggcacaagtagggaatcaatcgcccccaattcgatcgagagagagagaaatggctctccagctgagcggtctcgccgaagtcgtgcgcgaggtcggcgtcgccccgggcccccgccgcgtcgtcatcatctccgacatccaggcaggcgacgctgctgtcatcgacgagttaatggcgatccagctcggtgtcgatgcgtcctgggaattcgtcaacagggagcggctcaggaggatggggcgcacctacaacctgctcaagatggtggaagcggttctcccaggcctcatcgacgacccctaccacgcctccgacttcctccgcgacatggagcataaaatcaggacccgcgctactttctccggtgtctccttccgcgtcctcgccgtcgagttctgcaacctcctgcgcgactacaacgaccgcatcatcgctgatcctcccgtctctacccgcgaggagctccaggaccacatcaacgagctcatcgcccaactcgatgaccttctgcaccagacctgcacgctgcgccaagatgacccggttccatgaaggcaagcggaaagttcatgtgaggaggtcccgatcgtacctagttgttcatctgatctgatggtagttacagtagcagtagtagtcaagtagtcgaatcagcatgttaatcctgtttgaaggagcaagtagcagcgagtaatgtcactagtagtacagcacagcacagcaacacaagtatatgaggatgtacccgcacaaccacagtatagacaagtgtgaaatatatggaaccaccataagttggtttgaatttgttctcaatcgtgttgcctgcttggtttcagttcgttggtggcaagtcatctctcttctgaatcttcttgtgaagttgttttctgaatcttgctgtgaaattgttttttctgaatcctggtggtggcaaatcgtccgtcttctgaatcttcttttcccctagcttctgttctgtccggtttgtgtacacagatctggttcgcgtcttttcacccaaatttttagatgtttctgtctgtgtatagaatcgtccggtcgattgtgtttcagtttcttgcaggattagtctgctggccaccgtgctctctgctagcttgtggtagtaaatcctttctcctaccttgatggttttttttctcgcacacatcgattctgatttcctccggttttttgctcgttcctccgatgtaggcgtcccccgccctcttcctggcaggggctttggagcggtagagatgcagttccaagtccttccccggcaacccgatctgccatgtgccacaacacctagtaagtggaatatgttttgattgccttgtgccagattataatgagaatgagaaaggtgacaattacttctgctgtttgcctccctcctgattcacagtttcatactagtatttagcaagtttttctctgtgttttacttaatgagattgctgtttgggttgtggactttagtattgtttctgctagttaatacatatcctgcagtcttcagtctaaccacctacttcatttgcttgcttgtctggaagggaaacacttggttgcattactgtgtagattatgtcagatggttctctagctgcagttactatagtaaaattgatcatcctctgaatcattgcaggtgggaggtggcatgaatatcaaatctgattgtgacgaaccatccccgtatgctgctattcttgcttctcaatactatgttgtactgttgtttcaagatttgtatgcaggcattgttcttgcgtaggacaaacggacatatcttgggttacctatttttggaattctgttgagtttgaactaacatattgccttgctgtacgttgagaacaatttgttttgctcatatacaagtttcaccactagtatgtcttgattgccgtatgttttgattataatgaggatgaaaaggtgacaattacttctgctgtttgaagagagctctaaacacatgatagatgtgccttttgattcacggtttcatgtttagcacgctctcgatcgatgatgtaggaaggtttatttgtgtttacttgatgaggagcaggaacatttcttacattttgctggttgggatgtggattggtaacgtgttcagttttcctactgggcagttgcatgggatgttttggcatgaaattgattttgacacaacttgtaattgttgtgtactctctccgtcccaaaaaaaacccaatcctgggtttgaactccaggttcaaacctaggattgggttccaggttcaaacctaggattgggttttttttgggacggagggagtagtagctatagtcagtttttcctcacttaatagctatagtaaaatactcaagaggaagtccagggagcccaaggtggggaatgatactcttcgacccactgaccgtgaaggagagtactatactacgtgcatgtttggagttgctcatatcttcgcatccttcaaatgacacattcattttaactactgttttggccagctactagtactaattcctgcagtctccagtctaaccacctattcactgacttgtcaggatggcattactgtgtacttctagattattttggttggttctctagctgaaattgatcatcctctgaattattgcaggtgggaggtggcatgaagatcaaagctgattgtgatgagtcatccccatatgcagctatgcttgtttctcaagatgttgcactgtgttgcaaggtttgtatgcagacattgttcttgcgtggagtataggacaaatggacagatcttgggtgactgttttctggaattctgtctcattatgctctgtgcggctggaggcaacaagacaaacacacctggacctgatgctcaatctgctctcagggctcttgctcttgctcggtctgggatgaatattggtcgcattggtaagctcagagtttcaaatactagttgatgctgacacaatcgaaggatacggaaatgttgttgatgctgtgcacaatacttgcagaaagggaggtagtagtagggaggaggctgtgtcgtaggccatttatcgccatggacatggagagtatctcctctttggatagtcgctccaaagcttcccgaagagagagtttcgctcattgtcctgaatttctgactgtcacttaatttggccactctgttttggttaaggaaatatcaagttttcatgcttaacaagacccaatctagtataccttggtggttccatataatatggttggattgttttatgagtttgtgccatctactgtatgagtttgtgtcagtttatcttttgtgagcataatataagtgtgatcttgttggctgcatgatttctggggtacagcttagaagttactcctatttactgtacttagatggatggttggttgtgctgttgaatcacttgtggagtagtagtacttaaattttaacatgttgcatttgcatggagttttgtcagggttcagttgcatttgaagagaatgtacgggtgatcatgttgcatttgtcagggtccagatcacaacttttgctggtgtgctgtcctgatctggtttcatgtgatttgttgaatgatgatggacctgtgtgttgaatacgtagtaggagtaagtactactccttgctgcaattttacaccattgtcgaatttatgatgatgcttgactgaaatttcagacgtctcaaggagggataggcaggggcgcagggccttttaccattgaggttacttgggccatggcaactagtaccactatgggcagtgtggctacaacatgtatcttcagattttttgtgttggccttatcatagcatgctgctctgctctgctctgacgttaaacaagggctacgagcaggcttccctgaaagaccagagaatttgagttcattggtatattcgacaagggaacaatttattggtatattcgaccaacaaattcatttattcatattgttctatcagtgtaaaagtcgaagaatattgttctactagtgtctgtcaaaagcctagccgagcttgagcttggatcaagaagctaagctcattgctactccatccgttctaaaatgtaagagattttagttgaataagacacattctaacgtccatcctaaaatgtaagagattttagttgaatgagacacattctaagttcctgtgtagaatcataatattaggatatatatcatccaatcaaaatcataatattatgatatatctcatacaatcaaaagcctttctattttaggacggaggaagtagctctcaaatgtatatatgaagatgcgtcttggccctatataaattttatgcacataaaactaagcaagaaaacattgcactgcaaccatgacatacggagtatatagtaaaagcagttcccacttgcgatttaagaacgcaccaacgacgacatgactcccaactgggagctggaaacttaaactgaaaactcagttttcaattcctcagcaaacgaacaggtccaaataatccaagaaacaaagcatggtttatctataatttgattaaagcgacaacattgtgcatttcagatagcttatcgcatagtcttaagaaaataataagggatagttaaagatgaaactacaaagatcttatgactaacatatactatcatttattgaaatacatatcacaactaagataagttatgacatcttccaccttccagcagcatagggatcatccaaaggcaagggaatgacagcgtgtgcaagtccccacaagagtcagagttgttgtaggtgcaactttatcctcgatgtaccttcgtacagcaatggcagctcttgcggattccttgagcacagcgttgctaacaggccagcaaatcttcccattactttccccagaacacctatcaccacctctaagtgtgtccaacacaagacgctcaagtgaggcagcggctttgacaatgcaacatgttagctcaaccaagctcttcgcggagttgaaccctatgatctccacactcttcaggcattcatggctgagctcgggcagctgcctcaaatgtgcggaagaatcttcaacaatcgattcatgcctcatatcttcctgaaaaacctggaggtgaacaattaaagaatatgaatcaatggcccagcagatatatatatgcaggatgttgaacagggtggcccttacatccaagtataaagtctccaaggaaggagacgcgtgaaggaaagaaaccagaaagaaataatcataggatggggaaaaggtccctcgcgcaatctgaatggtcaggtgcttgaggcagaggaatttggtaggcagcattggtatattgactgcctgcacaagaaatacattgtcacgtgcagattatttctactgtcatctatagctactatgcagcacataaaatcttagaacatacctcagagtctgaacttaataccatactctcaagatttggcataatggatggaagctgagcacgagcatagcacacgacattcggtcggatcatggacaagaccttcattgtcagtgtttctccaagtgagaacttgatccctccactaagggaaatactggacaaattcggagcttcacacacaatcacttgcatcctgcggcatgccataacactcaggcagctgagatgctgcagcacacacggtatcttcaggaaacttatcttgttgcatacattaagtctcaactgctccaaaacaagggagttcaaaagaagggactctaactcgtcacctgtaatatgcacaccacacagatgcagttttgttaggcttctcaaggggccaagttcagccatgggatggaaggcacagaaggtaagctgaagacatcgaattgagtctcgaacaccatcagataaaagtgagcatgcaaagatgtactttttatgtagcgtaagagtgagctcttcaatccctggtgtaacagcaacctcaagccatctatcaatgtaaggatatgtactgtcctcatcagctacattaagcttcaatatcttcgcagtgcccaagtggtttctcagaatgctgtcaattttgcacttgaaatttcccctagatgtcctcgggcaaagtgttttgaaattcaagctgaggttgggatgaaatctccaggaattcagaaaggaatgagaaaggcaagcagcacgagcagcagcactcatcggcattaaggaatgtatgtgacgccagatgtcctgcatccataagcatgggataaaatctcaaattaaggccaaatggaattacaacaagagaaaaaaaaagaacaggagaaccacatggagtatctctgccccaggttgctctctatatgattgcacaaggtgcaggatggtgcaattgattgtagtccatgatataagtttatgtgcatttgttcaaccaaaatgcacatcgatgattagtttattgtgcaatagcatattataaatagatcagtatagcaaagaaacataaatttgtaacttcagcacagggtgtaagcagaatctcgtgaaactagaagtcttgacatgtttattgtaagatagacataaaccttgctaaatgcaatgaaaaatataacatattgaaaaaaccatataaaaggacatcatgaaagcagttcaacctgtcatttcgtatggatttaggtagcaaaataaaaacatcaatgcctagcatgaatagtgaagccaaaagaaatagggatcactatttttatagactgaatatgtcaattaatgcttgtaagaacttggatacagcaacatttcagtatcatcactgcagtaaagcatcatatgcctatgtaagtaatcaaaactggatatttttcatattcgtcttaaatgaatatgcatgattgacatgattaggcctgctcaaacttataatgaaatcattcatacttaggcatggctcccaattgcttatatcaggagggagcacatgttacagttgttggacttaagaggaaaatgcaactactgatgcatgccacgccttatggccattgcccaacattaaaaaaaaaaaaaacaaagcaactacgcatcttattaggctgggccttctaagagagctagaaatagtcctaaatgtatggtaagtgcagcgatacagaggtagctgacaatattttgacatattctgtggttaaagatgtgtttaaagacatactgatgggaaaagatgaaagccgtttcaatatgtttaagaacaagcgttatattatattactgcttcctgaaagacttagacacagctgctacaataatggttcatctgcaaaggctagtaacatcagtcaaatagacagcccacaagtgagagatcctagggtgtatgattatactatatatttttatcaggagtaccatgaaagaatcaacagtcatgtctcattatcagtagatatgctcaggctctggcctggaggactagtgagaaaagaatggaatgcatacggataataagaacgcaatgaagatattgccagcctttgaacaatgaccataaataataattcactaggagtttaggacaatgttcgattgcatatatattttgtgactataaataataatcaactagcgcagtggggtgaattaggatgattaaagcagttaaagcttacaatctaagcttgcgtcagaattttacagtgctgttagcatacctcaggaaggtacgggagtgaataaatcagtgaatcgccatggccaacttgttcagagggggagttattagtgctacccactgtacaattcgatttatctgcagctgaaccagcacgattataattataatagcccatcagactgacaagaacacattagagagagagagagagacaaacaacgtagggggctaccgaccaatggtttattgggataaaaagatcaagaatttttcaacgaataaatgcagatattatggggttaaaaggagctgaatcggtgacctaacctagcaaagcagcaacagttgaatgttgtgcaaattataattcggtatccatctaacattagtcaacatgaaccgattagcgaacaagaactgatccaggtgagacgaaccagagacagggctgggaggcaaagggagttgaggcttactcatgggcagggctggggctagggctaggttttgccaccgctgctcgcgttgcacggccacggaggacatggcagatggcattcaggacgacgataactctctctccccccttggcccttggatctcagactctcctacctatctatatagctcttctagtatgagagttctgtttctggtttcctctccaactcgttttttattcgattggagctggactttactatatgtcaaaacggattattagtaataaaaaacaattttatgagtctcaaatagaaactactgctacagcagagtccttaacgacttaaaaaaacaaatattcaaatagaaactactactacagcacgatggattgggcacgattaattaggttcagcccgacgggcgtcgtaggacagcccgcaatgtgcagacattcgtttaattaggttcgtcaaccagcaacaagactggattatttcacgtgaaaatatttacacaagcacatgagtactccctgtcccaaatcaaactaggaacaagagagggaaacctaccaagagagggaagaaaatacaaaattgcaaaaacaaaaaaaaaacaagagagcagtgaataggaaacagattgaaagctactagctcaagaacatgcaagagaactcatagattcagcagagccacaagcactaatattgctaaatgacatgtcaagtgattaacaacatcaaacagctacaatctttcttgaaaactacatcaaacagctacaatcctaacacagatcgacattgctcaactttgtgtaatatcatgattagaaaattctcaatctcactcttcgtagtatggtttaaattcgattccctgcgctgaagtataaattgatcggtcaatacacagcatatttgattgcacacatcaaacaaatcgcaggagtagagtggcacatcaaacaaatcttgaacacgaaccgaagaagaaggaggaaaaagaactgaccggccgtcgtcgctgctgcacaaggtgtggccggccaattggaactgcaactctcttccatggcagatctgccaatggagctcgaagtagttgcctgctcccacgccgatggagcccttagagctggaggcggcagcatgggcagcatcgcagcgatggacggcgttcgctgctggatggatgggcgacgagtaagtcggcgtcggtgacgagagtagcggcggctgcgttgccgtctcgctgcccagcgacgtctccccgtctagtgcaatcgtgccctaatgggccaaaaaattttgcaattcgcgggcatttttgtgggggcgggactgcgggccgcaaaaaaagcccgccccacttgcacccctagacacgatgcagaatcgctagagatggtaccatgacttcacggagacaaacagcatgctactccatccatcctcaatggcgaacaactgacacccagtaattaagctcgagtatacgagcttcgaatagagactaacagaacaatgatgcaacgggcaaacagaacagaagcaacgcgactatgaacaaaaaggccataggctgaatgctcaaaaccataccatctcagcaacaggcaaagacaatttggtttggaggttcttaaaaggcgccttaaataaggtaaacagtcgcattacagctagcagcaaacatgagttcgcgaattgatcaacataacattaggcaaaagagctcaaaaaaggatagtctggggcagatagttctatatccttgcaaacaactcgctatagcaaaactccaggcagacgcagcagcagattttaagcgttggcagcagcctgggcggcagcatcccgcttcctttgctcctcgatgatgctgagcttgatgcccttgcccttgggcaggctcacccaaggcttgttgcccttgccaatggtgaacacattgcccagacgggtggcgaattggtggcccagggcatcctcaacgtggatggtctcgaagctgcctttatgcttctccctgttcttgatcacaccaacacggcctgtgttccttcctccagtcaccatgacaacattgccaacatcaaacttgatgaagtcgacaatcttgttggtctccagatcgatcttgattgtgtcgtttgccttgatgatcgggtcagggtagcggatggtgcgaccatcataggtgttcaggtaggggattcccttctggccaaactgcacagaccgaaccttgcaaagcttgaactgtgcacagaaaaattagaatcagccagcattctaacttgaattaatacactcaaaagtaacggaatgcacaatgctacaatcagttcttctctagaggtaaactaaagaagcaattctcaataacagttcaatcaaagcaaaatatctttctcagcacaacataaatttcattatttcaaacagaataccttcatataacaagagtgtgttcagcaagaacagtaccaaaaattaatatgtcctaaccttagcatcctcatccttgacagactgaaggcggaaacgtcccttggtgtcgtacagaagcctgtagttctcaccagtcttggggatggaaatgacatctgccaaaaaagaatatgtttagcacaaagcaccaagtgtttttacatcatacactgaagcatatattgattgcaataacgattgagcatacccatgaaaccagctgggtaggtcttgtcagtcctgaccttgccatcaaccaagacatggcgctgcatgaggatagaaataacctcacggtatgtcagagcatacttgagcctgttcctgataatgaggatcagaggcaggcactccctggacttgtgaggaccagaagatggcttgggggcctatggtaaaaggtaattagaaatataagctatcaggtaacagaaaaaaaaaagataagcttcaagcatgtgtagttaagtgtaaacaagaatgacaaacttacaaaagctccaccaagcttgtcgagcatccaatgcttgggcgcattgagcctcttcagatgcttcttcaaaccccttgcctggtattacggtaagggaaaaggaaatgatcagcacaaataacaacataactgcagagtagcacgacatgaatacaatgacacaatgaaatcacaaggttatgaacagccctaacatcgctcatggcaatggtgcggcatggtttctaagtaatctttgttaattcttaacaaaaaaggaatctagacaccagaacctataatccttgaagccaggcagatatacaagttgaaccttggcacgtaacagaaatgtagaggaacaataacgcagcaaacagcacgagctaaaccctcaaactagcattgacagtacaattatacaaagcatactgaaaataacgagctgtctaagatcccacaaatgggcgacagccaaggatgcaatgtccaatcctagactctactactagaagcccaacattgtgcatagctgttcattctcgcgcaacgctgaaacataaccactaggaactgatccacaatctgaagccagccagcgagtacaaattcaacataacatgcgtttaaatcctaacaggctgtagcgtggtacaaagctatctactcaacatacgaatcctacacatcacaaagaaatctcatggaccaagagcaaaataaccaagccgactactaagctactacatcctagcaggccacgcgccgcacacgaactcccactcagggagagcggggaatggaactaatcccaccgaagctacgaacgagaaggatgccacagatcagccagatccgcagacgcgagagagcgcgcgggggggagaagcataggacggaggagagggggtagggggctcaccatggttgcgaggtcgggctaggtcgccgtgctctgccgccgccgcctgctgcttcgtcctcctctgctccgcgccgcgccgccgccgagatgacaagagtgggagagcgagggttggagaggctatatatactagttggtgtagggttttagttcaccggatttacgagtttgccctcccgctcccctcatgggcttccacgatttattccagaaattacggcccgttttaagaccctcatggctgaattcatggcccaagtagttagatcgggcctagtttggtcccgggttgcttggatcatttgcttctcggcccattagactcttacatggctgtgatgcatcgtgggctgtattcttgcagcttaggtgaagtgacagattttatccaataaatgggcccatgtaacacaattaagagcatgggccgaagtgcagggttgcagcttgttctttcggtgtactttttccttaagataagattacaagcctgaattttacagagcagcacaaaggcccagacctcaaccaaagagagcagaaactgaaatctctcaactctccaaagtagttgttgtctcttctacaaatacatcacacttttgattttaatttttgaaaggagctacatgccgtcgtgagttgtgagtataacaaactcacactttgacttgtataacaaagtcgtttttcatgccatctgaaaatgacattgcaacctgcatatctctagttatttacaacagttggttcacctttgattcaggcggttcaactaggtaggtccgtataggttttgttataactttttttttttgcggggaaacaaggatatattactcagaataggagttctcacaaagcaaatgtgagatagcaatacaagagtcatccggccagaagtaagttaaggattcacttcggcctttatttgctaagaaatgattaatgctattctgagtcctgtgcactttattaagtgcaatcacccttgttccagccatcggggaagattaaggggggaagaaggggcggacgctgggacgtgccacgtcggatttttgctacagtcctacagtaccggggctggtctttttgcgaaaaataagttcaatcacctcgttgactacgcacgcatcagcagacaataccttattcactgacttgatcagctggattgcttcttggcaatcggattcaacgacgatgggcagcagagtccattggagggccagggctattccatctctgcaagctagcagctctgtttctaaagctgatctgcagcgactaatgtggccacagcccaaaatttcctggtggccctcttaacagctggggcaacactcttgtcagctcaaaattcagtgcaatttctggagctgattttgagcaactacagactggcagtaggggttgcgttgaaggatattgagccgaaagacattgttcttggtcgatttcttgccctccaggtcacaacacgactgcatgtgccctgaaaatcgagacgttggtgttccttgttgttttctgcaatcattgcatgttatgttattgtggagattatggatatcccatatctacacggcgatgatatttgggctgaatataggataccgaatatagatagaatatcttatgtgtatcttgggtttgtttctcaacttgtgcatcaaggaaataccctgagacttagtcggtcacgactgtattttatatgtatctgcatattccgttagggatatagattgtcttttgtaacacggactcctccccatatataaggggggtccgggtgcctctaggggcatatgttgtttttccccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggttgcgtcaagcttttcgccgatcagtgcaatgggttccatctccggcatcgacgacctcgtcttcccacccgggcagacgtttcggttcggcagcctcgacttcgtcaccaacaacttcggcaagatctctctccttgactcggagtcggaccagtcgggagagaaccagatttcggccccgtttggactcccaaacgcggctgaaagttacttcaagaccatctcgaccgagtcggcttcaaaccactcgggcgagatcgcatcttcaccaacgtcaccagatcaagatgatggggcttacccaccgatcctgatgaagctccccgacgatttggcggccgtctccatcacgacagcgtctctttcccgtaggcctaggcggaagtcggcttcaacaccgatttcgcctagcttcagggaagttggcgtcatcctccaaccactcggcacggtttcgacggatcagctagatggcgactacagctctcctaccgtcgactcgcgccccaccgacatcgtggagtacgacgagtttagctctcgctaccacgacccggatctcgacgacttcgacggaagcctagatgacaactacacccctctctattttggcgtcttcatggccaataacgagacggaggagcaacgccaagcccgggagaccgaagcgcgtcgcgagactgaacgccgccgactggaagaggagcatcaagcacaagaacaagaacggttacggcatgagcagcaggagcgtgagcggaccgcgaaggaggctgaggatcgacggcagcgagctttggaagcaggacgccgggcgcgtgatctcatcggccagcaagatgttgaagggacgccgatttttcgcacccctcaacagaatgcggttgccgcgatcaccctcctcgacaccctactcagggaaagcgagctcaatcaatccgatcacgtcgtcaacatcttgaaccagacgaagactatgattgcggcttcggtcccagttaactccgaaagcgtccacacgccgactggcagccgagtcccccacttccgatctcatgactaccgtcatccaagcctcagcatcaccggcgcaggatccaatcgcaggagcaggggccacgacgagcggtctgttcactcacctcccgaccaccatagggagcgccgagtggaacggcctcgctcaccacctcgtcgccgccccgtcgatcttcgcgacacaatcatacagcgccgcgcagctcgaggctatcatcactcgccggaccgccacgacgatgaccttgacggagtagcagccttcaccgacgacctgcgtcgagtggactggccagccggcttcaagccgactggaatagagaagtacgatggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacaatcggatcttgggccgagttacgtgaccacttcatcgccaactttcaaggcaccttcgagcgtcccggcacacaatacgacctctacaacgtcattcagaagtccggagaatcccttcgagattacatccggcgattttctgaacagcgtaacaagatctccgacatcaccgacgacgtcatcatcgccgcattcaccaaagggattcgccacgaagaattggttggcaaattcgggcgtaagcctcccaggacagtcaagctcatgtttgaaaaagccaacgagtacgccaaagctgaagacgccgtcaccgcgtcaaagcagtcgggtcccagttggaagccaaaaaaggatacgccggcttcgggaggaggtggaagtaacaatcataaggaccgcaagcgtaagcctgcagaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactacacggaagaactccgacgaagaacaaagcacgtcgaggaagaaggacgacggcgacaccccggcaggttttcaagaccaccgcaaggagctcaaccatatcttcggcggccccctggcttatgagtctaaacggaagcaaaagttgaccgaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatccttttcgccaagaccttggatgatatgcagattcctcgctccgagttaaaaccaagcaatgcgccttttcacggcgtaattccaggattatccgcaactccactcggccagatcaccctcccggtcacttttggcactcgggaaaactttcgcacagagaatatcagcttcgaagtcgccgatttcgagacagcataccatgccatactcggacgcccggcattagccaagttcatggccgtcccgcactacacttacatgatgatgaagatgcctggtccccgaggagtcttatccctacggagtgacatcaagcaagccgtcacatgcgacaaggagagttgcgacatggcccaaacccgcgagatagcgtctgctcgagaggatatccgactggctgcagccacggcggacgaaggagaagtgcccgctaccaagacttcaaaaagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagacgccaagcctatcaaacaacgactccgccgattcgcacaagacaggaaggacgcgatcaaggaggaattaaccaagctgttagcagcaggcttcattaaagaagtccttcatcccgactggctggcaaacccagttctagttcggaagaaaacagggcaatggcgcatgtgtgttgattacactgacctcaacaaatcctgccctaaagatccttttgggttgcctcgcattgaccaggtagttgactcgaccgccggctgtgagcttctcagttttttggattgctactcggggtatcaccagatccgactgaaggaatccgactgcttgaagacttcattcatcacgcccttcggggcatactgctacgtcaccatgccatttggactcaaaaacgcaggagcaacttatcaacgtatgatccagagatgcttctcaacgcagattggccgcaacgttgaagcctatgtggatgatgtagtcgtcaagaccaagcaaaaggatgatttgatctcggatctggaagaaaccttcgcgagcatccgtgctttcaggatgaaattaaaccctgaaaagtgcaccttcggagtaccgtcagggaagctgcttggttttatggtgtctcatagaggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactaaagaaaacagatgatttccagtggggacctgaagcacagaaggccttcgaagatttcaagaaactcctcaccgagccaccggtcctagcctcaccacacccgcaggagccgttgttgctgtatgtatctgccacctcccaggttgtgagcactgtcttggtcgttgagcgtgagaaagaaggccatgtccagaaagtccagcgaccgatttattttgtcagcgaggtcctagccgactccaaaacgaggtaccctcaggttcagaagttgtcatatggtattttaatcactaccaggaagctatctcactactttcaaggtcacccggtaacggtggtcacatcatttccactcggtgatatactgcacaaccgcgaagcaaacggacggattgcaaagtgggctttggagttgatgtctttggacatatcattcaagccccgaatttcaatcaagtcccaagcgttagctgattttgtcgccgaatggaccgagttccaagaggatacccccgcggagaagatggagcactggaccatgcattttgacgggtcaaaaagactttccggcactggagcaggagtggttctaatttcaccaactggagaaagattaagctatgtactttggatacatttttcggcgtcccacaacgttgccgagtatgaggccctccttcatgggctgcggattgcaatttccctagggataaagcgtctaatagttagaggcgattcacagctggttgtcaaccaggttatgaaagagtggtcctgccttgatgacaatatgatggcatatcgacaagaggtacgcaaattggaagacaagttcgatggactcgagctaagtcatgttcttcgacataataatgaagccgccgacagacttgccaattttggatccaagcgcgaggtggcgccttccgatgttttcgtcgaacacctttatacgccgacggtacctcacaaagatactgctcaaattgcgggcactcatgacgtagctatgattgaagccgactggcgagatcccctcatacgatttttgacttctcaagaactcccttaagacaaagatgaagccgagcgggtttcaaggcggagcaaactttatgttatgcatgaagctgagttatacaagaaaagcccttcaggaattctgcaacgctgcgtatctttagaggaagggagacaattgctgaaagacatacattctgggatatgcggaaatcacgctgctgcacgcaccattgtcggcaaagcttaccggcagggttttttctggcctactgcagtgtccgacgccgacaaaattgtgcgcacgtgcgaaggttgccaattttttgccagacaaattcatttaccagctcaagagttgcaaactatcccgctgtcttggccgtttgcggtttgggggctcgacatggttggtccgtttaaaaaggcagtcggtggttacacgcatctctttgtggccattgataaattttccaagtggattgaagctaaaccggttgtcacaatcacagcagataatgctcgagacttcttcatcaatattgtgcatagatttggagtgcccaatcggattatcactgataatggcacacaagtcactggcggagtttttaaagacttttgtgaggactttggaattaagatttgctatgcctcagtggcacaccccatgagcaatggacaggtggagcgagccaatggcatgatacttcaagggattaaaacgcgtgtctttgaccggctaaaaccctatgccggcaaatgggtgcaacagctgccatcggtgctttggtctttgcgaactacacccagtagggccacaggccagtcaccttttttccttgtctatggggcagaagcaatgttgccgagtgaagttgaattcgaatctttgcgctttcgaaatttccgtgaagaacgctacgaagaggacagagtggatgacttgcaccggttggaagaagtccgtgaagcagctttgattcggtcggctcgatacttacaagggttgcggcgttatcataatcgcaatgttcgatcccgtgcctttttagtcggcgacctggttttgaggaaaattcaaactacacgggatcggcacaagttatctcctttatgggaggggccatttatcatctctgaagtcacccggccaggttcctatcgactcaagcgagaagatggtactctcgtcgacaactcttggaacattgaacatcttcgtcgtttctacgcttaagtttatcattgtacttccctatcttgactgtcaacatcaagttttcttcttgaagttgtcagtcgggggctattatcataataatggagtgtgattttttatcaattcaatttgcttacttggtttatcattgccttgttcgatttttctacttagtctgcgaggactgaaagtttttaatagcttctttgggttttaggctcaacaaagcttgataaaagcttttaagaaatcaaagatttggctggaactatcaagcacagcataaatacaccagtattgtacaaattgagcctccatttgttacattcatactcagtcagagtcagtcctttcatcatcagagttattgttgctcggctgaaggtcgttgttgtggaattgctctacaacgtcacttgcaatcttgtcagccgcattttgagcattgttgataagatcaagagcagcctcttcgcttgtcccgtctgcaaatccatcaatggtgtcgatttcaattctcgggtacaaggatttggtcatcgccaatgccatgctagctcccatacttccagctttcttgatgttcttgaaatatacatccggtgcaactctcagcttgtcaaagatttcggttgcgtcaagtgcactcggaccactgttattaaggaacatagcttggacaagtggtgtagcgacattggcaacttcatctcttgctccttcaagcctctggatcttaccaaccaggacgtcaaactgagcttgagatttgattttacggtctacaaaacacatttataataagaatctgctgcattaaaaagaggaaagttcagattgtcagctggcagtaccttcaacctccttcaaggccgagtccctttcagcagctagttctgttttgtcttttctcaaggcttcaatttgcttctccatttgagccatcctggtggcttgcgctgtttgaaatccaaatgtttgaggatccagttatgacagcataaatgggacagatctagagattaccttttgatgaaccactcagctcgtagtttgaatcctggagctgagcaattcgttcccttaattccttctccgttttcttggcatgctccttggcctcgtgtagctggctcctaacggcttcaagagttcccaaatgaggaaccagcttttctaaggttgtggtcttggcctcattgcgaagatggattctctgcacggtggttcatggattagttttgctaacgagaaaacaaagtcattaaaggcagtcacctagaagacttacattcacaatgcgagtagcttctccaagtactttcttcagctggcacacttcctcatcttctttttggcgatttatgacaatgccggaaacttgagagttctcgtcccaccatttgagtaagataggaggacgagagtcatcagctgcctttatgcggagaatttcttcttcgtcgccgcctagtggacctgatgtattcccaagacattagacgagtaagctggagttattcagaacggcatcacttgagaagatgagttacctgaggatgtgcctagctgagcgtgaggtgatccctgctctttatccggagacccaatcactgagtcattaccagcctctggtccttgagaagttgtcgcctgcgcttcagcttcaggaatctcttgatttagacctacatccgactggtttccagtcgggggctcttgggttgttgcagtttcagtagctgccgactggtttccagtcggcggctggtcactcggattggccttgtcatccgaagcatgggcgccagtcggctgactttcggcagtcggctggctttcggcagtcggctggttttcggcggtcggatcagcatctttggataaatttgactctgtggcagccggatcaggattttttccagttggatctatatcggacggtttcctgcaaagtgtcctttcggtattcagcgtaatttctatgagagaagcatgccgaaataaaatggtaccgagaagtttatacctggaagatgttctaatctttggcatttgacggccagccagttttttcctgggcatggtatgctttgggagtttattgggcgtgcccttgtccccagatttgttgctgtcatcgccttcgtcgtcattaagcaccagctttctcttgcgagaacctgtctgcccagccggtttggaggtttgaggttgcgggtctgacctgattgtcggccctccacttccctgaacggtgtgctggcgaggagatcggcgttgagcaattgggggatcagatttcatcaatacgtactcctgaatgagatgcttccacggttagctcactcaacatgaagataaaattatgttttggtcatgagttgaaggtttcagatacatacctgtggaggcggattgaatgcattatatggtacaactggcagctgatgtgagtagctgacgacaatagcatttgagaagattttatacattctctccttcatgattttaaagtccagagagtctgggtcttcacggtttggatcatgcttgccgtcaaactcgaatgctgtgcgggatctctctttgattggagctaatcgacacttaatgaaatgccgagtgatttgctctccctgtaagccttgctctttgagcttcagcatgcgttccatcagttctaaggcttgggcagcttcatctcccatgggaagagagttccaggtatcttggtatactgggggaagacaggagtactcaggaagagcgggctcgggattttgaatataaaaccagttggcgtgccatcctttgtttgaagtcttgaaaggcatagagaaatacttctggctcagagtgcccctcagttgaaatccagccccaccaactacgcatggtttgtttttgtttggttgaggcttaaggaaaaagattcggcggaacagagcaaaatgaggtctaatgcccaaaaaagcttcacagacatggacgaaatttgcaatatggactatggagttcggattcaaatgatgtaagctgattccatagaaattcagtatcccacggaagaactttgaggttggaagagcaaatccaccataaaagaaatgagagaagaccacggcctcgtgtgtatcgggggtcggaaaagcctcatcgcacgctggccgccacccgatgatctccttggcagggagaacgccgtgcgccaccatctccttcaggttctcctccgtcacgtcggacggcgcccattggccttcgaagctttctttctcttccgccattgattttccccgaatacgttgatttgattcgagggatggcttgggagagatgaggaattgaggcggtggatcacgggaaggattttgatcactttttgaaggtggatttgagtggaatggtgaaccctagtttgccggcgtagctctgtactgtagcaaggagtggggaaaatggcgagagttccggcggggaagacgaagtgtcgcttggatctcgggttttcttgttaagggtatcggaggtgcgaatgggcctaggcctgaatagtatctcagcccaatacttttaacagcgtggcccattgtgttccttagggacttaggcattttttgctttggcaatttatgtacacaatagtgttgcccaatgctgataaaatcctttttacgcggtcatataattctttggaattattgcaatgcaaattaaaaggtgcccgacagaaaggcgttatgctgtttttgtacgtttttttaggctacaaaagctgtctgggttaacttggaatgacttgtttttatcatagtcatttcctcggtatgttatatgcctgttttcattgtggtaaatagtcatagcctaggctattagacttattcattaccatgatttttataatatttggtgggtaatctttagagtcttatattcggatgcctgtcaagtgtgttcattcgtgaactttttagagtgttaaccacttggatttcttttattatggctaaaaagcagtcggctggaatgcctctttaggcgccgtgtatgcttttgtcatatgatgcataattatgctattattttgttctcaactatatgtttagtttgttaactaatcacatagttggaggctatacctaattaggtgcatctattcgatgcaccatattctttatcttttcgccctttacagtcttcgttttcgctactcggcaggccttggcatgaaaagtttgaagcactcggattattatctttgagcaggctatgatggttgactgcaaaggtctcgggggctactgtggagattatggatatcccatatctacacggcgatgatatttgggctgaatataggataccgaatatagatagaatatcttatgtgtatcttgggtttgtttctcaacttgtgcatcaaggaaataccctgagacttagtcggtcacgactatattttatatgtatctgcatattccgttagggatatagattgtcttttgtaacacggactcctccccatatataaggggggtccgggtgcctctaggggcatatgttgtttttccctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttatcttacacttaagatcgatcgaccgggcacacaggtatcgatcgatcgttctttaaacaattgcattattgggatcaattatttgggaaccatttctcggagaatctgtatatccgatacttaaagaaacagaattattggagatacacactcatagctaagctgctgacaatgcacaacaagtgtcaaacagaaacatccaacagcatctcgactctctctctccgatgactcggacagacactcaacttaacttccttgccctcagctgcttcatcaagctagtgacaatcagtttgctcgagctaattaagaaattgattagtccatttgggctactagctggcacctggcaacagcatgtgccaatcattaggctatgccaagaactcaaagctgctactagctcaaatcagtgtgctagctagctaaactccatgaccatgaccatgagagagtgagcttgtgatgggatgaggttagatgagaggaggagattccggatctccatgagtggtggggctgagcacagccaccagatagaattatttccttggggcctacagtgtcacttttggcccccaccccaccatggctagctgacatggcatctacaaatacagtacaatatatggcgccaacttcagatcagcctcaaactcaacatgtgatgaggatagattgctgatgtgctgtattgctattctagctctatcaatggcagtgctgttttgcaataatgttcatgaaccagaagatccagcagcttagctagctcaataatgctactagttctgaattgcctagctcgatctattggcggcattcactgttggtctactggctagggttgcttcttgtcatgcgagaggccacaatttcttgaagaaaaaaaaaagaacgaaccatccacgtggagtaaaaagcaacgacgacgctttcatcacacaagaggacatccttatttaatttgagaagcgaccattggaatgggtggaataaatcgtatacgttctacctgccaagatgcacgcgtgaatctcactctttaacattattattattattatactaatccacgtgtgttttgaataatgcagcaaaattttcaacaggtctgaaggtaacatatagccacgagtttggagaagatgaggggctgatgagatgtgatgtctagctgcaatcggcgacccatgagccagctgatatatcgctcatcataatcacattcatattaattaaatgactaattggcaggctactactccagttaatagaatgaatgaatcgtgttttttgatgccacgtcgagaccgaagtttgcattattgcaacacgacgtccgttagttaggcgcgtatatgtaactgtcagcacccatgccatatgccagcactttaccttcatctcatcagctttatatgcatcgaattgctgtcacaagtcacaacatcaactgctactatacatactagctagtaacatggatgtctgctaagagcatcccagcagctcattcaaatttgatcctccatatgctcatatggatgaccatctaaaaagattcctcattcatatttcttctcactccaacagatcatctatattgcatctttcatatcacacccttctatattttactaatatttttcaactaaccatacatttgtattattttttaaagactatattttaaacaactaaattttaaattttaaccgtgttatttatcctgataatttaaatgagtttattttaatgaatatatttttaatggtccggaccttttttttctcctcctctctactcgttttctttcctctttccgattcctcttcttctctcctcttctattcctcttcttcttctctccttttctccccagcgtggaggcggaggctggcggccgcggcagcgcgacgggagcgggggcgctgcggcgcgacgggccgcggcggccgacgggggctgcggcgcagcggcgctacgggctcggaggcgcggcagccgacgggcgcagaggcgcggcggcgtgacggccggcgtgtagaggcacggcgacgcaacggccggcgtgggttctccttctagatctggtatgtctctccctctccaccctcactccatagtgaaaaatgcacatccggacggcgacgacgacgacattggggaggtcgcggcggaggggaggtcaatccggactccggatgggggcgggcgacgctggcggttaggatggtgtgaggagagagaaacttcaaatttgacgtttctctctccccggatggaggatagctaaatttggatgctaggatggagtatctgctggagctcatttttcttctcccaacctctattttgtggatagaggactagatggagtatctgctggggatgctctaatatatactatatgcactaataactccaatataggaaaacacgtttctacatacatatatataggagcagtgatagtgattactacatgattacatgtatgcatgtagtactggaaaattaactgaacagagtgacccgtaacaaaactgaacgaaataggcttggtttagttcccaaaattttgttcacaaaaacatcgtatcaaatctttggacacatatatggagcattaaatatagataaaaataaaaactaattgcacagtttgcatagaaatcgtgagacgaatcttttaagcctagctaattagtccatgattagtcataaagtgctacagtaacccacatgtgctaatgacggcttaattaggctcaaaacattcatctcgcggtttccagacaagttataaaattagttttttcatttgtgttcgaaaactctttccaatatctggttaaacatccgatatgataataaaaaaattttatttcatgaactaaacagggcctatggcagattgagcgcatgttctcctacggcgaagcaccatgcatccatgttctcctgtctagctattggcctcaagatgcacgtacggattatcaaactgatccaattcaatgtactgttagcctaactgcctaacactagtccatatatatttctctgcttttccctccaatcttcattcacatgacaaattccggtaagtctttgtgtttacgcgtgcatttctaccatgcttatatgtaccatgtttcgttttatttccagcctggtttctttcatgaaaatataatgatacagatacaaacaaatcttataaaaactcggtttcaaactcttttttatataaaaaccggtgtggctgcatcttaaaaaggattatatcttgaaatagtaacaaaaagaagtataatatagtgtgtattacgggcgacgacaagatgggttgattacattggaagtttatagcgcacgtcaattagggcatcctcaatgtttgtggtgtaatgtaaccttaaggtgggccctataaatagtgagtcattattatagccatacccacaatgctatggttaaaatttagccacaagatggcccacttagaatggaaaaataattgtttcatctcttgttcatgaagtgaatgagagagaaaaaatattttctttttgtttgtggtagaacttaagcataaggtgtaccctaagctaatgctactttccacaatatatatggctcactttacaaatataatcattgccttaaggtgtcgtatcggatggcttgcctaccaatctgcctagtcagcatcgaccaaagcacaaacacgtgtcgcgttggaatcgatcgcctaattaatgtgtggctcccacgctcacgacgacgtggcagcagcccgcctgcctaaatgtccggaagcaatcacagccaccattttccacttcccccatcaatcatcaattggatgatgcatgaatgccttccttttttttaaaaaaaaagaaataaagaaaaggcaaaagctttgccttgtagtaggaggcatgaatgccttctggtatcaattcttcctcaacaattactcctacctatctgcaaataaaataacaatactacaagatatcgattgaagtcatttctcacatctctcttatataggtggtgttcttttcttctaaagataaagatgaagattaagtttttttttacgtaaaatgagatgatattaacatatggtagattaagttttaattattacaaacttaaaaaatagattaatttgatattttagagtaactttcatatagaaagttttcgtatgaaacgcaccgtttagcagtttgaaaagtgcgtcacaaaaatcttaatcttcatctaactcttgttggagaaaagaacacggccaaatgttgatgttcattaacaccatagtatataattcccatcctaggtaagcgcacacatatatatactacatcacattttgtattgttctactccaacttgcttgaactaattaatggcaatttactccctctatcatcattagctaaataaaagacgcgaaaaccaaagacaataaaatctctatggttttaaaattaattctcatcgatcaaagtgctctatcaccgtgtcccgcggattttgcatcatactttaaatattggatggagttgcaccatcagaaattaatcttggatagctgcatatatacggtggctgcatgtgtagcgcattcaacgacgtccattcactctttcacaaatagacgaagagagacccctattatatgatgattattttgagaggatcacaaaaatattaggtaaagattatacttggacgtatttgtataatccgcatcagtgaagctaacaaccaactccgcatcactaaaattttgtcacaaatttaagaacttatggttaatttgtgtttgtggtgttttcgctctttgtcgttgataggctagcaggcattccttactagtcaacatttgtcgattttgaaatttgtggccaaatcattactgcaacgaaagaaagcttttcatttttcttgcgaatacaaaaggtggtggaagaaagaaagaaataaggaagggagaaaatgtaaacgttttactaattaatttgcttgtgcggcccaattaatctgttggaaaccatcgccatcaattcagaaacaattaacaccagatactacacatgcattgtttgtgggccactgaatcatctgaacaaaagcaaattcattttcataccgagtgaaaagagggagaaagagaccgtgcagtgtggttgtgtaagagataatccgataatatagctagtgacttggcacaaatttcaggccggagaactattccaccacgtggttgatctggtctactcttaatttcaagccaccagctaatttgttttggattggccagctactagactggttgatgatttaccactactactttttataaagagaaaggcaaaggattactttattgataaataaaataaaacaataaacattcaacagataattgccgtggattatatacttgattatggggtaaattaaatattttgagaaacaaaccaaataaattgtagcttagaacaagtggtgtaaataatgcagtagaaatcttttcagaggcttggtgcaaataattcatgacaataatttgacaaattagctgaaaagaaaattaataaagggctgaactttgctcagctgacctagcgaagagacaacttacggacctcatcttttcacttatgcttatgcttatcagacaaaattttaatttttaaccttaaatttgaggctgattttgaggttttttcatcaaagtttatttttcagcctttgcttttagatcactaagaacacgtacataaaagttttattcacatgttacttttcgttatctcattatggttcttgtccttagttagttattacataaagagagtaaaaatggcttatacacatatggctgttgtataaatcattgtgtttcctgtggtaattatactgtggagtgaagcacagtcacgagttttcactccaccatcgtcgtggacgtacgtgtggtccatagcatatgcgttttgatggctccaatatatacattcagtagtcttctcttccaatcgtacgcgttgcattattgtacttggttgatttaatgccatttcatatccatatcacacgtccgctagctaaattaacattccaagccgccgcttcccccgtcatagaaatgaatcaaatcattctatcaactgaacttattatatttgtgccgtgtgaggcattatacatgcgaaggtaactatagatatcattactggcattgtgaccaatgcaatgaactcgatcgtaaggtgagataacgcatatataatttgtagactatgttactgatgatacatacatattcgatcagcagccagcaatacgtacagttccttttctgaatatgtttgtctgaagattgtgtgtatgaaagtcacaggttaatctactccatgctagcacagcagctagcatgcagcacctgtggtttgggttatcacaggtggacatttgatcgatgtatccagaatgtgcagattaacgaatgaaacagacatgacatctgctcgctgctgctgctagtggtagagatcgatcgctgcagctgcatcgcatctgcgatcgatcgatccagtcggctgaaggcacatgtatggcgatgcgatcaccgaacgaggattctgtctgctatcagtctcagagctagctagctaactgacgacgaaacagcaaatcaataatgctagctatatagctagtgccacttggcataacaacaacgatatgatgcagagataaatcatcatatatccatggccatggcttatacactgcccatacaggaaacggagtatatggtcatcaatcaatccatcgctttctcaagttagctgaatacgaagttggcaattactattaattactagtttctttttttcttaggtaatggatatatataaaaatagtggctggaaatagatggtagtcgttgccctttattagtctgtactattttctgttgtgttgttttcggtctctaacgtgagagcatgtaggcaggatcagggcacattttgtccaatttcaccaatgtgtgttttgcttgtagcctttcgatcatttcatttgcttgctgaaaagaacaagctagccatgcaaggcaacgaaatcaagagagactgagagaaagaaaaagaaattaagaaagaaagaaagaggaaatggagggtttgcttgactactggaccagcagcaagcgatcgacagaagagcacaagatagacttaattggcagccatcgtcgattcgcaagttaagaaaacgccgataaattatttgtgggccatggaatcattggtgcatctcgacaacaataattcactttctttctcttgtccatctcttcttcctcttctctttcagagagaggacagagacagagagtgaagagagaatccaatagctgtgacgtggtgcgaaattcaggggggagaagagctcaaaacttcaccaccattaagtgtcaccttccctccacgtggctggtctgcccttacatccatcatctacgcattggccaccgattgaattgttttggatgatttaagggattggtgagggatagaactgagttcatgatagttattatttcgaggatttaaatgaatgcagtaatgaaattgcggatctcctgcttctttgaaaaaaaaaatgaatgtgtcaaatattactccctccatttcatagtataagttattttgattttttttcttaagttaaatttttttaagtttgaccagtttatagaaaaatgtaatagttttttaagaaaaaacaaacatttcattaaaacataattcatgttagattaaataaaactaatcagtgctttaaatattgctaaatctatctataaacttaatcaaacttaacaaagtttgaccagaaaaaaataaaacgaccaatagtataaaatggaagaagtagaaagttaataggtcgattttaaaggttctttttcatagcgtataaagttctctagctaagaactgatgaggatttttttaaaaaaaacataccgtttagaagtatggaaatcatatctatgataataataaaggagtagttatatttatggcgtcatattttttactgaaaaataattgataggctagagcagtacctaaatttgatggggactgaattgagttactgctagtacgtcctgactcatcaacatctcatagctagtagctaataaggattccggccaattggttcaaggtgtgacgagcggttgatgcaaggcgtagagtaaacgtgatactccctccgtagaaaattatagagcatgtttatttggaaaaaggtatcattctttaactattcgttgtgcataagtatatttataatatttatggaaccaatgttttatgaaagctttttgaaagatgaatctgttggtataactttatgcactaaataaatatacctgtagctagtttggctaattgatcaaaatttacagagtttgactttatacatagcattgtgttccttgtgctgctaattaattaatgagtaaattcaataaaacttcatatattatagtctaaattacacaaaaccacaatggttttaacacgtggacaggaaataaatactataggtgccggttatatcatttccagcacctataatgccgacttgtacgtctttatatagtagtgcaagtatatattatggtcgtaaagttttacaaactacactatcaacaattttgactttgatttaccatgcatacattttttttctacaatcacatgttaaatttataagttttttatctatcatataagtgttgcatctgctttttaaatttggatacatggtgtatgtctaaatattaattgaaggtcaacctataatactcagagttatatgccatatgtttgtgtaacttagattataatgtgcaaggttttatgaaattgacttttaattagtcttctactaatgttgagtaagcagctagcctttttcctcttcattaagcaagccactatataggtaaccaattcgtgcttttgctggccttctgtctatgttactccaataaagtttggtagcgccgccgaccagagcagctggctaataaaattaaagaataacaatatatcatgcatatatatattagtagtagcatattagaacttgcaaattgcaatagattgaaccaggattttggaagggatcgatatataaatatcgaagctagatccggacaaagcgcatgttatataattatattacacacgcatgttgctgagttgcacaagttaaccatgcattcttgtctctgcatatacacatacctgctaactgcaatatataataagccatagtatatacatacatcacatgaccgattctctgttggagatgcaaatcaaaacatgcctgacatttgccatggtataatggtgtgcatgttataatttggcaaggcattgaaactctcattcaggtagtatgtgtacatgaacagcatgcagagaagaaatttaatatatattaattagtataattattatacagatttcacagctgagtttgatcgatgcatgaactgtgtatatctgtcacggtagtgtgatgaaatatatggtgggggcatccaaagccagcccacatgtcagccagctgtagatccatcgatgctatgatgcatatatatggactatatatactcgctcgaattaattatgcgttacttatttttctctgcgcgtttaatcaaacactattaattagtacagtattaaactagctagctagcttagacagcgtcacctccatccatggtggggtagctgcgtacatgtgctcctgctttagctagctcaaactagtgcatctatcaacacaacactaatcatagcatgccgtcgacgccgcatttaattatagaaaggactgcctaaccggccatctcttgacagaaataaataccctaaaatcatgtgaattctaaaccgttagatcactatagatctgtacagctatattcttctctctcttcaccgctaactctgtttgagtgcacgctattttcgacattgagcttctcaatcctctaagatagatccatctgtcaccgcttcgcaggcgccaaaaaagcctactagatcaacctcctctcctcctccgtgagcggggtgtcaccccgttgtcttcctcgtctccaacagctcctacatcgtcacccgcctaataactgattaggatctctcacccccactgtcagccctatctgtcaccctgccactaatccgtggcttagatggtgtggacgttgcctcgtcaccctcccgctctgcagccaccaaacattccctctaaccctagcgaactttcctagctagcccccttagaccataaaccctaactgatcgatccaccgctagttactgtagtgggagaatcgaggagccaccgctagaaatcccccctccgccttccaatacttacggaatgaattaggttagcaactatgaatcacaataagttagagcacgtacttatttttatttataataatgaagtagcgggttttcccgcgtaatttaaaattacgcgctaaattctaaaattaaaaacgatatttgacatataacaatgatttctatttctacaaatatgactagctagcgtttatatacaactataccgacaaaacatctaacattaacttgtatttctaacaaaacaagaaaaaacaccatgaaatttctatgtggcccgggcagtgaagcatgcagtgtgtgacgcgggactccggtgagataggcgaggaatctcctctcgtaagattcacctactcttctctcgtcaaattaacagcctatcgatgatcgattaacggaggctggcaactgggccaaataggcgaaacaaccaatgggcccgcgccacgtgcatccagcatcaatccaccacataataataataactaaataaaataaacaaataaattagtgatggatccgaactctaatactagtattagcaatacaagaaatagaaatagcaattggatcggaggcactataaatacatcctccgacccctcgccaatcccgcacacaacgcaaacgcaaactaatctcctcttctcctctcctccctttttctttcttgtgctaatattatatccatctcgcggcgacgcgacgatcatggagacccgggacgacgtcgccgacgcctcggcgcttccctactcctactcgccgctccccgccggggacgccgcctccgccgacctcgccgccgcccgccgttcccggaggcgcccgctctgcgtcgccctgttcctcgcctccgccgcggtgatcctcgccgtggcggtcctctccggcgtcaggctcgccgggcgccccgcgacgacgacgatggtcgtcccgggggtggtggagatggagatggcgagcagggggccggagtccggcgtgtcggagaagacgtcgggggcggaggagatggtgaggctgatgggcggcgcggcgggtggggaggcgttcccgtggagcaacgcgatgctgcaatggcagcgcaccggattccatttccagcccgagaggaactggatgaacgatcccaacggtacttaatttctttgcattttttttcttttattttccttcttcgatcgatcgattgattgttctcatctcaattcgttcattccttccgctctgttcgttcgttcttctagatctgacaacattcaaatgctattaaataaattcccattttggaggaacgttttatggttaagattcttccagccccattttcctttttttttatttatttttgagaaaagatttaaaaataaaaaaggaaaaccgagatacccttaagattccaaccgcaccaaccgaccaggcattgtagaattcgaattacaataatttttagatagataaaattcaaattacattatataatcaaattaacattggaaatgcaatgcaggtccggtgtactacaagggttggtaccacctgttctaccagtacaacccggatggggcggtgtggggcaacaagatcgcgtgggggcacgcggtgtcccgcgacctcgtccactggcgccacctccccctcgccatggttcccgaccagtggtacgacgtcaacggcgtctggaccggctccgccaccaccctccccgacggccgcctcgccatgctctacaccggctccaccaacgcctccgtccaggtccagtgcctcgccgtcccctccgaccccgacgaccccctcctcaccaactggaccaagtaccacgccaaccccgtcctctaccctccccgcaccatcggcgaccgcgacttccgcgaccccaccaccgcctggcgcgacccctccgacggcgactggcggatcgtcatcggctccaaggacgagcaccacgccggcatcgccgtcgtctaccgcaccgccgacttcgtcacctacgacctcctcccgggcctcctccaccgcgtcgaggccacggggatgtgggagtgcatcgacttctacccggtggccggcggcgagggggtggacatgacggaggcgatgtacgcgaggaacaagggggtggtgcacgtgatgaaggcgagcatggacgacgatcgccatgactactacgcgctggggaggtacgacccggcgaggaacgcgtggacgccgctggacgccgccgccgacgtcggcatcggcctccgctacgactggggcaagttctatgcctccaagaccttctacgatccggccaagcgccgccgcgtcctctggggttgggtcggcgagaccgactccgagcgcgccgacgtcgccaagggttgggcttccctccaggtacaccttcattacctctctaaactattttaagtttaactaagttcatggacaaacatatattaaattagtttcatcaaatcaataattaaatatatttttataatatatttgttttgggtgaaaattttactacttttttctataaacttagttaaatttaaagcaggaatttgactaaaattaaaaacaacttataactcgaaacggagggagggagtatatattaattaatccagctactactagtaattagctagcatgcatgattagctaggcatcattggcatgcatatgtgcacttttactgggctccattgacacgttggatcgacgaacaacacgtacatatgcatatgcctgccggagtgtagcgtagcaatcaaataatggcagccacttgtgaagagcgagagagatgacgcgaacaaacaaaaagcttgtcatgttggttgtcaaaatgtcgcttagcttcatccaggaatgaatgcggatatcctgttggggccccactgctcagctaccgaccggagcaactgttgagatacccttttttgcaataattgacataataaacagatcgtattattattggttgatggatggaattgcttgtgtccaagctatagtcctcctagcaactgttactactagtaggaatagctgtccttgcccataactcatgtgcaaccatgtgctgtagctgcattctgcttgtctttgctgatgctttgcctaactgaaatcatttgcacacacaacttaactgggattcatagattgcaaccttttcttttcaccagaaaaagggctgtcttttttgcttgcttttcaatataattccaccgctctcattttctttgctgtcacagtactgatagataatgcaaaatcgcttggttcatgtgaagcaagctatagtaataataattatgattaacatgtgtaattaaattactggagtagtagctaattagtaaaaataaaaaaattggcatgcagtcgattcctcggacggtggagctggacaccaagacggggagcaacctgctgcaatggccggtggaggaggtggagacgctgcgcaccaactccaccgacttcggcggcatcaccgtcgactacgcctccgtcttcccgctcaacctccaccgcgccacgcagctcgacatcctcgccgagttccagctcgacccgctcgccgtcgacgccgtcctcgaggccgacgtcggctacaactgcagcaccagcggcggcgcggccggccggggcgccctgggccccttcgggctgctggtgctcgccgacaagcgccaccgcggggatggggagcagaccgccgtgtacttctacgtggccaaggggagcgacggcggcgtcacgacgcacttctgccaggacgagtcgaggtcgtcgcacgccgacgacatcgtcaagagggtcgtcggcaacgtcgtcccggtgctcgacggcgagaccttctccctccgggtgctcgtcgaccactccatcgtcgagagcttcgcgcagggggggaggtccacggcgacgtcgcgggtgtaccccacggaggccatctacgccaacgccggcgtcttcctcttcaacaacgccaccagcgcgcgcgtcacggccaagaagctcgtcgtccacgagatggactcctcctacaaccaagcctacatggcctagactcctctcttcttcttcttcttcttcttctccattattacattattgctgcttacttgtaaatcatttttgacgccgccgcctgctgctagctgctggcctggccttcagaattttatctctttgcttctttttttttttgtctctgctttaattttgtatctcgatcgatctcgaccgatcgattaattactatatctccatgaagaaatgcatggatgatggatcatggatggatcgctcccttcgatccaactgtacctaggggaagaagatgccatggtcaagcaatacttctgtaaatgtttcacatgagtcaagatttatgcagagttataatatatatgtttctctctccctccctctttgcaaacaaaaagtatccaaatgaagaatcctctcttaatttgcaccaagatagagacacgcacaaaaagagtttcgcggcccgtgatagactgatgcttcttacatcttgctggcctgggttgtttgcctttttctttttccctgatttctttatatttgttttcagcccgcaaaaagaaatacagaaatgcacatgcttattattctcacatggatgcaaagcctgggacgtggcaaatgtagcacagtacatgcttatacagctacaaacaatacatgcatagatcagatttttgtcttctgctttatgttttttctacaccgtgttgagtttaatatatcatgttcttgacgagccaaaatacaaacaaactgccgctggaactgttaaatgccaaaagctgctatttgcagcatattaagggaactggggaggcagctagctagattggttagcagctcagcatgagtatcatcagtagtatctcagagaaatacatttcaatgcactgtggacacataccttcattgaacaacagctcagcctgacactgcgcatgctcacaaagggaataagggaaagtcaaattgcaacttcataaccgattttgaattaaacccattgaacacgctcatcattcgtgcatcctttctttcattttctgtaaggatcagatgatgaccaaattagatgagaaccaactgtaagattttttttttcgaggggaaggtcaggagttctgccgatttcaattaagtagggggaaaacaaagttttacaacatgcaaagtccagggtttggggatcccttggatacaactgtaactgtaagaatttccagctgcaattagtttttcttaaagaatcagatgacaaagaaatcagatgaaagcacctcatcagagacgtacaaacattatcaggtagcactttctgacaacagaacaaagcatggattaattccctgccaagactggtgccgagtaatttccagatatcatcgagccattggaaggagtcaaaccaatagtaacactgcagatgttagatcaatgatttgaatcactttgttagctgaagcacactgttctcattggcatcttcgttcaacaaactcaaggaagatctcaaattcataagtggagagcctgttcaatcggataaccacatatatcctgcgcatttttacaattcgtaaccaacctcaaatgttcatatagatatatcaatgatttgcactaagaaacgaaaaatgatcagcttatcagtactttgcatctgctgtcaagatcaatatgcaagccccacaggaactactgcaaccactgggaataaatgaaatttgaaactggtccacttgaatcgcaatcacttatctgaccatatcagagtgtggtgtgttcataactacacatggcccatttgccttttttaaaaaaatgcacgcacataatatacattctaaatgagtttttgcagttccaatttcaatcaagattgcctgaactggaatattctaaagaggcataggcagcaaaaaggtaggcagcatgttgctcacaaaaataatgatgaaacgaaaacaattcattgaatttaagtagccaacgattcttttacttctatcatggagcagccgtttagcggaacaaggccagagacagagatgtaccaagccctctggagagtcgcagctttcaaccagagaaatgctctttaccatccaccggtgatccaaagaaaagataacacatatcctgggttatcaccacttcaccataaaaatgaaggatttgggactagcaccatggtctcaaaaaaaagagagagaggctatttctgacaaggtcacttcacaagtcacaagatatcttcatctcaatggtgtatgttcttgtcctctctggcattttatgagatattgtacttattttcaattgcgtgatcttactgtcatataactgcattgtgactttgtgaggtggttcagcacaaatttccatctttatatcaagaagacatgaccgccaacacaaactgctataaagcaaaagggtagtgctgcatctgcatgtcaatgtgtccagttttctaggcagtacacgaatttttcaattatttggtttgccattctccttcgtctctctctcagcagggatttgaacatgaggcagcgaccaccatacttttcttcatgtcaaattaatgctagaaaatgtggattggcacttctgctgtgctgtcaaaacttgcctcccaaccaggcaaccaccatgtaactaatttaacaaaggctaatcagaactaccttcctgaaacacagaattatgatttcataaacacacctcttttcaaccctgcacctgcagggaacatgagaattcttactttcaggtgcagactttcaggaaagccaaagaatctgatctaaatttgaccttgattaacccttttcctttcttcaagtaggctgaaaactctggttcatatttcatactagaagaatgtgggggtgtaagctggattgacaggatgattaccagaagtctccgcaagagcacgtgccattgttaaacttgtgaaatctgacagcatccctcacaagaatatcacggcaaatctggaacgctaggaacgatttgaatttcaaatccaaaaaattgggaacctctgcaggtatgccatgcagctcaggcaatgatttatgcatatgagaaagaagcaactttggaagaaacaggtaatactgccaacaaggaacaacagcaagtagaagtcacaaacttatctcccatccctgcaggtatatttggtgctacgttgattgatttgtgtgtggataacaaaacaggaattgatctttttgtacatgatccagttatcccaggctgccatctggctaaaagctattagtgtgaattctacttccccttgcaggctgagcttacagatctctgggtagccttaaaaatctgcagtcttctcagcttggtgaatgtgatcttctcactgataacacaacaattgctactatcttcaagcaaaataattttcaggagaatctatgatattggagcttgaggccgctcctatcaaaatttcaacaaaatttgcaggatcagcaattgcaggtcaaatggattcctacaagggcaaatgaagttgctgataaacttgcaaatgaggcaagaaggataagttgttatagggctagaactttcagtttttgtcacaatagttctcatgtttgctatcaatctagatgcccaaatacaagtgcccttgtaaacctctgtcttgaagagcaaaacataatgcatgtattataatagaagtcatgaattctaaagaaagagaagacttaaggttgttggctcaaataagaattgccaagatgttaaaagaccaattgccaagatgtctatttgagaccatactcatggccacatgtagtgcgcaagttgcataagttcatcaaaacggcgtagcaataaaatttaatgacggttctagtgtcctgtggtttttcagaagataataaataacaaaaaagggcttatgcttaaaaagcagccaatttacttggaaactaaagtttctaagattcgttttttagggaaatcatccaagaaagcatattagtttattgcaaaggaaagcatattagtgacagcagtaaatagctatatctttatgtatttctgcagaaatcaatgcccaaggtcatatgaaagaaatcagcatataaatgacaaaattgatattgataggtgctggaagcctcaaattactttatcccgttggtgcttctatacaatatgatcctaccataaaagcaaaaaaataaaataaaaaataacagcttgagacctactcttttcattgagtagtaacactatttttttatctcatgggtggtgtgattaagcttatggataagaaattaataagacattgacataaatgtagcacctgagtacctaacaataatttaaaactaaaaaagaagaaatatatgcactaaccgcaattgtgtgtaccaactattttgcatccatgtacatatgcggttgagtttttctagaattcgactacctaggctgctgctgcgagtgtggtgtatcgatcataatttgcaggttttagtccttgcagcctagccaatgtctttgagtatggatagcgacctccttgaactcctccctcgaaagccttctttgaagggtgagatacacaagattaccctgagataaaaaacttgttcagtaaattagcaaatatatcatgaggcaggtgtgtgtggatagacaataaaggtacagtatatttagtactattcagatacatggaaccagtcataatgcagtccttaatatttgtcgtaaatatctgactgattctgacataaacactgtcaagcaaagaagcatatggattcaaagcctctttttttttgcaaaataattcaaaatgatatcaaccggttttgctaggcaaatctgagttgagtaggatttcaaggaacatgtcctctttgagcaattttatagccaatttagtaaaaagctctcatcttatttacatttttaagaggatatttctatgacaggcattacattggatcatagaaggaatcaacgagatgctgacctttcttctcaggaggtgatacttcccttttaccagtgacattttctgctttatgaactacagagtgagctaggaaatgcagcagtagcttccctccctacttcatctactgactgcactaacggatccaagcaagaaaaaaattcttccttggagatattatgatctatatacttggattgaactgaagaaatttacagaaaaatgtcagtgcaaaaaaacaacacacagaaaaactcaattagagaatggatatcagctattgagcttgcaaagtgagaggacctggatggctcaaagccaatggctctgaccggaggagctcgcagcgatcccttctcccatttcaggaaagccaaagaatttgatctaaatttgaccttgattaacccttttcctttcttcaagtaggctgaaaactctggttcgtatttcgtactagaagaatgtgggctgtcagctggattgacaggatgactaccagaagtctccgcacgagcacgtgccatcactaaacttgtgaaatctgacagcatccctcacaagaatatcacggccagttatcttagaaatgaacttggtagcattgtgacaatccacacatacccgtagattcttgacaatccgaattggcatttcttgtggaacaaagattaagccaaaggcaattgctagcttctcgctgtgatggctaatcatgtgaaccttatcagcatctgccacatcatgcagcaccgagctgacatcaggcttgtatccttcttcagccatctttgagttgagccactctagcttttcgtatattctactggagaaggggtgggattggtcatcggctgaaaatatgtgaactttgttcttgtacttgatccaactgcagcctggttccttcttcacctgcctgtccctcattccacgtctaagatgagcgacttcagtccattgacctttagcagcatgcatgctacacaacaacacatagctggcagggttttgtgggtcagtttccaagagattctcagctgcccacttgccaatctccatgttcccacgcagcctacacgagctcagcaatgttgcccatccaaaggcatcaggactgtgtggcatctgctttatgaattcctcagcctctttgaacctccctgatctactgtacaagtcaatcatacaagtgtagtgatcatctataggaacaataccgtggtccttctgcatggaatcaaagtagtcgcaccctttctctacaagtcctgcacggctacaagcagaaaggacaccgataaatgttaccccatcaggcttcaagccatttgccaacatcttctcaaacaaatctatagtttcttttgccttcccaaattgagcataccctgtcacaagagcagtccaggagacttgatcgtggaaggacatctcatcaaataagcggtgtgcatcctcaatgctgccacacttcccatacaaggtaactagtgcattggacactgtaatgtaccgcatcaaccctgagacaagtgctaggcagtggaactgtgcaccctcttccagacttgctaaattagcacaagaacttataacactgcctagagtgaaatcatcaggcttaatgccatccatttgcatctctgagaatgcccggacagcctcctcactgcaagcattctgtccatatccaacaatcatcgcagtccacgatatgatgtttctgcatgtcatcctcctgaaaacagcctctgccaatctgatgctcctgcacttggagtacatgtcaacaagcgcactcccgacaaagacattatcttcataccaagtccgagttatgtaggcatgtatctgcttcccttcttccaaggcagcaagggcaccgcaggctgtaagaatgcttccgaaagtgtactgatcaatgccaacaccctctgccctcattctcctgaaaacatcaagagcctccaactgcaaaccgttctgagtcagtcctgtaaccatcgtagtccaagtaatggaatccctgtccaccatcagctgaaacaaaccctttgcatcctcgatcatcttgcagcggagcagccctgtgatcaaggtattgtacatgaccacagtcttggcctccatttcttgaaacacccgcctggcatccctaatgaggcccatcttggcatacatatcgaccaacgggctcccaacgaaagcatatgccccgaacccaagccgcagtacctggcaatgcaccgagtggccaagcgcgcggtcggagagagccgaagcgaccatgatcatcgccgacagagtaatccgggttggcctgacgctctcctcccggagcagcgcgcggtacagctggaccgaccgggcaggagagccggtgctggagaagccggtgatgagcgcgttgtaggagacggcgtcccgctcgggcatcgaggcgaagaggcgctccatgtccgggacgagccttgagtgggcgagcgccgagaggagggcgttgcgggtgaagaggttggggtcgggcatttcgtcgaacacgcggcgggctcgggcgaggcggccggacttggcgtaggcggtgaggaggtggttgaggaggaaggttgggggagcctggagaaacgtcttgagaatgaggcagtgcacagcgccggccacgcgaaccccggtccggccgccgtcgccggcggcggaggagaggatggcggcgtagcggttgcatagcgcgtgggcggcgtgggtcatcgcgcgtgggctttcgcttactagactagaagtgcccgcgcggttagcagataagttttcgatcgttcgttttattaaaaacttttataaaataggtaaaactacatgtatacataaaaatatatttaacaataaattaaatgatatgaaaataattaataattacttaaattattttaataagacgaacggtcaaatattttttttaaaaaaaaagtcaatagcatcgaacgttttaggatggagggagtactattaaaggccttcacatcaataaataaaagttgggattgtacttgacagtagttaacaattcgggaaagcacaagaatgcatatgcaaacaagcatcaaattgggcaaacatctttgtgacacacaaacataaaataaacaacctggccactagcaaattgacacgacactaaatcaagaggagggaaaaatttcaaaaaaacagggaaaaaggaaccgtaccgatcttggggaattttatgattcgcgagcttcccctgcaagtactatggagaattttttttatttataatttttttattaaaagttttacaaaaataattttccattttgaaaattgacggaagtagtcgcctaccgccctctgggaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccgccctccgctagggcgattttgtactgtggggggggccgcctgcaaatgggcggcgagggggcatggaattttgcaggcggcccccttgccgccctgggggagggcgatttttgcctctccccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatataagttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtatcgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttctgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgagatcagatattgacagcaattgggtgtgatgggaacaaccaggttctacctatggcttttgcatttgtagagagtgagaacactgaaagctggtactggttcctagagagagtgcacattgcagtggtgcgtatgaggctcaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttagatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaatgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcagactaaatacttctatcgtgtaatttcaattcaatgttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccaccattcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactaacacccacgggcacgctgtggacttccggctggtccactacgcacggtccatcacggatgctcagccacaggacgtgccgcagtggagctggggttctgccgtgctagcagccacgtaccgtgccctctgtgaggcgtgcacgaagactgatgtcacgcccagaaattcccgaatagaattccaagcagaatgtgtattaaaacccccgtccaggaccagccggggtacacaaacgacaatgttgacatacagatccacgtcttacaaacattataaaagtcttacagagatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcatggatttaacaagggatagctaagcaggttcatttgcataaatactggcatttataaacaggaatttaatgcaaaaacagttgtaaaaaaaattaaacagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcactttatttaaccaacaccagcaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgctgggggaacctcggcgactatctcgaagtacaccggagcgtcgaaggaaccggaatctagcgacatacaaagcaatcattgcaaacaggctataagactactgaaacagagaacaaaaccatttttaatggattctacacatttttcttgatttactgagacttgaatgggcttaaacggagctcggatgaattagttatgaattttagaagattcactgtgtttaatactataaaagaaatccttaaataatttattgcgcaatattaaccagggctgacgtcagcgaggggggggggtgcggcgccgacatgcgggacccaccggtcagcggcatgggagagagaggaaggggggtggcggcgcgcgggcccaccggtcagcgacccggggaaaaggaggggcggcggcgccacgtggcggccgaaccgacggccccgatctacccaagggtagatcggacggcggcgcgggacctcgcggccggggcgcgcgggcgcggcgcgagacggcggcgaccatggcgccggcggcgcggcgctcacacggcggcggcgcgcatgcggcagcggcgcaaagcgacgaccgacggcgatcgtccggcggcggagagcggcggctagcggctctaggaggagaggaaggggaaaaggagggaggggatgcctcaccgagggtggccggcgcggaggaaggcgatggcggacggcgacggcaagccacgggaggacggcgtcggctagcggacgagctccggcgtgccctaaggaaggagaagagaggaattagagagagagagatggaccatggcgatcgggatccatggccgaaggcggcggtagaggtggcgctcacccgtgcgcgtggagatgagggctccggcgacgaacctcgacggaggaggggcggacgaggtggacctcggccacgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggtgatgcttaaataggggatggggaaaccggacgtggccgggagcggcgggattcgacggccgacgtgggggagtggggaggagagagaggcgggattcggttttcgaatcccggccatctcgggcgcggcgcgagcgggagagggaggggaacgggcgcggagaaggcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaagggagaagtgggccgacggcccacttgacaaaaaggagggaaaagagaggaaaaagaaaaagaaaaggaaaaaggattttccctggaattaacaattgtactttagtgatttttaattggttaaaattatttctagagctctgaaaattccactaaaaatcctgttaatgaatttcgacatgtagaattcaagaaaaattccacatgtcaaatccgattattatttgcattactttcttagggttttctcctgatttcaccagcattttcttagggtcaattataaattacaattttgactagggaggaaaacttcggggtgtgacaaacctaccccccttaaacggaatctcggccccgagattcggtggagctggtgaagaggtacggatgggcggccttcaactcatcttccctttcccaggttgcttcctcttctgaatgatgactccactgaacacggcaaaacctggtgaccttgtttctggttctcctttcgctagtgtcaagtatgcgaaccggcttctccacatatgttaggtcctcttggatatcaatgtgttccgaattagcctgttcttcaggtacccttaaacacttctttaattgggacacatggaacacgtcatggatgccgatcatagtggatggaagttctagctgataggcaacttctccccttcgttccaaaattttgtacggtcccacgaagcgtggtgccaacttgccttttgtctgaaagcggtgtactccccggagcggggtgacacgaaggtacacgtaatctccggcctcaaaagttagctcccttcgacggttatccgcgtagctcttctgtcgagactgagcaatcctcaatctctccctgatgattctgactttctcttctgcttccgctaatacttctgttccgaacagctgacgttcgcctgtctgatcccagaagagaggtgtgcggcacttccggccgtatagagcttcaaacggtgccatctgtagactggcctggtagctgttgttatacgagaattccgcatatggtaagcttttgtcccaagctccaccaaaatcaagagcgcaagctctcaacatatcttccaagatttgattgactcactctgtctgaccatcagtttgcgggtgataggccgtgctgaaatttaaacgggtccccatttcttcctgcagcttctgccagaactttgaggtgaactgactacctcggtcggatactatcttcttgggtaccccatgcaaacacatgatccttgcgaggtacaattctgccaatctctttcccgtataggtggtatgtactggtataaagtgagccaccttggtaagtcgatccacgactacccagattgaatcatgtcccgatgatgtccggggcagtcctgttataaagtccattccaatctcctcccatttccattccgggatttgaagaggttggagtaaacctgctggtctttggtgctctgctttcactcgttggcaaacatcgcagagtgcgacgaattcagctatttctctcctcatgctgacccaccaaaatttttctttaaggtcttggtacattttggtgctgcctgggtgaatggagtactgggtctgatgagcttcggtgagtatcagatccttcaattccttgtcgtccggtacacacaatctttctcccatccagattgtgccatgctcatcctcgtggaaatcccgagcttttccgactctcatgttctttttcagttctgctatttccggatcatttacttgagcggctctaacttgatccacgagcgtaggccgtgcctccagagcggctacgaacccgtgttcaacaattccaacgttgagatgttcaaactcctgccgcaattcctcacacatgccctcgatgcatagagcagtgcagtaacttttccggcttaaagcgtctgccaccacattggctttacccgggtggtagtgaatactcatgtcatagtctttgattagttccaaccatcttcgttgtcgaaggtttagatctggttgggtgaagatgtatttcagacttttatggtccgtatatacttcgcagcggttgccgatcagatagtgcctccagatcttcaaagcgtggaccactgctgccaattccaagtcatgagttggataatttccttcgtgtggacgcaactgccgcgaggcatatgcaaccactctgccctcttgcattaggacacatccaagtccgtgacgggatgcatcgcaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattctggagaagttttcgatgaatcggcggtaataacctgccagtcctagaaaactccgaatctgcgacacggtctttggtggggtccattttgtaactgactccacgttcgatggatcaactgctacaccctgagctgtaatgacatgacccagaaatttgacttccgtcaaccagaagtcacacttgctgaacttggcgtatagctggtgctccttcaacttctcgagtaccagacggagatgttgttcatgttcctcttcggactttgaatagataagaatgtcgtcgatgaataccacaacaaacttgtccagaaattccatgaacactttgttcatcagattcatgaagaatgcgggtgcgttagtaagtccgaaagacataaccgtgcactcgtatagcccgtaccgagtggtgaaggccgtcttcggaatatcctcttcccggattctcaactggtggtaacctgatcgcaggtctatcttagaaaacactttagctcctttcagttgatcaaacaaatcgtcgatccgcggtaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctccgctaattcgttggccgccattctgtacggtctcttatagattggagcggttcctggtgccaaatcaatccggaattcaatctccctcttgggtggcatggtggtgaggtcttcggggaacacctctggatactcgcagactatgggtatgtcctccaattttctcaagttcttctcttcggtgtccactgggatttccgtctcaatctgattcaacgaggctcctttctttggcgagactagagatttgtacaccacggtttctcctttctcattggtcagggtgactgtgcgattcgcacaatcgatgactcccttaaacttggtcagccaatccatcccaagaatgacatctaggtctttggattcgagaagaatgaggttggctagaaatggtgatctttggatttctattagcactgaagggctaaaactgactgaggttgaactatttcccggggtatgaaccctcattggtgtgctaagctcttctttccttaacccatacatccccacaaatttctttgaaatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttagcccggcacgcctgggcttcgggcatttgtcagcgaagtggccaagctcgccacagttgaagcaagaccctggttttgctcccgtctccttcttggcttgcgcgggctgggctgactgtgccggtgccattggtgggcgtggagctgcaccgcggttgggctggcctccctggtggttctgactgccgctagcgccctggtggaagttgctagagtggaacgggcggtgctgtcggacgatcatggtggtaggtccaccctgctgtccgggagtgaagcgcggtcggtgctgactaccttggttggatcggaactgcgccgcctttcttttcctgtccattttgttgcgctgatcctcctgacggattgccttgtcgaccagcctttcaaagtcagcgtagtccccggatatcagttggttggtcagctcgtcatccaggcctgccataaacttttcctgtttctcggcgtcagtgcggacatcctctggtgcatatcgcgcgaggcgattgaactcgtggaggtactctgtcactgtcctgttgccctgatggagcgcccggaattccctcttcttttgcgctacaaccccgtctggcacctgtgccttcctaaagctacggcagaactctgcccacgtaacttccgtacccggtgggcgggtggccatgtggttgtcccaccaagctgacgcaggaccctgaagctggtgtgtggcgaaagcgaccttctcctgatcattgcactgcaggagattcagcttcttctctatcgcatggagccagtcatttgcctccatagggttggtggtgctggagaaggtgggtggcctgacacgtagaaactcaggcaacttggactgagggggagggggaccaaactgctggtgctgctgttcggcgtgctgcatcatcctctgatgcatctgctggtgctgctgctgcatctgctgcatcatcgcggccatcatctgagtctgatgtgccataacttgggcaagcgtcggattctcgggaagtggtggcggaccattgccagaatcaccgttggggtgcacaccatcagcgcgttcttcaccgttgctgccctcgcctgttgcgcggctaccagtcctggtgtagaccatctggagggaagaacagacggggaaaagaagaaaaacagatgctcaagaactaagctttattatataggaattaaaactgcaattgttctgatctgaattaaaacacttaaaaaggcaagcaaaaatccttattaagacagccatatcatagacacatgatatcgaccgtcaactgaccccaaacaagcaacctaaacacacaaactaacaaacaaaaactagacagtcgatgaactagtggaaaaacgagcctaatgctcggaacggctcctgcggtcggtggagtcgaaagcgtcctcctgctcgtcacccggtccctctgagcgactcctggagcctgacggatcagtctcgccgctgccactgggagtagcagacagccatcctccggtaccactggctgaacctccggcggctgatgctggagcgaaggagagagtgaacgcgggagctggagctggagctgcaggaactgcgggcggagctggagctgctgcgggggccgctggtggaggtgggttcctgggcgccagctggatgcgcacaggtgtagtcgtcctcttacggggcgtagtgcggatccggactcctcctggcgctggaagacccttcaactgagcattctccttcttcaggcgcgctacctcgtccttcagagcgacgatcctcatgagcttcccatcattcaaggccttggtcgccttgtgcaggtccgagtgcatccggtccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggctgcctcctgacaggcgtgatctgctgtgcctccagatgcctcgaccgccatgttagcgaggcaagtccccacgtagccatggacctccaagcggacacggtgaggaagctcgccactgagcggcggaatggtcgtgtactccggcgcgtcggggtagcccactaccagtgtcatgcgtgccagctctgccacgaagtcgatcatgccttctccgcggtggttgggtgggtgaccggccatctagagaagacaaaggagtaggatcaatgtatgctcaaatccaaatttaaataaagcaataaagactcaaataaaggaatcaaataagagcaaaattttatgcatagatcattttacatgagcgcgaataaataagacagactcacataacgataaaataatgggaaattagatacataatagtagtaacaaacgaagcataaacaccttgcaacccatgataccgagctaggaccgaatgcatttcacccatcaaatcccaactgactgacgagtaaatcccaataattttactaaaaccctagactgactcgttttggaaaactcactttaaacgagcgaccaagatttttcccttgaaccacaagaacagatccccgttttcccggaacaaaatccaattgcaaagaacatatgcaatgaaaaggattcagagggctcttaggtctttccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaagtcttacagagatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcatggatttaacaagggatagctaagcaggttcatttgcataaatactggcatttataaacaggaatttaatgcaaaaacagttgtaaaaaaaattaaacagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcactttatttaaccaacaccagcaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgctgggggaacctcggcgactatcttgaagtacaccggagcgtcgaaggaaccggaatctagcgacatacaaagcaatcattgcaaacaggctataagactactgaaacagagaacaaaaccatttttaatggattctacacatttttcttgatttactgagacttgaatgggcttaaacggagctcggatgaattagttatgaattttagaagattcactgtgtttaatactataaaagaaatccttaaataatttattgcgcaatattaaccagggctgacgtcagcgagggggggggtgcggcgccgacatgcgggacccaccggtcagcggcatgggagagagaggaaggggggtggcggcgcgcgggcccaccggtcagcgacccggggaaaaggaggggcggcggcgccacgtggcggccgaaccgacggccccgatctacccaagggtagatcggacggcggcgcgggacctcgcggccggggcgcgcgggcgcggcgcgagacggcggcgaccatggcgccggcggcgcggcgctcacacggcggcggcgcgcatgcggcagcggcgcaaagcgacgaccgacggcgatcgtccggcggcggagagtggcggctagcggctctaggaggagaggaaggggaaaaggagggaggggatgcctcaccgagggtggccggcgcggaggaaggcgatggcggacggcgacggcaagccacgggaggacggcgtcggctagcggacgagctccggcgtgccctaaggaaggagaagagaggaattagagagagagagatggaccatggcgatcgggatccatggccgaaggcggcggtagaggtggcgctcacccgtgcgcgtggagatgagggctccggcgacgaacctcgacggaggaggggcggacgaggtggacctcggccacgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggtgatgcttaaataggggatggggaaaccggacgtggccgggagcggcgggattcgacggccgacgtgggggagtggggaggagagagaggcgggattcggttttcgaatcccggccatctcgggcgcggcgcgagcgggagagggaggggaacgggcgcggggaaggcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaagggagaagtgggccgacggcccacttgacaaaaaggagggaaaagagaggaaaaagaaaaagaaaaggaaaaaggattttccctggaattaacaattgtactttagtgatttttaattggttaaaattatttctagagctctgaaaattccactaaaaatcctgttaatgaatttcgacatgtagaattcaagaaaaattccacatgtcaaatccgattattatttgcattactttcttagggttttctcctgatttcaccagcattttcttagggtcaattataaattacaattttgactagggaggaaaacttcggggtgtgacaaacctaccccccttaaacggaatctcggccccgagattcggtggagctggtgaagaggtacggatgggcggccttcaactcatcttccctttcccaggttgcttcctcttctgaatgatgactccactgaacacggcaaaacctggtgaccttgtttctggttctcctttcgctagtgtcaagtatgcgaaccggcttctccacatatgttaggtcctcttggatatcaatgtgttccgaattagcctgttcttcaggtacccttaaacacttctttaattgggacacatggaacacgtcatggatgccgatcatagtggatggaagttctagctgataggcaacttctccccttcgttccaaaattttgtacggtcccacgaagcgtggtgccaacttgccttttgtctgaaagcggtgtactccccggagcggggtgacacgaaggtacacgtaatctccggcctcaaaagttagctcccttcgacggttatccgcgtagctcttctgtcgagactgagcaatcctcaatctctccctgatgattctgactttctcttctgcttccgctaatacttctgttccgaacagctgacgttcgcctgtctgatcccagaagagaggtgtgcggcacttccggccgtatagagcttcaaacggtgccatctgtagactggcctggtagctgttgttatacgagaattccgcatatggtaagcttttgtcccaagctccaccaaaatcaagagcgcaagctctcaacatatcttccaagatttgattgactcactctgtctgaccatcagtttgcgggtgataggccgtgctgaaatttaaacgggtccccatttcttcctgcagcttctgccagaactttgaggtgaactgactacctcggtcggatactatcttcttgggtaccccatgcaaacacatgatccttgcgaggtacaattctgccaatctctttcccgtataggtggtatgtactggtataaagtgagccaccttggtaagtcgatccacgactacccagattgaatcatgtcccgatgatgtccggggcagtcctgttataaagtccattccaatctcctcccatttccattccgggatttgaagaggttggagtaaacctgctggtctttggtgctctgctttcactcgttggcaaacatcgcagagtgcgacgaattcagctatttctctcctcatgctgacccaccaaaatttttctttaaggtcttggtacattttggtgctgcctgggtgaatggagtactgggtctgatgagcttcggtgagtatcagatccttcaattccttgtcgtccggtacacacaatctttctcccatccagattgtgccatgctcatcctcgtggaaatcccgagcttttccgactctcatgttctttttcagttctgctatttccggatcatttacttgagcggctctaacttgatccacgagcgtaggccgtgcctccagagcggctacgaacccgtgttcaacaattccaacgttgagatgttcaaactcctgccgcaattcctcacacatgccctcgatgcatagagcagtgcagtaacttttccggcttaaagcgtctgccaccacattggctttacccgggtggtagtgaatactcatgtcatagtctttgattagttccaaccatcttcgttgtcgaaggtttagatctggttgggtgaagatgtatttcagacttttatggtccgtatatacttcgcagcggttgccgatcagatagtgcctccagatcttcaaagcgtggaccactgctgccaattccaagtcatgagttggataatttccttcgtgtggacgcaactgccgcgaggcatatgcaaccactctgccctcttgcattaggacacatccaagtccgtgacgggatgcatcgcaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattctggagaagttttcgatgaatcggcggtaataacctgccagtcctagaaaactccgaatctgcgacacggtctttggtggggtccattttgtaactgactccacgttcgatggatcaactgctacaccctgaactgtaatgacatgacccagaaatttgacttccgtcaaccagaagtcacacttgctgaacttggcgtatagctggtgctccttcaacttctcgagtaccagacggagatgttgttcatgttcctcttcggactttgaatagataagaatgtcgtcgatgaataccacaacaaacttgtccagaaattccatgaacactttgttcatcagattcatgaagaatgcgggtgcgttagtaagtccgaaagacataaccgtgcactcgtatagcccgtaccgagtggtgaaggccgtcttcggaatatcctcttcccggattctcaactggtggtaacctgatcgcaggtctatcttagaaaacactttagctcctttcagttgatcaaacaaatcgtcgatccgcggtaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctccgctaattcgttggccgccattctgtacggtctcttatagattggagcggttcctggtgccaaatcaatccggaattcaatctccctcttgggtggcatggtggtgaggtcttcggggaacacctctggatactcgcagactatgggtatgtcctccaattttctcaagttcttctcttcggtgtccactgggatttccgtctcaatctgattcaacgaggctcctttctttggcgagactagagatttgtacaccacggtttctcctttctcattggtcagggtgactgtgcgattcgcacaatcgatgactcccttaaacttggtcagccaatccatcccaagaatgacatctaggtctttggattcgagaagaatgaggttggctagaaatggtgatctttggatttctattagcactgaagggctaaaactgactgaggttgaactatttcccggggtatgaaccctcattggtgtgctaagctcttctttccttaacccatacatccccacaaatttctttgaaatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttagcccggcacgcctgggcttcgggcatttgtcagcgaagtggccaagctcgccacagttgaagcaagaccctggttttgctcccgtctccttcttggcttgcgcgggctgggctgactgtgccggtgccattggtgggcgtggagctgcaccgcggttgggctggcctccctggtggttctgactgccgctagcgccctggtggaagttgctagagtggaacgggcggtgctgtcggacgatcatggtggtaggtccaccctgctgtccgggagtgaagcgcggtcggtgctgactaccttggttggatcggaactgcgccgcctttcttttcctgtccattttgttgcgctgatcctcctgacggattgccttgtcgaccagcctttcaaagtcagcgtagtccccggatatcagttggttggtcagctcgtcatccaggcctgccataaacttttcctgtttctcggcgtcagtgcggacatcctctggtgcatatcgcgcgaggcgattgaactcgtggaggtactctgtcactgtcctgttgccctgatggagcgcccggaattccctcttcttttgcgctacaaccccgtctggcacctgtgccttcctaaagctacggcagaactctgcccacgtaacttccgtacccggtgggcgggtggccatgtggttgtcccaccaagctgacgcaggaccctgaagctggtgtgtggcgaaagcgaccttctcctgatcattgcactgcaggagattcagcttcttctctatcgcatggagccagtcatttgcctccatagggttggtggtgctggagaaggtgggtggcctgacacgtagaaactcaggcaacttggactgagggggagggggaccaaactgctggtgctgctgttcggcgtgctgcatcatcctctgatgcatctgctggtgctgctgctgcatctgctgcatcatcgcggccatcatctgagtctgatgtgccataacttgggcaagcgtcggattctcgggaagtggtggcggaccattgccagaatcaccgttggggtgcacaccatcagcgcgttcttcaccgttgctgccctcgcctgttgcgcggctaccagtcctggtgtagaccatctggagggaagaacagacggggaaaagaagaaaaacagatgctcaagaactaagctttattatataggaattaaaactgcaattgttctgatctgaattaaaacacttaaaaaggcaagcaaaaatccttattaagacagccatatcatagacacatgatatcgaccgtcaactgaccccaaacaagcaacctaaacacacaaactaacaaacaaaaactagacagtcgatgaactagtggaaaaacgagcctaatgctcggaacggctcctgcggtcggtggagtcgaaagcgtcctcctgctcgtcacccggtccctctgagcgactcctggagcctgacggatcagtctcgccgctgccactgggagtagcagacagccatcctccggtaccactggctgaacctccggcggctgatgctggagcgaaggagagagtgaacgcgggagctggagctggagctgcaggaactgcgggcggagctggagctgctgcgggggccgctggtggaggtgggttcctgggcgccagctggatgcgcacaggtgtagtcgtcctcttacggggcgtagtgcggatccggactcctcctggcgctggaagacccttcaactgagcattctccttcttcaggcgcgctacctcgtccttcagagcgacgatcctcatgagcttcccatcattcaaggccttggtcgccttgtgcaggtccgagtgcatccggtccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggctgcctcctgacaggcgtgatctgctgtgcctccagatgcctcgaccgccatgttagcgaggcaagtccccacgtagccatggacctccaagcggacacggtgaggaagctcgccactgagcggcggaatggtcgtgtactccggcgcgtcggggtagcccactaccagtgtcatgcgtgccagctctgccacgaagtcgatcatgccttctccgcggtggttgggtgggtgaccggccatctagagaagacaaaggagtaggatcaatgtatgctcaaatccaaatttaaataaagcaataaagactcaaataaaggaatcaaataagagcaaaattttatgcatagatcattttacatgagcgcgaataaataagacagactcacataacgataaaataatgggaaattagatacataatagtagtaacaaacgaagcataaacaccttgcaacccatgataccgagctaggaccgaatgcatttcacccatcaaatcccaactgactgacgagtaaatcccaataattttactaaaaccctagactgactcgttttggaaaactcactttaaacgagcgaccaagatttttcccttgaaccacaagaacagatccccgttttcccggaacaaaatccaattgcaaagaacatatgcaatgaaaaggattcagagggctcttaggtctttccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaagtcttacagagatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcatggatttaacaagggatagctaagcaggttcatttgcataaatactggcatttataaacaggaatttaatgcaaaaacagttgtaaaaaaaattaaacagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcactttatttaaccaacaccagcaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgctgggggaacctcggcgactatcttgaagtacaccggagcgtcgaaggaaccggaatctagcgacatacaaagcaatcattgcaaacaggctataagactactgaaacagagaacaaaaccatttttaatggattctacacatttttcttgatttactgagacttgaatgggcttaaacggagctcggatgaattagttatgaattttagaagattcactgtgtttaatactataaaagaaatccttaaataatttattgcgcaatattaaccagggctgacgtcagcgagggggggggtgcggcgccgacatgcgggacccaccggtcagcggcatgggagagagaggaaggggggtggcggcgcgcgggcccaccggtcagcgacccggggaaaaggaggggcggcggcgccacgtggcggccgaaccgacggccccgatctacccaagggtagatcggacggcggcgcgggacctcgcggccggggcgcgcgggcgcggcgcgagacggcggcgaccatggcgccggcggcgcggcgctcacacggcggcggcgcgcatgcggcagcggcgcaaagcgacgaccgacggcgatcgtccggcggcggagagtggcggctagcggctctaggaggagaggaaggggaaaaggagggaggggatgcctcaccgagggtggccggcgcggaggaaggcgatggcggacggcgacggcaagccacgggaggacggcgtcggctagcggacgagctccggcgtgccctaaggaaggagaagagaggaattagagagagagagatggaccatggcgatcgggatccatggccgaaggcggcggtagaggtggcgctcacccgtgcgcgtggagatgagggctccggcgacgaacctcgacggaggaggggcggacgaggtggacctcggccacgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggtgatgcttaaataggggatggggaaaccggacgtggccgggagcggcgggattcgacggccgacgtgggggagtggggaggagagagaggcgggattcggttttcgaatcccggccatctcgggcgcggcgcgagcgggagagggaggggaacgggcgcggggaaggcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaagggagaagtgggccgacggcccacttgacaaaaaggagggaaaagagaggaaaaagaaaaagaaaaggaaaaaggattttccctggaattaacaattgcactttagtgatttttaattggttaaaattatttctagagctctgaaaattccactaaaaatcctgttaatgaatttcgacatgtagaattcaagaaaaattccacatgtcaaatccgattattatttgcattactttcttagggttttctcctgatttcaccagcattttcttagggtcaattataaattacaattttgactagggaggaaaacttcggggtgtgacaactgacgcgggagcgatcatcgctggctgccctatgttgcttcagctttgggcagccgagaggtttgccataggtcgacagtggtggacagcgcaccctacggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtcccatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgttcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaaaacatcaccccgcggtaacttgatgttccatcctcgcaggacctcgtttgccttcgagcgcccctagcttcagagcagtgcgacctacaacaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcatctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcatagtccacaacagcacacatgaaaagcggcagctcgagttatcactatcaactttcggcgctgcctgtttacataaagtgaatcacgcccacgcgtgatcgtcttgtcacatctaatgcataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtacaaaatcgccctcccccagggcggcaagggggccgcctgcaaaattccatgccccctcgccgcccatttgcaggcggccccccgcacagtacaaaatcgccctcgcggagggcggcaagggggccgcctgcaaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgactacttccgtcaattttcaaaatggaaaattattttttaaaacttttaataaaaaaaattaaaaataaaaaaaattcgtactatggatgtgttactactgggcctgatttaattcaggcccatcagacaaaaggccgggccagctacgatccctaagatttaggcccatattgatcgtcagcccactgtaggcctattggaggaagcgggaagaagcaataggccgcgtgggaagcccatattttgcgggctgcctttctgtataggccagagcgggtttgcggtaaacacttgattatactcctccattcacacatacacacacaaaaaaggaaaaaagagcaatgtactcctatccaacacccgggaggacgcatcaatttgactactgtttgactatccataattttggtcaggcatcttcatgcacaacaccaccactaattagtgctaaccttttcacgcgatgaaatggtctggaaccggaagcattgtcgtttgggtggagaactaaccacgttgaacacagagtcagtaactatcgtctatctgaatgactgaaggcatcaaaggcagccacactctgaatcaatcgatgtgagtagaaatacaggacaactcactgtcggatagtaacaacaggatagattgatgtgcattatccactttgccaaattaggcgtaggctaagcacaacctaagcttctgtataaatatccagcgtagtaatagtaaagtagcactgattatcatgcatttgccaatctagatattaccaaagtttgccagaatcatgcaactttatatactactcgtttcgaaatgtttggcaccgttgattttttagcacatgtttgagtgttcgtcttattcaaaaacttttgtaaaatatgtaaaattatatgtctacataaaaatatatttaacaatgaatcaaatgataggaaaataattaataattacttaattttttttaataagacgaacggtcaaacatatgctaaaaagttaacagcgtcaaacattttcgaaacggaggcagtactagagtactagtggcacttgcctttccgtcagaattaagcaagcagacatgcatactgaattcccgatttcagtcattcaagaggcacaccacacattgagtgaccacaaaccaacgatataaacaccatattgaatactcgagattgaatgatcacctaactgtttgtgtttttctttcccttcacaaaacaagctaggatgtctctccagtctccatataaaaaatgaagatgtttcaccactcccctgtaaacaaatctgcaggttgtgcaaattcccggagttggaagcaaatttgcagcctctacattgaaaggccctgtctgataaacctttatctgtgcaaatctgagcccagattccagaggaatttcttggcaccaacactagttcacatgggaaaaaagaagccaataactgaacagatgttgtgataatcgaacaggagagtaatgaatcattttcactttttcagcctaatctaaaactctcagttcatacatctccttgaacagccaaacaaaacagagagagacaccaaatgatccatccagttggatcaaatccatcatctcgatcttgacgaatatttacacatgaaagcaagcaagaaagaaagaagcgaagaaagagagagagagagagagagagagagagagcgagagaggagagcttgccaagaacaagggccaaatcagttggccgcatgcatgcatcaaggcgccaccgccgcgggctcggtagcggtggcgccgggcggcgtcgcggccggcgcgcggcaggtcgggcacgacgagcgccggcctccggcgagccatcgctcgatgcagcgcgcgtggaagccgtggccgcacaccggcatgacgcgcacggtgtccccgtcgacgaactcggcgaggcagatggcgcactccgcggcgccggccagcttggtgcccgccgcggagtacaccagagccgggggcggcggcggcgggtcggcctcctgcacaggcggcttctccgggtcctcggcggcggcggcggcggcggctggttgttgcctggcccggcggtggcggcggagcaggtacctgacggcggcgttgagcgcgagggcgagggcgagcgcggcgagcagggcggcgaggatgacggccatgttgctggcgaagtcgccggcgccggagtagggaccccatctgttggtggcgatggtgctggtcgctgccgtgccgttggacggcgagcggtgggcgtggtccggctcgtgctcgtgctggtcgtgcggcgacatcgccatggtgatggtggcgttctcgagtagactagactagccaagaatatttcacttttgtggtagtagtcgagtgaggtttaagcttagtgcagtcagtatactagctaagctttatatcactcaagtgcagtactcaactactcaaggggagatgtgttgtgctcagctcacctctgcctctgctgctgatgaagatagatagctatagcttatgttgtgaggtgaaaccggtggaaatattcgtcgaatatatatatacatttttttgataatgcaatgaaaatcccatcctctactttagctgttacttattacaatattattaacttgattgtaaagaacgtgaagcacaaacagggtttgaaatttcggttcgaaatttcgcccccaccgaaatgctcacatctcgcccgaaactttcggttttttgcaattttttgtgaattcagtcaaactttattcaaattcattcaaaatcagtcaaaatttcaaataatttcgtacgaaaaaaatctgaatttcggttctttcgctcacctctggcagaaaaccaagtttcgaaatttaaaaccctgagcacaaatcctttggccacgtacattccggttcaaatgtagtggccggatttaaatccattttcataaaaatcaagcactggttcgatccattagtaaatttctgttcatgcttggtgaatgttattaataaaccggttgattttggaggcatgcggatgcagcaagagccaagagcaggcagagggggtgatgtggcatgcagcctttttacatgtggagtgttcctttgcttgtagtatcatctgatgattgctgcgtccctccttttaattttgtcacttcaatgcatgtgttctctcttgtcctatacatcccctatctatcttcaaactgtgcatcgatcgatctggcaggcatgaggagaatttgtatacatccgaaaacatatacatatactggttaattaagaaaagtcaagtccttttagctactagaactgtattactacagttttcaggctctcactgtttctgtataagctgccggttggtcgtcagtcagctcgatcgctcagataaggtcaggaaggacatacagtaattaagctcttggtgatctgaaattctgatttctcaatcagatagatgataagacattcatttggagtatacagttaattaaggatgcattaaggagctaggagtagtacatttggtgtagctagatgatattctcacgcattcagcaagtggcaaaatgcatgcatgcagccctgctggtctgaactctgaacccaaggatggacagctgaatgtttgctttttttctgaaagagtatcatctgagatctatatcattatcagctaagttcacggccgatatggcgcaatgcaacgctgtagctatcaggccgcttgtaagtatcctttgtgctctcttctattctgttgtcggctacagctacagtacacccacgtatacctgaatatcagaatatgagataccctgatgatgaaaaatagagaaaaatggaacgaaaaatataaatgctagattaattgttcttgggatagaaagaaaggttccaaatgggtaaagctgcctaacccacaaacacacacatgtatatatatgcaccttttttattagatcagttcctttcagatgggggacactagactgactgctacagagaaacattggggcctactgctttttgatgtcctgcatttcacatttctttttgagaaaaatgatgcgtcgacgttatggtacctgatgatggaggattttatacggaatataattcatatacatgatcaactagagctacttgtcttgtctgagttacatgtaaggttaatgaagtataagatatttattacttgtaatgaaacaaggagactatacagcatttgggaaaaagaaagatagagagataaaagaacaggacaagaaattaagagagaataagggaccctttcaattgggaaaatggagggggggtaaggaaaacacgggaattttacaaaaatgtaaatataaaatagagaattgtaaaataaagaaaaaacatagtaataatatttttattggaccataaaaaaacaagataatttgaggagagataatagactcaaaagaatatttctatgggtttgtacctcatgttaaatttcctccaaaacttatatgaaatgagttattttctatgatcatatagtgttcatttatttgattcaaatggctatataggaaaaaaaacctctaaaatttctagatttttctttaaattaaagggggcctacctaaaataagagggtatcgggagtggaccctatatattttgtatgataatatgatagtaaagtcctaccaggcagcaaaatcgttccaatgggcgaacaaaattaagaaggaatcgtacgttttcattagcgtgtgatttggttgcgtatgtagtccggacttaaatcgcccaattactcgatcaatcaacattccctttatgatttctttttcatttttgcgctggtcgatcgtactggaacaaggacgacgaagacgccgtacaccctgatggcaacatggctagcttagctagctgacgaacgagattgattgcccgatcgattgttctagctagatcgatcgggccgctggaaggaacgaaatgaatcaagcaagtagtactgtaatcactaacaagggagcatgtcagtctaattgtctctttgactaacaaaattgctctattaggatataacttttataaaatgattaaatttattatactcatattcaaaagtattgtactacttttgtaacagagtaactgtcaaaaaattaatctaacaaaacagaacaagtatatttttaacctacagaagtgatcgagtagaactgtagaagtgtacatgcatgatgggcatggagtgccattccagcagcaaactgagaagctcacaaaagcaatcatcgaatcgtcaaagatagacatgagtgagagtatagacgatcgatgcatgcatcgaggaggccacacctgccggggccatccattcattgttccaactaacgacacacctatcttctatctatagctatttcgcggcgaccacagattctgcccaagcggtttttctttcttggagtaatacaattcttttcatcgtaaactagtacaaatatatattagcaaaactatgatgtactccatatatataatattttttccgtttcacaatataaatcattttaacattttccacattcacattgatgttaatgaatctatatagatatatagaaaatgctataatgatttttgttgtgaaacggagatagtacttcatttctttcgtattgtaagttatttaagttttttctgaaatcaaacctctttaacaatttgatcaagcgtatacatcaacatgtgtgataacaaataaatatattatcaagacacacttctaggtgattttagtgaaactaaattgatattgtagatgctggtatattattctataaaactcgatcaaaatcagaaaatattgattttggcttggctagtctatttgcatagaaagcaaagtgtgggtgattagtgtatgattgattaaggtttaactatttaaaaacttgataatgggtttttttatttctttaaagagaattatataattattttcgttttgcacgaaacacaatatttgtcaattcgaaaagcatgcttatgataaacgagaaagtaacaagttctaaccatagtatcgaacgcaaccttacaacataaaacaaatagatcagtacatgatagggacaaggttttcttttcaaaaaaataaaactgaatgtgcatagtcgagtacaagctctctcttacagacgggtaaagggttatctttcccatgataaacggataaatcttaccatttttttattttataaacttgcttgcgttagataataaaatttattctggccttggattaaaaaaaaactacaactaattattagagaaagtctataactgcgaattagaaaaccactcattatcatgatcgacggttggactactgcaggcatggaagcaatcggcctatatgcaagcaaggggggcggcctgggtgtgggtgtattgaatggagtgcccggcccggaggaggagaaaaccaaagagaagagaaggttgggctacgccactcaaaactgatagcagctgattgcactgctgctgctgctgcaatctactcgtatctatcgctcatcgatcgctgatagatagatatgaatgaatatggtgcatgggcgttggttagtttggttgggttggttgccgtatggatgagggaagcatgcatttcaggaaaatgatacatatagatagactgattgattgcttggcactgttagctgttacccgatccatccatccactactgtaactgctgtatctgtatctgtatgtacgaatgtatgatggaccagcaaatctatatatcgatcatctgcagctgatcgatgcaggcagctatctacctctatgccatgcatcctttgctgctaattgtacatggttatggtatggtatgttcctgcagttatgccgatcccgcttcacctgctaaaaagaccagtacatccatcccattcccaggttacaacaactcagtatcggatttgacctacaattttggatgtcatgtatcgggacgaacagagttacaatatacatgcgtgctgctgcttatttactgccagctctttctgctagttggataaatatgggcctaacaagattgttctgtgggcctcagttaaatgggcttctcactccagaagagaagatgggcctaacatggaagcccacctaatgtcccccatgaggcccatgacaccatcgacaaggcctccccccccccccccccccccctcccttccgactccgaccgtccgccgccgtcacctcgccgccgcctcctcccctctccgccatagatacggatcggaggagaaggagggactcactccaatagtatcgtctattattgtttgttgctctcccctcccctcccccgtgcgtacgtctccgattaccaaccaggtcgcccgcctctcgtcgccgaccgggccggagctgctcgatctgctgcagtacgtccagcctgcagcaattcggccgcccgcccgttgagaggagagggagaggagatgatctcatcttgccccatctgcaacgtccaggttcttacggctgagctccaatggtatagctcttcctctttcttgatttcttcttctcctctctagtctctctctacataacgtacagtatgctatgctactgctgcgattttacttacctccattgtggtctgtgcttcaccaaactgattcttttcatcttttgctaggcatgcgaatgcccattttgacgatgatcaactccaaaccgacatggaattggcccaccaaatcgccctcactcaatccacgcccaatcccctgctgctggtctgtactcctccccactactcttattctgctgctcgccttctcattcttaagtttaacctatgctgcaaacatttcctagtaacaattacactcctgtcccgcctattatgcaactagctaaatattgctgtcattgtcctactacttcatctgtttctcctataaggagtgaaaaaaattcccatgtagctgtcctcttttgcaggacactcatcaagaatgtaacaatctgttcgctggtgatcctcatgctcaaggagcctcctcaagcatcgccggaagctcatcacttcagggaagtgttttggatgagcaagtatcttgcttgctccaagcgcaactccgaagcaatgttcaggaaatacaaggaggtgttatgaacttgttgagagcctgcctggaatcagaagctggttcatcgacaagtatgatatcaggacatgttgatcactatcagagtctttcatcagaagataaggggtggggatgtgggtggagaaatatccagatgctgagctctcatttgctgaagcaaaggccggaagcaagggaggctttatttggtggttctggatttgttcctgacatcccttcacttcagaggtggcttgagattgcttgggataagaaatttgatacccttggctcaagccattttcataacaaagtttatggcgccaagaagtggatagggaccacggaatgtgctgcccttctccgctcttttggtttgcgtgcaagggttgtagattttgatagcacggaatcatcaggtcctcacagtaagaacggaaaacatgcaccaaaaagagtacaagggccaatggacaagttcttgataaagaatgtttctccaacatctacatcttctgaactttgtcgagaagatgctgaaaacatgagaggccaacaggttcttgttgactggatctggaactactttgctagcaggcattctgataactcggacagttcaaggcgtgtgcttgtgagtgataaaacgtaagggatgttctcagaaatgttcaatctcaccatctgaaatgcttgcagctttcgtaagtgcatgttaacactacgcttaagaatgttgtacactgactaatgtgtgttattcgcagcccattgtatttccaacatcaaggtcattccagaaccatagttgggatccaaaagcaaaatggtcaacatgggaatcaagatcgatttacccttttgattttggaccctggccatgtaagctgtcgctactattcatttttttaaaagaaaaaggaaaaagaaagttgttattattcactttgtagtatatcattaatttttgttcaattgtgcatattttttattattcaatcttctgtaaacatccagaaaatttgttctacatttctctgccaaattaagatataaactttgctctaacggtttacagagaacgtcagatttggagagggctcttcgaagcaagacaggatggcagcgtctagtgaaaagaggtgtccacactcttaggaagccacagtatcaggtacatcaaatcacccaaaatttatgaactttgaaagggttgtgcagttcatacaattctgatatgccttcgatttttcagttgtgctatgtggatcctggaattgctagttcagaagaaatggagcagctgaaaactattgatagtatcctggtcaggttctagaatgctggtgcgtacaatgagtaatcgtgtcttactttgtcacatgctaatagaggaaaatgatacagtttgctcgctcatgtatatgaaaagtcaaaagataatcaatgatgtacttgatgaaaagtttatgcaaaataacaatggatttacatacctgtattttgttgcttcatacgaattagtaattttggcctacttattgacattcaacattggtcgtctcaattgtctttatctaattatgcaaacatttgttaaatggaggagacaggggaatacatagactacaaggcttgggatgctcttccctgcttggagaaacgtggaccattgatgcattgctgactgctgagctctgcgttgggttttataatgtatgtatggcctgtcatgcttgtctctatagagaagtccaataatttccttttgctttgctcctacttatttaaacattatccggacactgagcattgatgcccttaaagtcattgtttttttagctttatgtatattatttcctttagagttttgttccatctatggttgttctctcttttttagttccattggtttctttcttgtattctaggattatataaattaatttatctattcaagtagcatggtgaaaatattagaaaatcagcaacataagaacaattttgatacagtatttcagcaaatctaagaagtaggagtataaatatgagaatcaatgaactttaagaagataattggtaagcacatattgttattacaatccttcacctctatttacattattctttacttttatgtgcattcaactgacattcatgtcagtattattacgtgtctatgtataacttcttaactttattgttgaatattccttactgcatcctggttgttcatggatctatatactgtatggttctggtagttgaagctggcaaaactgactacatgagcattatgcgtttaccatgaaccttactatgccaattctggaactgtttactgtggtatagatgcagtttacgtagaaatgctttggcaggattgctgctgcttacatgatctgtgaagtaggctgaatgtcttcagattgcttattccagtgcatagctcttgcatcttattctgtgaattaccatgtactatctgaagttgtgaattgatctgcatagagtgtttgcctttattttatagatgccttcttggagaccctcacaagtcacaaccagttcaactgaagtgggcgactttcataatgcatctgattctgaacactggggttgcatttagttacaagatcagattccaatagcaaatcgagaggtgatcggtcccaatagattgtctgaaactggtcaggtcatctgaaccttgacaagatctgtagttgtcatttctgttagaatgtatgccgccttggtaaatattccttggcagatagtagctcttttattatgtgaaacagaacatctgaacgtgactttggtaatattccattctgcatatgttctctcgacgccttttcatcttcggtgcttacaatttgcagtctacctttgatcttcctttttccctctcccttgaggtctcattttccctgtctgaaatacgttgggagatcatgcaatttccactaatattggtgcatagaactgcactattttgtaccgacatttgtcaactttcgtcatattgagcggagcatagtaaactaaattttgttactgtcattgttagtatagtattttgttgctgtcattgttagtatagttttcttgcctttgtaaactactagtaaaacagttttcactgtaatggatgaacagtccagatagccgatatataatattttgacagtggtacatgctgtcatgcagaagtgctgacaaaattcagatccattttgaggtccactcccttcgtcccacaaaaaatcaacctagtactagatgtgacatatcctagtattataaatctaaacatatctctgttcagatttattctactaaaaatacgtcacatccaattctagattcattttttttagggacggagggagtaattcacattagttcagcatttcacttggcagaaagtaaatgagtgccagcaaatgactctggctgctaagcccaattcgattgaccatgtcatatctggtatggaactgggatttggtatatttttaagctagctgtctttgtagcgtcccagcataagttcagttacttgtgtcattagattaagaggtaaacatatttaattgagaagaaaataatttgcactctttagaccagcctccacaaacgaacaggatccgccgcactctctagaccacggcactactcagcgttctttctcatttttaaagaccctgtcagcttcattcattttttttatgaagatatccttagcattattagagctttatccatgctgtgtggtacacagaaaatctctgaaaattatatggttctctactaaaacgaccatattctatctttggaatttcgatcgaatttaaggagccgagcacacgcgtgtaaatataaagcttttactagtatttttctgctttgagaagaagagcaatttagttgcacgtccaactcttcctgtaggcaggcataatgtagccgttgaaattaaatccctgacgaggatagttactgattaattattggtgacagcggtagttaactactcaaaccgtggtagtggagacagcagtgtactctatttaccagcaatttaacactatgtaatattgttcttcctttcattgagcagtttgaaacagatcatttgatcagattatttatactaaattatctacacgattatatacataaattaactattataataaataaacttaacaaatagcttaaatcaataaatctaagcaatcgatagaattttttatagaaaatatataattttaaagacttaaaacaaacaatcagcaataataatgttttattttgagatggtagatgacgacagaatcacgaaaaagacgtatcaatgaatttaagcaatcaatatttttttagaaaatatataatttgaaacaaataatgggggacaataatgttttatgttgagatagcaggtgatgacagaatcacgaaaaagagaggctaccgtggcttatctctgtgggccccattggtcagtaggatattagggagacatgggcccacgcgtcatcctcacgggagcttcttgtcttctctttacaagagaatagagaaagaagacgaccacgccaccaccgctcgtctccaccgcgagcgaaacccaaaaaggcaatggcgaccgacggcgacgccctcgagtcccaggcggcggcggcggccgaggcggcgcgggagctgcgcgaggccgccgcgtccctcgtcgcccgccgctccgccgacgaggacgcgctccgccgccgcgccacggcgctcgacgccgacctccgccgcctccaggcctccctctccaccctcgcccccaccacgctcgacaaggtgactgcatctcgttcttctcttctactcatctccctcttcctcttcctctccccgcgcttgcttccaattcgatctctctctctctctcactcacgcgtcgcctcgtacgggtttcggcggcttggaattgaaacctacgagctgctagtacgttagatcgtgattcgtttcgtgattatctcgcaaagcagaacgcttacgcgcttcacgccttcgcctggaggattgagatgtaaagtttgcacgcccgcgatctggtgctcgtcaaacactggatttgttgcgccatctccctggagatgtctccaatttacatgcttcctattggttttcaaagttaggaatctgaggcgtgtgcatcgagctggatgctggccatggccaacgattattattgttgttttttgtattgaaatctcgaggcagtttaggcaaactatagattccgtcagaaatctgtccccatcctttactgctccgtttagagatccttggaatattcgctctccctcatgcttgtgcaaatttgtaatgcatccactaggttgctcagtacctggattgagaaacattgtccactgctccgtcgttgctaagccaaaaggtttaatctcaacctagagaattattacaacctatctagatttaatctccactgtctcccatgcatttctttagcacgcacaagtgacaaaatttgacctgtttctaaattgatataagagtctccgtccgcatgtccaagtttatcgcactcctttttagattttctacttaccttttgtacctcttttctaatatatagttttcttctgtacttctgttgtgtcatctgtgagaattgtctcattctgccatttatctatataggttgaggaggaactggagcgtgccagggtaacaatctcagatagtgacgtggctgcatttctcccaagcaagcggaatggtatgctatgatttatctcaccccccatgcccgtctcggggaaatataactgttatttatggaattcacttctccttgaaatttagggaagttcctcaagacctttgttggccctgtaaatgtgcgggtggcgagaaaagaagataagctcagagtgaaggacgagtacaacaactacagggtagattttagatgcttcttcgataatttttttttagaaagcttatgcatttactttggatatgatttcttggaccaatttaataaagctatctgtactttttattacttttattttgatgacttaagcattctaaatttccaatgattactccaattggtgtattctttaaattttgatctgtgataagaatcactattgaagagaactactaccattttctacaaaaatctaagtaaatttcagattatcaaggtcaacgagtatggtgtgtattcaatctcagacagcatgctgataaaaccttgaacctgttttgtatgtcatatggtttaattagtaaatacgggaaacatgcaattctggactaatactctagaaatcatgttgaaaggttatgtaagtgttccttttcatgtcgaattcaagcagtcctttctaaattgaacatagtggcttaactggtagagtatacttggtataattttcgctactataaatttttatgtcatgcctgacagtattgatggtttcatttatttgcaggatagggctgcctatatgtttctattgttcccatccattctcctcctacttagatggtggatatgggatggatgccttccagccttggcagttcagatgtaccaggtatttagtgccgtgcagtgattgaccctgaatatattttctctatgtatgactttgctgtccagcagaaacgatctaaagtttatttgttccacttaacaggcttggctactattcctttacacaagttttgctctgcgggagaatgtgttgattgtaaatggaagtgatattcgtccttggtatgtgtctgaatttcattgcttacagaaactgtcaactgcagcactcaacaattttatggcaaatacccatttttaatgcacggacagacaaaagtgcttgatttttttactatatgcgacttataatttgttggtatgggaaagatcttatatcaaaacatcttttaatgatattcgtaaaacccatgtttcgtttgttcacttaatctagcaaaatcaattcctttcttagaatgcattatcatcttttcaggtggatataccaccactatttagcaatgctaatggctctcgttagccttacatgggagataaaaggacagcctgattgttccagcaagcaggtaaatgatcatttttcagagaaaactagcactcactttgtcatcaaaccttcaaatttttggaacgctgaactcagacactatggctttcttttcagaggggggtacaacttttcctgcggtgggcaatcatgcaaggaattgcaatgcatctacagaataggtaccagcgtcaaagattgcgcacccggatagctctaggaaaggtaaggttctgtggttcacgtcttgcttcaagacagtactcaacaacatattcttttagtgccaagtgaaggtgtacaacatgttccaataataagattcaaatgagtatcatcttcaaatgatatgtatacaatgcagatgcttatcaaaagcaatttaatgcactaatttgcttgatgtttgttgatatttgcatatcagctaagagttcggaatatcactgaaactaatttagagaagatgctctggtcttttaatcaaactaagtcttataggcaatggttgttcatacagctcaatagactgttgaaatgatgctgtatattgtatcatctatgtacctttctcaagttttatcggtgttgttatttattctgtttcatatttaattgcatgcaggctaaaagaatggatgttgttgctggagaaacagctggtgtggaagggcagctcttgctactttacccggtccttttcacattacaggtatgtgtaaatgtgtcttgtgagctgaaagcatggcagatccaagttgttagtaattgtagccccccacccagaatatgttgtctcacgttgttggttcttgatattttagtcacttgtttcttttccttgatgaagtttgcttccgatttctggatgttagcacaaagatgattaattaaccattatatatatcttccatattctgcactaatgcgcttaatcttggatgctatgtgttgtcaggttttcgaaggatatgttggagtattacttcttaagacggctttgcacgggcttgcatcggaatggcaggcaagaattatcaactatgtaatgtttgcagttgatagttaatcagatcttcatgagacttaggctgagtttgtttcttagagttcccaattccccttattttccgcgtgcacgctcttcaaactattaaactgtgtttttttacaaaaaaaattctataggaaagttgctttaaaaaacaaattaatccatttttcacgtttttttagctaatactccctccggttctatattaattgacgttttgaacaatgttgaggtcaaacttttataactttgaccatcaataactttaaaaatatttagtttaaagaaactagaacaatatatataaatttgtctttcaaagcactataataaaagtaaacatgcatttatttattgtatatattataatagaaaaactagcatggtggcccgcgcagattgcgcggctagcatcattatattttctatcatataatagcatatatgttttctcattatattattcaaatatattaaaatgacaacataattttaaattttgcaatatgtgtaatattcatattatattttatatacatgttagttattaattatttttaatatcaatttttagttatttgtaaattatatatattcctatatggactctagactcgtcttttaatatttcctttttttaattccgaattttctgtaaattgtatttctatatagactctatgctcttctttcaatattatttatttttatttctgaattttcatattatattttatatacgtgttagttattaatatcaaattttagttatttgtaaattatatatattcctatatggactctagactcgtcttttaatatttcttttttaaattccgaactttttgtaaattgtatttctatatagactatgcttttttttcaatattatttatttttatttctgaatttttattatttctaattgtatttctatgtggactctaaactcatctttcaatattcttcaatttttaatttcgaatttcagttactaataaattgtattcttatgttgaccttaaactcttcttcccatatttttcttaatttcgaattttagttatttgtaaattgtattttttatacagactctagactctacttttaattttattatgtttattccaaattttagttagttttaaattcctatatggactctatactctacttctagtatttcttttttaaattccgaatttctattttttttcttaattgtatttctatatggactctatactctacttctaatattccttatttttaatttcaaatttctattatttcctaattgtatttctatatggactctatactctacttctaatatttcttgtttttaattccgaatttcagttatttcctaattgtatttctatatggactctatactctacttctaatattccttatttttaattccgaatttcagttattttctaattgtatttctatatggactctagtctcttcttctaatattccttattttttaattccgaatttcagttatttcctaattgtatttctatatggactctagtctcctcttctaatattccttattttttaattccgaatttcagctatttctaaattgtatttctatatggactctgctttttctttttctccgattaatgtgagaatttctaagccatgagagcgaacgtggaagctcctttttctattcctttaattatataatagataaggtcaaagatatatcttgtagaccgtgtctttgtccaaaacgtcaattaaaattaaactagagggagtacttaattaatcatgtactaatgaactgctccgttttccgtgccggaggggaacgtttccaaccagcagaaacgaatgcagccttagattgcttccttgctcaaatctactgctgtttggcctttttgctcagtcatctgcataaaatgcatttccgtaatatttgaaaggaaaaagaactttttagaaaatgtaatgtgctgatgaagctataagctaaacaatcccaaagcatccttgagatgctgattgtcctcaactgataatttataacgctgccatttttcacttgccaggttgtagtttgtgggatcttgctggtggtaatggcagtcggcaactttgtcaacacgatggagactttgatgttaaaattgaggttcaaagcaaaaatgaaaagagcaaagagcaggcaggatctcagtcgccaacaccaaaattgacaaagtgacccataatggtgactccatgcttggaaacagcgaatgctgacacaccatctctcttgtaaatcccttaatccataaactgttttggctgcccatgattttgtgttttggtaattgtttcacattgaagttcatattctacggtcaatgcacgattaaaaacactgttaactttaccacagatgggaacgctaaatttatgtgatttgtatgtgctaacagcgcttgcctaaaattgcagagaacaataatgtattatgtcagtagtcagtagattccgtggctctaattgcagagagctagtaacatgctgaaaatgaacagtccacagctcagaccatatcaatgcttctgtggctctatttagtggcattagaatcgtgttcagagtcttgtccaaagtttgaatgtttcacaggtttttttatgtagtgccatcagaatttgtgttcctctatctttgtgtttgaagggttccatgcagaacacccagtgatatagagaaacatcaatagaaatcatttggtctgattggacatgagagttgtaactcatcagtatgatctgtgttcttacaacctctggttggtctttaatccatagaactaacatagaagaattggcagcttgtaaaccctttacctgttggttgaaaagtcaggagtgtgtgataaccattttgttccccattttttagacaatggaattttgttttggacatactgttgtacctattgggaatacattctgcatttatgagcttgcatattggcaatatcttccatgctgtggtccagcaagaaacctttgcaagtttgcagacctgccaatcatcagtgcttgagacaaagcaaaaggcaacggagctcgctactgtgtatcactctgattgcggtagcctctgttctagtacctcaaattctttcaactactgtgtctaatcatatgcaatccatccaatgacatgcaccatcatgattgaatcattgagcccatctcatctctgtatgattagtttttgtttgtcagttccacacctgaaacccaagatcatagcatccaaatgcacaagctgcactcttaatttagaaatcaatatttacattccagtatttcatcactctaatcaattgattccagttctttcctaagcagtgttcatcgtttcctacaattaattaattaccttgccaataataaaacacacagacacaaaaataactaagtaaatcatctacaaaataaaaataaactgcaatccgatatccatcatgtggaatcggaggcatcgtgcaggtcgtgatgagcaatggagatggacgtcgccgccttctccgcgatggccgcgcgcacctgcgccatcgtcggccggaggcccggctgcgccgccaggcactcgacggcgatcctcgccacgtcgccggcctccgccgcgtcgtagtcgtcgcccagccggcggtcggcgagcccgtccaccccctccgtcctgacacgcggcagcaaccgcgccgtgaggttgcccccgccggcgccgccatccgggccgggtatcccggcggccggcgagccggtgatggcctcgagcagaagcacgccgaagctgtagacgtcggacttcttggagacgatgccggtgcggaggaagaaggggtcgacgtagcccggcgagccgacggccgccctggtgggcgcgacggcggcggagaacccctcgcaggcggagcccaggtcgcagagccgcgcgcccaggccacggccgtcgaggagcacgttggacgccgacacgtcgccgtgcaccaccggaggcgcgccgtcgtggaggtgctcgagcgcgccggccacgtcgtggacgacgcgcatgcggtggcgccatggcagaggcggcgatgcgccgccgtggaggcggtcggcgagggtgccgccggagaggtactccaggaccagtgcacctccctcctctgcacgcagtaataaaatttcttttaattaattaatctctttaattaacaaaaaatctctctcttagtaacaaacgtataatattataaatcattttgacatacatataataccaaaatagttttattaaaataaaattaaatatattttgataacaagtttgttttatgttttgtatataaacttaaataagtttaacaaagaaaaatcaaaatgatttataatataaaacggaggggtagcaggttaattagatgaagtataaaatcatttgcaatttctttttcttttttggggggatttgcaatttcattcatctggggatcaaaattgaattagaattaggattaaaatgatatatacgatcgaaagcgatcgtgttgagttaagttttggacgacgaaatgggacgaaaataacacaggtcgttactcgttaacgtactagacataaataggcaacagtgaagtgacgtttgttcttaatcgatcggtaggtaggaggtaatctccatttcttcttcttattgttttccccccgtacgacgtacgcatgccattctctacacatgttttattcggtcgatttgaaatttaatttgtgaggtgaaatgtaacatcatactagtagtattcatattgaactaacttaataacaaatcttaagaggagaaagaaattaagcaaagtaaataaataagaaagtgaagaacatagcaagcagcaagctggagtagctagcatcagagttgcatgcagatgcagtgtaaagcaagtgaagaacagaaaaaagatgttcccttttaagacttttaaccacaccgagacgaggtaacgtaagcttagagtcaaagcttcaataatttgtgcaaggaaaaaaaacacacataattcaagcagttggagtagtaggagagaggagagtgacgtgtaccgtggtcgtcggagtaggcgaggagggagacgatgtgggggtggcggaggcggcggagcaggtcgagctcctgccggaacgcgcgcagccaccgctcgccgccgcaccaccggtgcaccttcaccgccacgggcggcgagacgacggcgaccctgcagctgcttgccaggtagaccgtgctggagccacctcgccccaccaccgccgcctcgtcgaagccgccggtgagcgcctccacctcccgccacgtcagcttccaaggctccccctcctccttcgtcgacggcaccaacttcgccgccggccgcaacaacggcagctcttgctgaggaggaggagaacacggcggcatcagctgtcgtgctcccgccccgccttctgcggcctcggcgtcgacgtcggcggcggcggcagcacggtggcggcgccggagcccggagaggcagtgacggaggaggaggaaggtgatggcggcggaggagaggaggaggaggcagaagaagaggacggcgagcgccatggccacgtccatggcgccgcgctaagcttagcttcttcagtttgggaaagaaatgcaaagcaaagcaagagcagagcagaaaatgggttcataataagtatgcatggccagattaatgtacaggtggcagtttagttttactacttaaccacagctttgatttgatttgatttgatttattaatccctaatcttgattccccctgtgggaatttaatattaagctagcccctcaattctggtcaacgaatgattatattaacaccatggtctcatctggtctctgtatatacatggttgctgttaaaaattgtttttaattcataatgtgaataattacactgtctcttttaatttatttatttattacagtaggagtagtaccttcccatacggtgaatatagagtcaacagcatcacatgaaaattaaagagagggatagtaggatgcattaaataattttgcagtacaacaacattttgaaaatctctgggtccttacgatgtacggatacagatatatgaaatttaaattttgggagtgagtaaagatatatacacgccgacacgtatgcacggcgtacgcgtatacgcagttggttggatcaaatccccacgagttagcgactactaatcaatttgggattaatttgccgatcgagaatgaacagtgcttccagttaatgttgttcctgtcagtaccagcagtttgtactcagtttgcgtggacggcgcattataatatataaacactcctccaaatactcagtgttgttaatttggacagcgcaagtaatctcgaatttaaattttgagttgtttttggagtattttagcgacgatcgatcagtttaacggactccacgaggacgacagcttacgaccaatgagttaatgagtggtgggttctcccatgccctgcagttaatctactgtgcaatacttgtgttaattacttcttcacctgcgactactgttcttctgccagccaacacagtgtcatgaatcattttgatttccatacacacgtgtaacatccataatttaaattttattttcataaagtacaacatactagtgtgttcatttcgtgaaagtgctaacaatcttatcttatactgatatggtttttcaagctagctagttaaacacgatttttttcagtgaaatttaaacacatgctccctctttccttttttttaactcctatgtgatacgtaagaaaacaaagggagtatcttgcacgcaagctagaggtgtactaggcatagaacgtgacaagagacagaaaacaaacaaatctaacgaactaccagataattacaattaattagtactcctaattaaacacaagagaatcacaaaccaacttattagcggcgtatagctagtgtagagtggtactgccttgattttaatttagccgtgtgagtgaggcaactgtgatatgcctagctagctaattaagcaggagtagtactaattactacatcctatcattgatgagctctatctatccagctcgaagtaactcatgtcgctcttcacctagtggtacgatctagctagctaagaaaacccaacgattgattaaggttgatctgttttagcttgtcgtaactaaagctggagccaatcatttaaggtttaatttgcatcatgtgtatactccatatatatattgttgggttagttatgcacttatgcaatgcaagcaaagaggttaggttggatttatctgtggatttgtcagcagctgtaggctggctgcttcagttttttctgtggattaaatctgtcccctgtgttcagaagctgcattatattgctgcatgcgtgtggacaagggaaaaaacgcatcgcatgcttgatctttatggacttttggtgaagcgtcgctttcttggtttcatactgacaaagtcattcataagcaatacgagctaggctgcagacaaattgatgatccattttgctcacatgtacaactagccagctagctgattcaatggaccttctggtatctcaaactgcttacagatggggaaaaaaaggatagtagatttgttattatgctgcagggtgaatagactgaattctgaatataagtcactcatgtttggaacggagtaattaacgctaaatgtaattaattaagaaccagttgattgattcgttcctacttcctactactctcactgtcatagcagctgcactgtatctatccaaaaagatcaagatcaatatacacaccatcaggttcttgttctagttagtacatagctattacctcacatattcaaaaggggagaaaaagtcagtgcccaactaaaattctaggacccaagtaataatgccaacagaaagaattgcgattgtcatacttcatcatgcataaacaaaaagaaagacaagtccttgataaagcaaagagaaaacctaaccgaactaattaatcgattgaaatagtaggataagagaaaaaggagcttactcaaagacgacaataacctggcacaagttttctaccgcttaattactcgccttccctttcatgatattgtttgatttattgatgctaacatcacacaatcaaatttaagcgatattaataaggaaaaaaagggacggctaatttaaagtgacactcttccaaacctacctgctttagagcaatgcaaccaaataataaattgctatgaagaacctaatctagctcaaaatattggaagcacacaaaaccccccctaaagatcctgcatatccaaatccagcagattttgagtgcatttgtgtggagtagctactactgtacctggagtatatctaagcaatcaatataatcgttggttaggtttagaagatcatactatgtctcagggattaattggaagcagtccccaaaagtaaaagccaattgtcttttagtagttgttaacaatagaataattttcttgagtttccttataggaatggcatactgactttaatttatttttcaaactcttttgtattgaaaattcttgttcataaaatgcgacgcacattttcattgaaaggaataccctatttcacagtctaggatagaggagtaacaattttgagtgatcattcctgctccaccctgaaaatgatactacctccatattttaatgtatgacgccgttgactttttttcaacgtttgatcattcgtcttattcaaaaagtttatataattataatttattttattatgacttgatttatcatcaaatattttttaagcatgacataaatatgttcatatttacacaaaaaatttgaataaaacgaatagtcaaacgttggtcgaaaagtcaatggcgtcatacattaaaatacggagtgagtagtatttttttttctttcagtagagtatctccagttcctttttagggcaaaacttgcctcttcaaaaagtagcaccctaaaacaaaaaccttactaaaatacttactccaaaacttttttctcgttgatatatgccattttacatttccatgactctaatgaccgaatgaggagagcagtagggtgcttgtgcagagtatatatggcccagagaaacgggtgaaatctgggcctaattgtttgagcggtagttgagcccacctggcccaaattgttttcctttcgagagagcctgagggctacaacttgatgggccgaaaccgacattaatccagcagcccagtactattttgtggatgggcttatgggcccaaaccgtcgtctctcgaacgaaccgacctgagcttagcttatgtcgtcatcttttagagttagggctcgcctcgattcgttccgcgagaaaatccagtccctcccatcccatcgccgccttttccttttcctccaaatccaacctcctcttctcccccttctccggcgcggcggcggcggtatcaccggaggcgccgaccctccctcggctcgccaaaaggtaacccccagctatccctctcctcctcctcccgcttctcctcccgcttccgcacgaaaaaaccaactgaaaaaccctatcgatctgcagccatggcgaacctgggcggcggcgccgaggcgcacgcgcgcttcaagcagtacgagtaccgcgccaactccagcctcgtcctcaccaccgactcgcgcccccgcgacacccacgagcccaccggcgagcccgagacgctctggggcaggatcgaccccaggagcttcggcgaccgcgccgtccaggccaagccccccgagctcgaggagaagctcaccaagtcccgcaagaagaaggccgccgccgctgaccccgacgacctccaccgccgcgacgccaagcgcaggcgccgcgccgcagccgcccagcgtgaggtcagcgtcctctcgctcaccgacgacgtcgtctacaagccccagaccaaggagacgcgcgccgcctacgaggccctgctcagcgtcatccagcagcagttcggcggacagccgctcgacgtgctcggcggcgctgccgacgaggtgctcgccgtcctcaagaatgacaagatcaagagccctgacaagaagaaggagatcgagaagctcctcaaccctatctccaaccagatgttcgaccagatcgtctccatagggaagctcatcacggatttccatgatgcctcggctggtgattcagctgctgcgccatctggtgatggcatggacacagcgctggatgatgacatcggcgttgctgttgaatttgaagagaacgaagatgacgaggagagcgatttcgatcaggtacatttggtgtttctctttacaattcttttcctgcatatggctaaagcatgttatgctagtgtttacttacaaggccttcattatttctcctcgtcaggtgcaagatgatttggatgaagatgaagatgatgacttgcctgagtcgaatgcccctggtgctatgcaaatgggtggcgagttagatgatgatgatatgcagaactccaacgaggggctgaccataaatgtacaagacattgatgcttactggcttcagaggaaggtctcgcaagcatacgaagatattgatccgcagcacagtcagaagcttgctgaggagatcttgaagataattgctgagggtgatgacagagatgtcgagaatcggcttgtcatgctgttggactatgaaaagtttgatctcattaaactgctactacgcaaccgactcaagattgtttggtgtacccgtttagcaagggctgaagatcaggaacagcggaagaagattgaggaagatatgatgggtaacccaactttaactccgatattggagcagctacatgcaacgagggcatctgcaaaggagaggcagaagaatctagagaaaagtatcagggatgaggccaagaggcttactaaaagcgaaaacactggcattgatggtgcgagggatcgtagggcagttgaccgggatatggagagtggatggttgaaaggccagaggcagctgcttgatcttgacagcctgtccttccaccaaggtggtctcttgatggccaacaagaaatgtgagcttcctccaggatcattcagaacccctcataaggggtatgaggaagtccatgtgccggcgctaaaagctaagccatatgaaactggagagaagattgtcaagatatctgatatgccagagtgggctcaaccagcttttgctaagatgacacagctgaacagggttcagagcaaggtttatgagactgcccttttcaaaccagataatattctcctctgtgctccaacaggtgctgggaaaaccaatgtggctgtgctcacaatccttcagcagattgggttgcatatgaaggatggagtgtttgacaataccaagtacaaaattgtctatgtggccccaatgaaagctttggttgccgaagttgttggaaatttgtcggctcggctgagtgcatatggtattactgtaagagagctcagtggagaccagaacctgaccaaacagcagattgatgaaacacagataattgtcaccacacctgagaaatgggacattgtcacaagaaaatcaggtgacagaacctatactcaaatggtaaagcttctaatcattgatgagatccatctacttcatgacaacagagggcctgttctggagagcattgtttctagaactgtccggcagattgagacgaccaaagaacatatccgtctagttggtctctcagcaactcttccgaactatgaagatgtcgcggttttcctgcgtgttcgctctgatggcctcttccatttcgataacagctacagaccttgcccccttgctcagcaatacattgggatcactgtgaggaagccactacagaggtttcagctgatgaatgagatttgctacgagaaggttatggcatctgctggaaagcatcaagtgcttatattcgtgcactcgaggaaggagacagcgaaaactgcccgtgccatcagagatactgcattggctaatgacacgttaaaccgcttcttgaaggatgatagtgcaagccaagagattcttgggagtcaggcagaactagtaaaaagcagtgaccttaaagaccttttgccttatgggtttgctattcatcatgctgggttggcaagggtagaccgtgagcttgtagaggagctttttgccgataagcatatacaggtccttgtctcaacagccacccttgcatggggtgtcaatttgcctgcacacactgttataataaagggtacccagatttacaatcctgaaaagggtgcgtggacagagctgagtcctctagatgtcatgcagatgcttggccgtgctggcaggccacagtatgatacacatggagagggaataatcctaactggccacagtgaattgcaatattacctgtctctaatgaatcaacaactgcctattgagagtcagttcatatccagattggctgatcaattaaatgcagagattgttcttgggactattcagaatgctcgggaggcatgctcatggcttggctacacctacctctacatccggatgctccggaatccaacattgtatggtctaccggcagatatcatggagactgataaaacactagatgaaaggagagctgacttggtaagaggataccatacttatattctatcttctatagagttgttatacttatcccttcatccttagcgtttgttcacatattatccttgtacatatgcactaattgccacaatgttctctaattcattgtccaagttttctttaactcttatctgaatattggtgttcaagagttacatgaatctaatatagcatttactgaggtactcaattctcagtattgaaatgctgtttacagaaagttaattccctcacactggaatagggtatttttaatcatcactagcatcatagactcattagcatgtactagtgtataatagaaataggataatggccttggattttatttgtccgaatgctctttgcagtgtagctttatattttgttgctggacacttaatagttgtatatttgctctctttgaccaatagcaacatgatacaagccagtctcttctattgaaatgtatgcgcatctttgactaccgatgtagcattgtgcatcaatttagcactcgaactacagggtaaggtagcatgtaaaaaatgcgtaaaaagtgcgcaacttcaactcattatttttgttggctgaattccatagctgaagcatctagttgacaattgattcatgcttgtgttgttcatattgtatggtttctctgtatgctctcttgatgtttaactgctttgttaccccttctagtccatgctcaatcaattgttgattcttgtacttctgtgcttctgcaggtgcactctgctgcaaatctgctcgataggaacaatttgataaagtatgacaggaaaacaggatacttccaggttactgacctaggaaggattgctagttattactatattagccacgggactatttcaacttacaatgagtacctgaagcctacaatgggtgatattgagctatgtcggctcttttcactcagtgaagaattcaagtatgtcagtgttagacaagatgagaaaatggagctggctaagcttttggatcgtgtgcctattcctgtgaaagaaagcttggaggagcccagtgcaaagatcaatgttctgctgcaagcatatatttctaggctgaaattggagggtctttcgcttagctccgatatggtctacatcagacaggtaacatgttctccctgctgaataagcttcctgaatttgaattgattgcttattattatctgttttatgacaattgattgcttattattatctgttttatgacacagagtgctggccgtctcttacgagcgttgtttgagatagttctgaagagaggatgggcccaactagcagagaaggctttgaatctttgtaagatgatagataagcagatgtggaatgtccaaactcccctgcgccaattccctggtattccgaaggaaatcctaatgaaactggagaaaaaagaattggcttgggagaggtactacgacctatcatctcaggaaattggtgaactaattcggttcccgaagatgggcaggcaactgcacaagtgcatccaccagttaccaaagttgaatctttcagcccatgttcagccaattactcgtacggttttgggttttgagttgactataactcctgatttccaatgggatgataaggtacatggatatgtggagcctttctgggttattgttgaggacaacgatggcgagaacattcttcaccatgagtacttcatggttaagaaacaatacgtagatgaagatcatacactcaacttcacagtgccaatatacgagccactgccccctcaatactttattcgtgttgtatctgataagtggcttggttctcagacaattcttcctgtctgttttaggcacttaattcttccagaaaaatatgctccgccaactgaattgcttgatctgcagccactgcctgttactgcattgagaaatgcacgatacgaaggcctttatagtgccttcaaacatttcaacccaatccagactcaagtgttcactgttctgtacaacactgatgacagtgttttggttgctgcgccaacaggcagtggaaagaccatctgtgcagagtttgctatactaagaaaccatcagaaggctgtatctggtgagagcaacatgcgagttgtgtatattgctcctattgaagcccttgcaaaagaaaggtacagggattgggagcagaaatttggagaatttgctcgggtagttgagctaacaggtgaaactgcagctgacttgaagcttctggataaaggggagattataattagtactcctgagaagtgggatgcactctctcgccggtggaaacagcggaaacaagtccaacaggtcagcctattcattgttgatgagcttcatctgattggatctgaaaagggacatgttctggaagtcatcgtctctaggatgaggcgtattgcaagtcatatcggcagtaacatccggattgtggctctttcagcttcacttgcaaatgctaaagatctcggagaatggattggtgctacctctcatggccttttcaactttcctccagctgtccggccggtgccattagaaatacacattcagggtgtggatatagcaaattttgaggcaaggatgcaggcaatgacgaagccgacatacactgctattacccaacatgcaaagaatggtaaacctgccctggtgtttgtgcctacacggaagcatgcaaggttgactgcattggacttgtgtgcatactcgagtgctgagggtggtggaacacctttccttcttggttcagaagatgagatggatgctttcactggtggtatcagtgatgaaacacttaaatatactctgaaatgtggtgtaggctacttgcatgaaggtttaagtgatctggaacaggaagttgtaacgcagctgtttctcggtgggaggatccaagtgtgtgttgcgagtagcactgtgtgctggggaagatcattgcctgcccatctggtggttgtgatgggaacccagtattatgatggccgggagaatgctcatactgattatccaatcactgatctactccaaatgatgggtcatgctagcaggcctcttcaagataactcagggaaatgtgttatattgtgtcatgcgcctcgcaaggaatactacaagaagttcctttttgaggccttccctgttgagagccatcttcaccacttcttgcatgatcatatgaacgctgaggtggtggttggtgtcatagaaaacaagcaagatgctgtggattaccttacttggaccttcatgtacaggcggctgaccaagaaccctaactactacaatctgcagggcgtgagccacaggcatttgtcggaccatttatctgagttggttgagactgtattgaatgacctagaatcaagcaagtgtgtggctatagaggaggatatgtacctgaagcccctcaaccttggtctgattgcttcgtactactacattagctacacaactattgagaggttcagttcaatgctaactcaaaagactaagatgaaagggctcctggagattctagcctctgcttcagaatatgctgagcttcccagtcgccctggtgaggaggatttcattgagaagcttgttcgccaccagagattttccatcgagaagcccaagtatggtgatccacatgtcaaggctaacgcactgctgcaagctcatttttcaaggcacactatcttagggaacctggcagccgaccagcgggagatactcctttctgctcatagattgctccaggcaatggttgatgttatctccagcaatggatggcttacgcttgctcttaatgcaatggagctgagtcaaatggtgacacaaggcatgtgggatcgtgattctgttcttttacaacttccacatttcaccaaggagttggcacggagatgtcaggagaatgaagggaggcccattgagagcatctttgatctggctgagatgagcatcgatgagatgcgggatctgttgcagcaatcaaaccctcagctgcaggatatcattgaattcttcaagcgtttccccaatgtcgatatggcttacgaagttcgcgagggtgatgatatcagggctggtgacaatgtaactgtacaggtgaccctggagcgtgacatgacgaacttgccttctgaggtggggccagttcatgcccccaggtacccaaagcccaaggaagaaggctggtggctggtaattggtgatagctctaccaatcagttgcttgcaatcaagagggttgcacttcagaagagggctcgagtgaagcttgagttcaccgctgcttcagaagctgggagaaaggagtacatgatctacctgatgtccgattcttatctgggctgcgatcaggagtacgagttcaccgtcgatgtcatggatgctggaggggattgatcccaaggccagaaagaggatgaaagctttgcccagcccccaggtgtgtatggagctgggtggttgcttgtacgctcgtagcaattcctaatgtcctatccacacttgtatgtgtttgtactcgtttttatctttagccattttcttagtgtaactgatgctcacctctgctgctacctgtggtcatctttggggatctttattagctagcctatggctgtgcttcttgtgatcatccttcttattgtgtttttgtcttcctgtttcatcaaagcaagtcactaacgttttgattcttatctatatcattttatcatgccgttggtttggcccgtattaattgttacatctcatatgatactctgctcatagattgctccagtccagcctctccaggcaatgcctgatactccagcgtattattgttgagcaatcttggaaccggtttgttttggaaacaagtagtgatgtagtgtacatgtgctgcataatgctaaatgattttaagatttgatatagtccgtgaataatggtggtcataataaaccactactgcatgactccctttggagtccgggtccacttgttcatacatccactgttgctaaaatatgcttttggacaagtcagagagacaatatacatacaaactcaaaactctcctttatctgtctgtaatatccacacttttatgtgtttgtaatcgcatttatatctagcctattgttttttttaaggctcggaatgtaacctttttcaattcgaaaatcaatttttaatgttgaattcaaacttttgacagggagaaaaaaaagggatcccccggatagattcccagatgacgtcatctcacctgccgtatgtgatcttctcacctgcatggcattgcagagtacttcatttagttttgattctcgttgcggttgccagggcagtgggtgggtcccgcgctgctttgtcgtcctcgccaacgtgagggcgaggcggtgagaggtgagggggttctccgacgatcgcttgctcgctacggcgcgtcgacgccgccaccctctccgcgtcctcgccgcgcgccgttgggcttctccgcgcgccattcggtccaagcagcgcgacatcctacgccaccgaccaccggtcgcaagcatcggccccctctccggtctccgcgtacgtcctcgctgccgctgcagtcatggcggtgttcaagatgatccgccgtttggtggtctcctcgctccctcacgcccggattctcaccggcgcctcctcgtcggcgacgcccgcggcaactcctcctgcttccaccgtcttcttcgtcaacacctcgccctcttcagcggcgacgctcaccgccagcgcctcttcgtcggcgacgtccgcggcgacctccctcgcctccgcgacctcccgcgcctccccgtcggcgacctcccgctcctccctcgtctccatcgtcaccgactcgctctctgcggcggcgactctcaccgccaacgcgttctcgtcggtgacgtcggcggcgactcctcccgccttcctcgcctccgtcttcaccaccgcgccctctacagcggcgactcttgccggcagctcctcctcgtcggtgacgtccgcggcgacctcgcccgcctcactcctctcggcatcttctctgccctggacgtcgtcgtggccgctaacaccgccaccgaacagggcccttgctgtcttctcaccatcgccgcgatctacttggacaagatcctcggctacatcgatgacttccatgcggctccagaacaaggcgtattgcagcagcagcagcaatgcaccaacacaggatgaacttcctgaagatgtgatgtaagtttgtatgtttatacagtctttaacacttttgcttatgtgcagtttttcagtgtgaaatacttcattctgtaattctgcatcatgttcaatgcttcttattagttgggaatagtacacgtattgctttgcttgccaatggttcatattcattacttgtgtgcgaatggagtataacttagtgtatgaccctttcccactttgcttcatgtttgatgcttaactgtattcctcataatagttaggaatctgtatctatagtagaagtgttacttgcttaatatttcagattcagtacttgtttatgaggaactgaagtataagaactctttcctgctttgcctttgcttcatgttcgatgtttacatgtatgctgatatttcttatgttagttgggaacatgtatctatagtagaagtgttgtttggttaatacttcagattctatagttgaagtgtgacttgcttaatatttcagattcagtactcgtttatgatgaatcgaagtataagtttactgtatgactctttcctgctttgcctttgcttcatgttcaatgcttactctgtgtgctagtattcatctccgatcattaagagagaaaaagttattgtttctgtttgaaagcaagtttgtttatattgaactgaaaatagttaattaatttgcagaaaatacgatagcattctacaatcctcccgttctgctattccatttgtgcacccgatagagtatttgcagggtcatgcagtgttctttagtattccaggggacgtgcaacttctgggtgaaacttacctaccaaaggggcaaatgctgatttcaccgaaagaacaactcatgttcacaggcaggggaagtgtgtttgcgcagtcatatcttgaggagatttatgtgatgcttttacaaggaaaatgtcttcacaaacctcttagcatggatgacatggtagtcagtgcccttggcagagttcatttgagagatggaattcttatgaggcctatagctgagtctcgcagagctgcaatcatcaattctacctggtttgaagctatgaagctcctgaaacaaatgcttgcgtacgcaaatccacataatttcgatcttccacctgacttcctgcacctttgcaatactatggaaaaccgatatgaaccaaagggcatgaacataccttatcatgcatcattgttacccctccactcgaggcagcaggctctacttgatgcatttaacttgctgacaaacaggatgaacttcagatatgcatcttggatttcttgtgaattgcctcataggacggagtggccgcaagttctgcacgggaacaacttcctgcgacagtggttccgcgacaaacaatggctgaatgatgatggtacaatcaaagtacccactggtattgagttcttgtgggcccacagagtgctttgttgtcattcggatgactatgccaggaagggtgtttgcatgtacacttgggaacagctgcaccttctaatccatggtaaaaatcccttggttctacctgatctgcacctgaagctcatgagggcaggtcttctccacttactggacccggcaagattatttgcctataccaccaagagagcagaagattttcccctaccccacccaacatcctgaaagagtccatataggcactgatcggcctagcaacgatgagggaggatagcaagaatgctaactgggaatggttatgtttgaaatgtttcttaggctcttaacactgtttttgctttgcacttctggtatcattttcgtttctgttatcacttttgttttgacgtaagtggtgcacaatattactcattctgatttgtgaagaaaaactcgattcaaattgtggactgcatgagtgttggaccatgtaaattgtgctgttgcgtgaccatgaccaatgaaccatgtgtttggcacttgaatcctatgctaccaaaatttcagttgtacgtagagaacaaatagttcgattacaatgtttcaaggtgattgaagaattacagatactcttgtcatcacttgaagagtctgctcttattcacagccattttttcttcttcagatattgtatgtatacagaaggacatgatgcaatatactgagagcaaataacaaaaattcagtaattttctgaaatgggaaaggaaaaacaaagcttcagcagtctaaattcatgcctagcatgcacatgcgagctcaacagaagccacactgacatctgcgttgcatacatgcctcttcgttctaatgccaaatccaatcttgtaagcatgtacgatgacaaatgggcccatctgtgtctataaaatatggacccagtatcattacagtaaaggttaatgtttgcagtgttattattgtaaatctcccggagtatgttgtatgactgctttgcatcttgttcagaacgaaggatctgttggttgcaatactccatgctttgcatcaagattcggtctcactctcgtcttcctccctctcggtgtctccgccccgccgtcaccgatctcccgcctcccgcctccgccgccggcgactgctcccgcgcccgctccccgtcgttgcttccgttccggtaagctgcctgggactgtactagttgaggttgctagtccgaatccctgacgcgcgttgctcgctcttctgggcggcagcagatcgatttccttcaatggcggcggcggaggaggggcagtgggtgctcatggccaccggccgatctcccaccaacatcgccgtcatcaagtactgggggaagagggacgaggcgctcatcctccccgtcaacgacagcatcagcgtcaccctcgaccccgaccacctctccgccaccaccaccgtcgccgtcagcccttccttcccctccgaccggatgtggctcaacggcaaggtcctcctcctctctactcttccatctctctgctctgctgcttcctacttttttttttgttgttgcttcgcattgatgcttatgctttgttgtcccctctgaataatgggactctgttcatcaaactgatgacaactgctgcttagatctgaataatgggattcggttccagtgttcttcccatctacaaattctacaggcagtggagctctagttttttttttggttattttaataagaatcacatttctgatttcatatgcactagcatctagtatgtgtttctagctttgttgctgttacagtcactgatcctatctaactacgaactgtcaaatcctatatttacacggtgtgaaacttaaagctgtgatctaccaccacgctagaccttaagggatgatcactatgtcttaagctagcttttggtttggaattgtgcaggagatctccttgtcaggagggaggttccagagctgcctcagggagatccggaagcgtgctcaagatgtcgaggatgagaagaaggggatcaggatcaagaaagaggactgggggaagctacatgtacacatagcatcgtacaacaacttccccactgctgctggtttggcctcttcggttgctggcttggtttgttttggtaaagtctattacttctgatatcaatgatatttccctacttattgtctaaaatattttgaaatttgataatgccacccaagatcagacaatggttcaatcatcttattggtgatttttttttaaaaaaatctaaataggtgaatggaagcacatatttattacctgattgctttttgtagttttcacccttggaaatctaatgaatgtgaaagaagattatggtgaactttcttccatagcaaggtattttgttgctagtactccatctttactgatcagtatgctatggaactgcttcttttctccttctggtataactgacaaattcaaatgcaggcaagggtctggaagtgcatgccgcagtatatatgggggattcgtgaaatggtgtatgggaaaagtgagttatctgatgctatgacagaggaacagccttggtgaaatttatcgcatatcctttctagcgagtaatgataaattttatactatacttacagaataatgatggaagtgacagcatagctgtacaacttgctgatgaggcacactggaatgatcttgttattatcatagcagtggtatgtgatgtgcatttaacatacctcttactgcgtataatctgttgtagcattactactcctggtgttgtggcttcacaaccagtaaatttgaatcagatagtaactcttagtattttatcatgctttttaacaacatttactaattatgtcatgtctgacatcttcaaaataattgaatgtccctgtgtaaaataggtcagttcaaagcagaaggaaacaagtagcactagtgggatgcgagacagtgttgaaacaagtccccttttgcaatatagggcccaggtgactgttttgacttgtacttttgttttggctgtttaaaattttgtgattaaatttctcatgattcatagaggaagtagagttgggcagttggctaccccctgcaagacgatgttaattaattaactctggagcataattttgtgggctgccatgtcaaaagctagtctcgctgcaggcttgcaacgagtagtatataagaggcctgcaggcagttagatagcgagtgagcattgaggcgtacgagtaggatgattgtgaagatgatgaagccggtggtggcgctgttcctagtgaccgtcctcatcgcctcgcgtgagtcatcttaattactactactaattagctagtagctagtttctgtgcttaactattagtttcagttatcaagttagcatgaatgcatatactgatatacatgcagcaataaaagaagaagatggaaaatactattattgttattaggaaaaagtacgttttacccccccgaactatcacggtcgaccgaattacacccttaaactcaaaaaccagacattctatatcctcagctattgaaaccggacaaataaggccccttaacactgttttgagtggttttgacttaacctcgcacacgtggcgccaacgtggcaatctaaccagcaaaaaaaataaaaaaaaacatggcccacctgtcatacctatcctcaaaccaatctgccaatctctcaaccattccatctctctcacgcacgcgctcgggcaaggcagcgggtgaccggcggcggaggtggagctccccgggcggccgggtgtctgaggcagagcgggcgaccggcgacggagacggagctccccgagcagcgggcggtggaggcggagctcccctggcggtgggcggtgggcagctgaggtggaagcagagcgggcggccgacggtggaggcggaggtccctgtgcggcgggcgtcgtgccgctgaggctgaggcggaggcggagcgggtggctggcggcggaagcggagcttctcgggctgcgccgctgcgggtggcgggcggctgaggcggaggcggagtgggcgaccgacaacgccgtggtgaagggcggcggcgatgcgggagtaggtgtgtgtggtgtgcgggggatggcggcgcgcggggccgggcggttggcggcggcagagggggagctggagccgacgacggctcggcgggcagcgggctatggcgtcgccgagaggtagcgcttctctgcctctctctccctctctctctcggtgagcagaggaggcagctgtggcgcgggggcggaggcagctgcggccggagggggcggaggcagctgcgggcggcgggcgaggagtcgaggacggcggccgaaggcggcgagggagatggcgtgggagcagctgcacgacgaccgacgagccgccctccgtgcgctcggcatgggcctcatcatgggtggcgacctcctctgcaccgagctggagtaagccatcgcgcgggtggtgtacgaccgtagccgcggtggcggtggcggtggcagtggcgatggcgcgggagagaccgtcgcctccgtgccgcccgcctgctgccgcccaccgcccgcctgctgccacgcgcaagagagagaggaagagttagagagagaggaagatgagagagaggaggtgagagagattcggtggccggtgcgacgagatccacgccggcggccgctctccatggcctctagccttgagctccgccgcccacaccccttctgccctctctcactctctcgtataatcagaataggtgcctgacaggtagggcccaccatttttattattgttatttccatgttggactgccacatcaatcaaactagtgccacgtgtgcgccacgtcaaaccaaaaccaccccggattgacttaggggggtaatttggccggtttgaaaattttggggtgtaaaataactggttttagagtctaagggggtaattcgaacgacccaaatagtttagggggtaaaacgtactttttccttgttattattattgcaaatgcaaacagctatagctagctagaaaatgaaaagaaaagaaaagaaataagatgggatttggaaatggaaatgcagatggtgcgatgatgcagtgggcggcggaggcggagacgtgcaactacccaatctacaagtgcgagggggtgtgctacaagagaggcaagtgcaacgcctgctgcaagcagctcggcttcctgggcggcatgctctgcctctgctgccacgaggacgacgaccagccgccgccctcctccactcacctccccgtcgccgccatcgatcacgatcacgatcacgccgccgacatgccatgatcatcattcatccatctatatattgcttatttgcatgcactgcagataccaatctcatctcctactcccatgtatagttggagtacatatatatgttggctggatcatgagccaccggatgtgatgtgagcaattaataataataataataataataataataataataataataataataaccatggattactgatgctgcaaataatattttttctgctctgctgcaaatatgatttttgagatacaatgaacaacacatcaggcaggcgcaggcgcgcaatgagatggaactagttgaataatttaattttgtagagcgaatctatttggaatatctgttgcaggtgcatcactccggtcaaaaacatttcgggcccttttgaattgtaggaataaaaaaacggaggaataggaaaaacataggattctgacaggaatgtaaatgtaaaacagaggattgtaaaacacagaaaaaacacaggaatgattgtttgattggaccacaggaaaaacacaggaatcaaataagagagatagactcaaaggatttttatcaagaggttggacctcttgctaagtttcctccaaaacctatatgcaacaagccattccataggaattttgtagaatttggaaaacttcaatcctttgaatcaaagggctacataagaaaatttcatataggatttcaatcctataaaattccttcgtaattcatttgattcaaaggggcccttcatctttgggatgttgttgctgtgctaactgctaaggaagataatatcatcttattatgcccaaattttacaacactttgccttcttaattgttattaaaatagctgcagccaaattgtagtactgtaagaggaaatcatcatattattagaaggaagcaagaactttttttgacaatgtgattagttggcccctgttctgtttcccctttttcttttcgggtgatgactggtttggttgtcactttgccttgacagcttaatgttaaacaattataaccccttttctctcttagtaaaatttggtcggtcaatccttcggtcgaactagcaaaaaaaaaagttttcattttccagaatgaaggagcatatataataagaggacagcctcttaataaggctgtgaattccttgtctgttggtaatataaacgaatggccgaatggagcatatacagcatttcgattattactctattacaaacgaagaagattattattgtaatctcgctcgaaatgaaaaggaaaaagggaaatatagctagttttaccggagagaggtgtaagtaaattaaaagactcgagagtaaccacgaacgaaatcgccgttttggaatgcgtagcgtatagacttgtgcacgacgacggcgtcgtcactgcccaccacatcaacgccggtgagcagcaagaacctgtcgttcttgcttttttcgccggcgacgcggaagaatggatgaagtgagatgttgtgttgctcctcctcctccatgaacctggcgatgcagaacctaccggagccgaggtgcacggcgtaggtctccatcagtaacgatcgcttgggcggcgccgccgccggcagccggtctaggccatccaaccagcacctgaccatcacctgcgcatcgtaggaacagcagagatcggagagatcgcaggaacagaggtacagccccagcctcggagtggaggagagcccaaaccattgcccgtgctcctccacgtacttctggagtatctcgcagttatctcatcggaccagatcgagatgttgtgttgggcccatcgtccgccgaaaaaagttttatgcgtgtcatatgagacatggtacatatgaatatatatttaaaatatgtattattaaatatagtctaataataaaacaaattatagattccggctataaactgcgagatgaatttattaagcataattaatcagttattagtaaatacaacgttgtcaaatcatgacgcaattaagcttaacatttaatactttatacatatgaccaaacattcgatgtgacagcgtgaaaatggctttatacaaaatttggcatggagaactgttaacgctaaaatttgctaagaatttttaagtacatttagttaacgaagtatcacatgacttatacaacagagatcgagtttgagaagaagttaaagaataccacgacatggctggtaagttttgtatttatgaatgtttttgttatctttacaaaagtttgtatcgtgtttaaatagtacttttataggtctatgtgtataaatatatatacccaggattcctataatttatcttacaggtaaatacaattactcttggcgcattgccatcattcattccgaggtttttatttatcaccggtggaacttggtgatgaagatgttaggtcccgatttttcgataggtattgataaacagtcaatttgggcagagtcgtgacacaactcgatccggcttccgaatgagcatgctactcaacccctcaatcgcagcaccacgtctcctctagttatcaaccgtgccgaaactcggttgacctcgccgataaggctaatccctgcatgcaaatcgaataacacaagcaagaacaagatagactgcaacacaattgcatatgaatgattaagcatacaaatttggagttctacaaaccgatctagtggcgaaactgttcttgacagattaatctaagcaaaacccacactctaaacgatgacggctactgaataaatatgattaggaacgtcctagggttgccctatggcacacactctttggcctaagcccacgacacaattacaaggcccaaaacccaaatcagattcagactggatgaggtgtgtggtttgttttgcagattcccggcagctcggtaggaattttgacgtggaaccaaaatcatttgaaagtagactccataagctttccagcaagtactcatgggccccgaaattccttctagatcagcggctaggtccacttgaagttgatgctgtcaggaggcccgaatccgaatccaaaacgtgtagaactttatctcttgtcttatatggaccaaaagtgacgtggtgagatggaagtgaacttggagaaagtcttggtttggtcccaatcaaacattaaatttggcttgatgaagctatgctctgcaacagacaatcacacaggaaccaacatgaggggatggatctaagatctgagtatatttcatatggaaaatcgaaaggggattgacaagcaattcaacaacctgaaacaactcatcttcatgccgatggatgttgttctggacttctggtataaaatctatagcatccaaaacattagtactcctcagcgttaaccaaggcgagaggggaacatgcgacaatagagagaacaccgagttgtgtggcagagtaggaggaggtgagcgccagtggcaagagacgatgggggcgaaggggatcagtgaggggattgacacggtggaggtaaggcaagcaggctatcggcgctagcgctggagtaatgcctctatcggttccctgctctctcatgatttgaggcagctagaagcaagagagtatcggcaatcaacccaactggtggagtgcggcggcggcagggaaggacctagccgtcaggaaccaccacgatgccagcgggggcagtggagtgtcgcggcggcagggaaggacttcgccggcaggaaccaccacggcatcggcaaggggaggctgcggtgtagtgcggcggaggtgggaagacctcgctgtcgggaaccaccacggcgccagcagcggttagagaagaagtcggctccggcgagggcatcagtgggcttcggtggcggcgaccgttggggacgacagcggctcctgcgtgggcaggtggagtgcgtggcagcagtggaaggggacgacctcggctccggggaccgcgactagggaagaagtcggctccagagaaggcagcagaggagcgaggcggcggcaacagtacatgtgaggaggagcgagcagaaggagccagtcacgcctagagagggtgaggcgtagtcttcacgcgtggagattatgagatcatgcggtggagattggtggacggtacggattatacttgatctacgaatggacggtagagatttagcctataggattagaggggtaaactcattctttttatattagtatagatatagatatagtttatgaatggcccttgaggccttggacaattcatgcatatgcttgttaaaccaacatggcaattgatctaatggctccaatgtgttagatccaacggctctaatgcgcagatgatgtggcctaacgtggagcttgttttattggagttaatgcttacagtgggtaccaactactccctctgtttctaaatatttgacgtcgttgatttttttacacacgtttgaccgtaagtcttattcaaaaacttttgtgaaatatgtaaaactatatgtataaataaaagtatatttaacaatgaatgaaatgataagaaaagaattaataattacttaaattttttgaataagacgagcggttaagcatatttaaaaaaattagcggtgtcaaatatttaggaatgaagggagtatatagaaagaaatgatagttagaagaagaaaaacgataacgtagctgatggttacaaatgaacgtggtttgaggtggggagcccccccccccccccgacgcagattcagtgagattctcggtgacactgagtcactgacatgtgggaccccccggtgttcccttaaaaaaaacgtggttgagtatcctctacctgtaacgtgacctgtttggctttttccagctgtcaatgatcccttaaattgagcttttaaacatggcatgaattgctttcaattcttaccgccttttcatttgtaagcaccaccggaacattagacgatcagtatctcaccagtataaacccgctcactttctgctgcgctccgttcgggtgctcgtcacgaacaaatttacatgtacatcgtgtcttctttctttttttgacattatgtcttctttttttctaaattatttactcagtcctgggttctgattgcgccctgatgggattaataagttttgtttatcttgttaacgctagctagtagcaatatggacaatagaaatgagtccagtaacatgaatggggtcattcccatggagtattgcaagatacagatagttgtcatattgctctcttctgtgaatggattgtcataagctgctgatccttcctgcagcatctacccaagtgaaatctgcatgcacaagttgagatcaacatcgacaagatgagatgactctgaagatgcaggattcctattggattttggagagagacagctgatttacaggggggtggattgactgattcttctcatccttcctggcttgaaaattggaaagcttggagctttcggccctgatttgatccggtcatttctactgcttgacaaactgtggagaatctattccttccagccatatacatccaatttcttgacaatctggaccggacgatccatcagaaaaaattaattcagaatgcaatttggagtgcatcagcttttttggctggcacatcggtgtagtgtatctgtgtgaccttgcaactgtgcaagggtcaaacagcacggccaccagtacttttgttgatgaatgagttattaccacatgacttcgtcaatgctaccccagcaagtgatggaaggaaagatggatgataaggctccagggctcataaatagctgagactgaacattgctcattacagtcttcagatgtaaagcggtgttgttcttcttctctattctgctcaaggcagctgcatccagatcactctactgatcaggaccacgaggatcatctgctggaagaaaacaaggatttgcacattcactatgcactgctgtaattgtatcaaatccaattctaaatgctgaatgaacagttgctgatatgatcctgtcaagaagcaaaaacaagaaactaattgccctctgagacatatatatatagtggacgtgcactagtgttctgataccacaaatcctttggccactggagtcaacttttgatcataaggataacataagtaaagaagattctatttcctacaagagcagcagcagctaagcgcacacattcttttttcctttccagaaaggatataatgatggattagaatattcacagacagtagtacagcttcaggattgctgcaagattagtcacaaaatactagtagtagtagtatcgggcatgttcactttgatgccattttcaaacttaccaaattttggtaaagttaccaaaaaagtggctacatttagtttcctgctaaattttggtaactatataagaaatcatgccaaaatttaccaaaatttgctaaaattttgaccttattaaggttttttttgacatcaaagtgaacaggcccatcatcttactaccatccatggggtccaggacaaattagttgaactaggagtacatacagctgatacagttgtgcagtgaagcggtgacaattgtcaattgacaaagtgccaaggtctcacagctaatccccagctcagctgcctgctgcccccttgatggcctgcacatctctgcccattgaaatctttggtcagcaccatcctctggctgtcaagagttaggtgcagcccgatttgagtcaaccctttgattgcatcaagcaaaggtatactagtatcaatgcccctttatccaattctgcaaagtttcttccccaacttgctgtgtcctgaacaactggatttcattcggtcatcagcttacacggttggttgaatggttggtcaattgcaagctgttcatctgagagactgaaacaaaaccatttggatttgcggttgcagtcttgcagagatcacagaatgttgatctttcaggattagaaacaaaatgcagcacaaatatgatatgagtatatattctgatgaccagaatcagcacacacggttggttgaatgattggtcaattgcaagctgatcatctgggagactgaaacaaactgtttagattgcagttgcagtccagcagaaatcaaagcaagtgcagcacagtatcaggcttcataagaggcaagtgcaacgcctgctgcaagcagctcggcttcctgggcggcaagtgcaacctcctccgcggcatgctctgcctctgctgccacgaggacgacgaccagccgccgccctcctcctccactcacctccccgtcgccgccatcgatcacgatcacgccgccaacatgccatgatcatctcatccagctatatatattgcgttattacccatttgctcgcgtccatgagccaccggatgtgatgtgagcaattaataataactatggattactgatgctgcaaatgattttttttctgctctgctgcaaatatgatttttgagatacaatgaacaacacatcaggcaggcgcaggcgcgcaatgagatggaactagttgaatagtttaattttgtagagcgaatctatttggaatatctgttgcaggtgcatcactccggtcaaaaacatttcagctttgggatgttgttgctctgctaactgctaaggaagatatatcattttattgtgcccaaattttacaacattttgctttcttaattgtcaaaatagctgcagctaaattttccagaatgaagaaggagcatatataataagaggacaacctcttaataaggctgtgaattccttgtctgttggtaatataaacgaatggagtaccattattattattgcaatctcgctcgaaatgaaaaggaaaagggatatatataaatgatatactcactccgtcacaaaacaaaatatagctagttttaccggagactagagaggtgtaataagtaaattaggggatgatgaaattaaaagactcgagagtaaccacgaacgaaatcaccgttttggaatgcgtagcgtatagacttgtgcacgacgacggcgtcgtcactgcccaccacatcaacgccggtgagcagcaagaacctgtcgttcttgcttttttcgccggcgacgcggaagaatggatgaagtgagatgttgtgttgctcctcctcctccatgaacctggcgatgcagaacctaccggagccgaggtgcacggcataggtctccatcagtaacgatcgcttgggcggcgccgccgccggcagccggtctaggccatccaaccagcacctgaccatcacctgcgcatcgtaggaacagcagagataggagagatcgcaggaacagaggtacagccccagcctcggcgtggaggagagcccaaaccattgcccgtgctcctccacgtactcgccgcgccccatgaacggcatccccttttcgccaagctccctccactccccaaccttggaattcgtgtcgaacgagaaggtcccggctccgtgcgccgccgtcacccagagctccttcgattcgttcaactgcaccaccgcggaggcggtgatgtcgtagccagccttggcgaaaggaggcggcggaagagaccgccagtaccagcccatcctggaggacagtgagtcgtcgtcgtcggggagtaagccgtaggtgagagcctcgaagcagccggggttaccggacaagggcaccctctcgatgacgtagaggcggccatcgtcggcggtgaaggagattggctcgatcttgggcttgcacgggtcgggcatgtagcggacggcggcggaggcggcgctgtagagcagaccacggccgtcgacgtcgagggcgagaaggctgtcgtcgccgtcgctgccgccgccactgccgtagaggtacaagaaatcgacgtttccagggccggacaatgaggaagggtggaaggtgatggccggaggaggcaggccgccggcggcgtcctccacgtcatctggatctagtactttggctgcttgccgacgtgctggacatgaaaagagggccgatgcagcgacgcggtacagcttgtacgccgtcgcgtcgccgccgccgccggcggtgtccaccaccaaattcacaaaccgccgcatcatcgtctctgttgatattcttctactcaaaatttttcttttctatataccctttttttttccttttgacaaagagtatcttcgatccggaagaaatcacgcaccttctggagtatgcagtctcgctcgtcctcacgcgataggcggaccgccgaatctcctctcctcggtggcgcgtgatctcgacggcggggcgggatctcggggacggcggggcgagatctcggtagcggcctagcgggcggcacgggaggtcggggagcaatttttttttcttttcttttttttttgttgggcaatatatacggccatacgggacagttatctcatcggaccagatcgagatgttgtgttgggcccatcgtccgccgaaaaaaagttttatgcgtgtcacatgagacatggtacatatgaatatatattaaaaatattattaaatatagtctaataataaaacaaattacagatttcgcctataaactgcgatatgaatttattaaatctaattaattcgttattagtaaatatttactgtagcacaacgttgtcaaaccatgacgtaattaggcttaacatttaatacttcatacatgtgttcaaacatttgatatgacagcgtgaaaagtttttatgtgggaactaaaccgggccttagacaaaatttggcatgctaaaatttggtaagaatttttaagtacatttaattaacgaagtatcacatgacttatacaacagagatcgagtttgaggagttaatattaccacgacatgggtggtaagttttgtatttatgaatgtttttttcatctttacaaaagtttgtatcgtatctaaatagaacttttatcggtctatatgtataaatttgtatatccaggatccctataatttatctcacggataaatacaattactcttggcgcattgctatcattctctccgaggtttttatttatcaccagcggaacttggtgataaggatgttagatcccgatctatcaataggtattgataaacaattgatttgagcggagtcgtgacgcaactcgatccggcttctgaacgagcgtgctactgagccccacaatcacaacaccacgtctcctctagttatcaactgtgccgaaacccagttgaccttgccgagaaggctaatccctgaatatgaatcgaagaacacaagcaagaacaagatatattacaacacagttgcatatgaatgattaagcacacaaatttggagttccacaaaccgatatagcggcaaaactgttcttgacagattaatctaaacaggctactgaataaatatgattaggaacgtcctagggttgccctagggcgcacacccctttggcctaagcccatgacacaattacaaggcccaaaaccaaaatcagattcggactggatgaggtgtgtggcttgttttgcatattcccggcagctcggtaggaattttgatgtggaaccaaaatcatctgaaagtagactgcataagctttccaacaagtactcatgggccccgaaattccttctatatcagcggttaggtccgtttgaagttgatgctgtcaggaggtctgaatccgaatccaaaacgtgtagaactttatatcttgtcttatatggatcaaaagtgacgtggtgagatggaagtgaacttggagaaggtcttggtttggtcccaatcaaacattaagggcctatttggattgctaccaaaaacatgccctaccaatattttggtaatttgaatagtagttgtgtttaatttggattgaagcctattcattggtaatacctaatttagatttggtatcatctagaacattcttcactacaattttacattttagctatatattggtagcaaaccaaatatgatcaatgcaatcttaccttaccaaagatttggtagtgccaaaacttgcctacattttggtactaccaaaaaattgttagggtaacaatccaaataggccctaaatttggcttgatgaagctatgctctgcaacggacaatcacacatgaaccaacatgaggggatggatctaagatctgagtatatttcatatggaaaatcgaaaggggattgacaagcaattcaacaacctgaaacaactatattcatgccgatggatgttgttctggacttctggtataaaatctatagcatccaaaacattagtactcctcagcgttaaccatgcaaggcgagaggggaacatgcgacaatagagagagcaccgagttgtgtggcagagtaggaggaggtgagcaccagcgggacgagacgatgggggcgaaggggatcgttgaggggattgacacggtggaggtaaggcaagcgggctatcggcgctagcgctggacgaatgcctttatttccctgctctctcatgatttgaggtagctagaagcaagagagtatcggcaatcaacccaactggtggagtgcggcggcggcggcggggaaggacctagccgtcaggaaccaccacggtgccagcaggggcagtggagtgcggcggcggcggggaaggactttgccggcggtaaccaccacagcgtcggcgaggggaggctgcagtgtagtgcggcggaggtgggaagacctcgccgtcaggaaccaccacggcgccagcggcgactgaagaagtcggctccggcgagggtagcggtgggcttcggcggcggccgccgctggggacgacggcggctccggcgtgggtaggtggagtgcgtggcagcagcggaaggggacgacctcggctccggggacggcggctggggaagaagtcggctctagagaaggcagcggaggagcgagacggtggcaacagtacatgtgaggaggagcgaggagaaggagcccccagtcacgcctggagagggtgaggcgtagtcgttgtgcgtggagattatgagatcatgcggtggagattggtggacggtacggattatacttgatctacggatggacggtagagatttagcctgtaggattaaaggggtaaactcctcctttttatattagtatagatatagatatagattatgaatggcccttgaggccttggacaattcatgcatatgcttgttaaaccaacatggcaattgatctaatggctccaatgtgctagatccgtcggctctaatgcgctgatgatgtggcttaacgtggagcttgttttataggagttaatgcttatagtgggtaccaactactccccccgtttctaaatatttgacatcgttgacttttttatacacgtttgaccataagtctcattcaaaaacttttgttaaatatgtaaaactatatgtatacataaaagtatatttaacaatgaatgaaatgataagaaaagaattaataattacttaaattttttgaataagacgaacggttaaatatatttaaaaaagttaacggcatcaaatacttaaatacttaggaatggagggagtatatagaaagaaatgatagttagaagaagaacgataatatagttgatggttacaaatggtataatgtaaaacgtggttgaggtggggagtcccctgacccccatgtacctaaaaaaaaacgtggttgagtatcctctacctgtaacgtgaactgtttggctttttccagctgtcaatgatcccttaaattgggagaagactccgcgtcggacatccgatattccaccaaatattggatgccgcgcgtcatcacaccacctgcgtatgcagcatgcaaaaaaaaaatcagtcagacaaatgtcccagttaactaacgagtgaaacatcaagttatttagtgtgaaaaaaaatcagcaactgaaacatttaaaaagtttatgaaacatgattaagatacacgttgaaacatatcgctattacatataaaacaaccaatgttaatggattgaaacatatgtttttctttcatcaaaatataatcatgtgatatcttgttgtaaagatttaattacaaagaatacaacggtgtgatcggatcgtagatcggataattagtttaggagaaattttttttttgaaacttgttaaaatgcatgcatgcatgcatgtatggatgaggtggagagagagagagagagagtagtgcagttaattttagaaattttgtgaaacatattgaagatacacattgaaacatatcgctattacgtatgaaacaaagaaaagtaattttcacaaaactacatgtattttgactaaattatcacaaaactacagatttaagaagttgtatcataaaactacacatttagcaccaaatttatcacaaaactgcatattttaggttaagtatcacaaaaatgtatatttaatattgaacttatcacaaaactacaacttttggagtttaaatccctagcaccattgttatggtggagctataaacattattactttgtgattaaattggttctaaacatgtagttttatgataatttagttactaaacatgtaattttgtgacacttcatcttaaatgtgtagttttatgataaatttggtgttaaatgtgtagttttgtgatacactgagttaaatacgtagttttgtgaaatttactcaacaaagaatgttaatagattgaaacatatgactattttttattacaactaatgcagatgccggagacagggtgttagtagtaacacgcatgacccatggaactcaagtccagctgtgctcgctaaaacccaacatgatgcttggaattttctctcatttattagaaaccttaagtctcaataaagaaacaaggcagtgcgtatgcaatggcacctttttttattgttttcacacattttattacagtaagtatatgaatatttaattttggttacttttacttataacatcaagttagcctattgtttaattggccgcatgtctaccatctgcacacatgacatgcgagatgcacaacatataattcactcagcactgcatagagggcatcacattaggcgcttcctcaaatattagacggtataaaagtagtcaagcacataatatatgatcgacctgagaaaatgaactcaactcaaaatttctgactaagaaataatgcagcaataattcatattttccttcccagagttagaacacagctttcgtattggggcaagaagcagtataaggcatccttcaatggttgagctagtgcactagcttatgcttgtccacctcatacaagagatagcaaaaagtctatctttttaataggttgtctcatagcacattgtttaaaatgctttggtttccacaacccttctcacattttgtttaggagcttagctcttgaagaagagatagtgcactctctctccttatcttctctctcttccacatcatacaaaaactgatgtggagatttatgagctagctgactcacccttgttggaggaggcctaagacaagtgtgttcctgtcagcactaaaaatgccatgagcgaaagcaagccacagcaccaacagcaacagaaaccgagctctgagctccgggttgaagattttgtgtgctatctttcactctgagctcacagcctcaaaagccatcaggtcccatctgatatttctgattagcctgatgaccaactcaacagaagtaaaatacccgtactaaccaggttgtagtcacactcgcatatgaaaaatactccctccgtttcaaaatgtttgacgccgttgactttttagcacatgtttgaccgttcgtcttattcaaaaaatttaagtaattattaatttttttcctatcatttaattcattgttaaatatatttttacgtaggcatataattttacggagggagtaccacataaggcaccggagcatatctttagctgatggttctagcttcccctaccttgctattcagtaaacaaaaaaaaaagcagccaaatagcataggtcgatcactgcatgggcatattcagaaattacatggaaccaatacaccttgtggactggatattagatagcatgcgaaaagtcagttacgtgagaaagaagcatattgaaagaagaggattctagtcaacaatggtagattttattttagtgttgtgcgtctacccatccaactcatttatcagcatgcaaattttgcagtcatttttcaccaccaaactcaactggcaccatcatatgtgaaatgatcacacacataagatattcactgtcggctatctttgaaatacaagttaggcaccactctcccatctaaaatcatatataattatatgtattgtaatccttcagtcaataatggggacatcacattaggcatctccaccaatactcgacagtataaagtaacccagcaatattaaaaaaaaataaagtaaccaagcacataatatgtgattgacctgagaaaatgaagtcaactcaaaggttctggctaagaaacaatgcagcagctgattcagagttagaacgcagttttcatttggggcaaaaagcagtaggcacaatcattggaatatacgaatataagacaagtgtgtgcctgcctgcacttaaaatgccataagcaagagaaagccacagcatgaacagcaagatgatccgcttgtttgctccattcccaaaattcattccactcttggctgtttttatcatctcatgctctctgccattagcaatcagcgatgacactgacactgatagagaagccctgctctgcttcaagtctcaaatctctgatccaaacggatccttaagctcatggagcaacacttcccagaacttctgcaactggcagggtgtttcatgcaacaacacccagacccaactccgagtcatggtgctcaacgtcagctccaaaggcctcagtggttcaataccaccttgcatcggcaatctgagctccatcgcaagcctcgacttatcaagaaacgcattccttggaaaaattccaagtgagctcggacgcttgggacaaatcagctacctgaacttgagcatcaactctcttgaaggccgtattccagatgagctgtcctcatgcagcaatctccaggtactcggcttatcgaacaactccttcgaaggtgagataccaccaagcttaacccaatgcactcgcctccagcaagttatactatacaacaacaagcttgaaggcagtatacccaccagatttggaacgcttcctgagctgaaaactttggatctctccaacaacgccctcagaggtgacataccaccattgttgggcagtagcccgtcttttgtatatgttgatcttgggggcaatcagctcacaggaggaatcccagagttcttggtaaatagctcatcccttcaagtgcttaggctcacgcaaaatagtcttacaggagagatccctccagccctcttcaacagctccacattgacaaccatttacctggaccgtaacaacttagttggttccataccacctattacagcaattgctgcacctattcaataccttagtttagagcagaataaactcacaggagggataccagcctcactgggcaacctttcttccttggttcatgtttctttaaaagcaaataacttggtggggagcatccctaagagcctaagtaagatcccaaccctagagaggctagttctcacatacaacaatttgactggtcatgtgccacaggctattttcaacatatcatctttgaaatatcttagcatggccaataactcactcatcggccaactaccaccagatataggcaacagacttccaaaccttgaagccttaatcctatcaacaacacagttaaatgggccgatcccagcttctcttcgcaatatgtccaagctagaaatggtttatcttgctgctgctggtctcactggtatagtgccatcttttggatccttgccaaacttgcatgaccttgatcttggatacaaccagcttgaagcaggggactggagcttcctctcatcccttgcaaactgcactcaactgaaaaagttggccttggatgccaattttctccaaggaaccttgcctagctcagtcggtaatcttccctcacagctcaactggttgtggctcaggcaaaacaaactttctgggacaattccatcagagattggtaaccttaagagtctcagtgttctgtatttggatgagaatatgtttagtgggagcatcccaccaaccattggaaatcttagcaacttactggttctaagcttggcacaaaataacctctcgggccttattcctgattctattggcaaccttgcccaactaaccgagtttcatctagatgggaacaacttcaacgggagcataccttcaaacttagggcagtggagacaattagagaagcttgatttctcccacaattcatttggtggaagcctgccaagtgaggtcttcaacatctcttccctgtcacaaagtttggacttgtcccacaatttgtttactgggcccataccactagaaattggcaacctcataaatcttggaagcatcagtatttcaaacaatcgcttgactggcgaaataccgtcaactctagggaagtgtgtgcttttggaataccttcacatggaagggaaccttcttactggaagcattccacgatctttcatgaacttaaaaagcatcaaggagctggatctctcttgtaacagcttgtcaggaaaagttccagagttcctcactctcttaagttctttgcagaaactcaacctttcattcaatgattttgaagggccaataccatcaaatggtgtctttggtaatgctagcagggttatcttggccggaaactacagactgtgtgcgaatgatccagggtatagcctgcccctttgccctgaatcaggatcacaaagtaaacacaagtctactattttgaaaatagtaattccaatcgcagtgtctgttgtaatttcattgttatgcttaatggctgttcttatcgaaagaagaaaacaaaaaccatgtttgcagcaatccagtgtgaacatgaggaagatatcatatgaagatatcgccaaagcaacagatgggttctctcccacaaatttggttggtttgggatcctttggggctgtttacaatggcatgttgccgtttgagaccaatccagttgctattaaggtttccgatcttaacaagtacggagcacccacaagcttcaatgcggagtgtgaggcattaagatatattcgccatcgaaatcttgtcaaaatcattactttatgctctacgattgatccaaatggctatgattttaaagcacttgtctttcagtatatgccaaatggaagtctagaaatgtggctacatccagaggaccatgggcatggtaaaaagagattcctaactttgggtgaaaggattagcttagccttggacattgcatacgctttagattatcttcacaaccagtgtgtatccccagtaatacattgtgacatcaaaccaagcaatgttcttttggatcttgaaatgattgcatatgtcagtgactttgggttggcaagatttatgtgtgctaattcaacagcagcgcctggtaactctacaagtttggctgacttaaaaagatccattggatatattgcaccaggtgagagaaattggaaacttatactgatttattgacctgtatgcttcagccatcttattaacttatccaatgttacatggattgtagttttctgccattcacctttcttatgttttcaaatgaaaatgcagagtatggaatgggtgggcaaatatcaacaaagggtgatgtctacagctatggagtgctgttgttagagatattaactggaaagcgtccaactgatgaaaaattcaatgatggtttgagcctccacgatcgcgtggatgctgcatttccccacagagtaactgagattttagaccccaacatgctacacaatgatttggatggtggaaactccgaactgatgcaaagttgtctcctcccattggttaaggtggccctcatgtgctccatggcatcaccaaaagaccggttagggatggcacaagtttccactgaactacactccatcaagcaagcattccttgagctctccagtggaggaaaagtagtgtgaataaacctagctagtatgccctctctttcttatttttccaaattggtagagtgcccactcccctgtggtgcgcaaagctatgttgctttgcaactactgtgtaaggctacttctattaccataactaagtctatatataaacaggggtggacgcagcagggggcaaagagggcttgggcaccctctactgtcggcacgccccctggaaaccatacattattcagcaaccaagtccacactaatacaagccaatctcatggtctcatggtgcgatattgcgtataggctgcagccactcgttaatggcaggcaagcagacacatgtcaacacagccattgatgctagtattggccattaacatccatttttgctaacttttcttagcttagctcatgacagtataaatcaacaacaaaagcttcgatagtgttcataacacaatggtactatttactttaatgataatctcgtattggtctttttaactaacacctccaaaaattttgttctgtgtttccccgcaaaaaaaaaaaaaaacggttctgtgttcgccactgtatataaataacctcatgaatctattatgtgttttggaattaggacagcaccaaatgcaatgttagcaggctgtcgacacacccaagatatggttacaattccacggtagttagtcagcggcacaactcacatcatacaacggcataataacgcgcatagagcaaaacgggcacacagctgcgcctgcccaagtgcgttaatgcgtgctgcgcgctactactttcagaggcatttccacaaacacgccacgcgcgttcgaagtccatacacgaaatcgagcacacaggcatacgcaaaaaagtcagaaaagcagtagcacgctgacctcggagacgacggcgccggcctggcaaacctgccatcttccgccgcgcctgcgccgcccatcgtctcgtcttcctccgccgctccgcggcggcgcgacaggctcgacgccgtcgaagggttggagaaagagagagagggagggtgacaaattgttgatgctgcgcaggccgtcctcatagatctattccattctctctcttaataactttttattactccctcctcctaatatataagtatttttaacataatgttaaattaattttttttactttgacaactaatagcaaaaaaaataaaaatgattaatcatgtaaatttgatgttgctggttttatcattaaacaaattatcttaatatgcaactctttttatttaaaatattttacttttatatactcttcgtttctaaatatttaacaccgttgactttttaaatatgtttacccgttcgtcttattaaaaaaattaagtaattattaatatttttctatcatttgattcattgttaaatatacttatatgtatacatatagttttacatatttcacaaaagtttttaaataaaacgaacggtcaaacatatgctaaaaagttaatggtacggagggagtatattgttggttaaagtaacatcttgaatccccgcaaaaaaaaagtaacatcgtgaagactgtgccaagatctaaaaatgcttatattttgggacggagagagtagcaagtttttttttcctctcaaaaaaatctcatgtaaattccaaacattttttttcatttcgtttatttaaattatatttttttttcatttaaggaagtcatacacatgcgcatatacgcatgaatgtgcgctttaacacatcctataagaaacactcttaatatagttacaattttattgaaggcattttcgtcgtgtgatatttatgagcagcatgatttgaaccagctgaaccaccacatatcggtctttcctagtttcaaatatttttatacgtatgaggaaatagttcatctttgttcaacagtttcagatacgtttggagcaaatttacatcgatttgaatacaaacttttgggcatgaatttctagctatgtgctatatttttttaataatgaaaatgaattatatctccagtctttgcccacggacacacagtaacaagttttagaagaatttaaaatagacgtgatctatgtcctacttagcttggcttgctatgtcctgcggcctggccaacgatacattccgtgtcgacctatggaagcaaaagcaattcagtttataataatgctgctataaatttagggggggggggtggggggtggggagtgaaggaatatttacagatacttttgtgggtacaaacggacgattttcctaccatgttttttcgaggtttcttaattgtcaactttaaaaatagtatcaagacatggtactatttataacataggaaaagttctataattaatatttagacaaataagttcgatacatcttactccctccattccataatataagttttcttatatgttccataatataaggcatacatgcaagcataccattaactatgacatcttctccattaaattattactttttaaatcctctactcccatgttatctaatcctattggatgcatgcattagtatttattaggatgatccaaactacaatatgataataattatttcttagtttttggattaagggtggttgtgtcttatattttggaatggagggaatattagttatatgtatataggattatatatatcttgtgcacccaagatggttaaagggttgtacttgaaaagaaagatggttaaaaggctcttcttttttctacatgtaactacattttctggtggaatacacttacctgtcggcatgtattggttgccatgcacggacgagactgtaggattgtgagacccgtcgggaccactaccatatccaactccatgttctacaaagcaattatatgaattttaaaccaagttgaatttcacgtattagaatatgttatatttttccttaactatataatagctagccgatgttatatatagatatttcctctggttctaatatgcagtacagttaagtagttttacagcttttatacaccttttctatttccattccatgtttgttatctttccaaaatgctactactttcaaaaataattgtctcatattttacagaaaactctgatatattttcttgatggataaactattttttctatgagtatctaaagtttcaagtgaaatgcacttgcctgtagatatgtacgggttgttgtacacgaaagagattggaggctcgtgaatccccccaggtccgccacctccgcttccatatccacctccagcttctacaaaatcaaccactttaaataaatttatgcagtaaacttttaaacatgtttgtgttttgagaattaatatattatatttttcctttacccaataggtagcatatgttcatatatgactatttcctcttatccgaaatgcattgcaagtagtttcagaacgtctatacactattttaccttttatttcaagtttatacttgtcacgtaaatgctactactttcataagtaactcccatatttctatagtaaaatataaatgaaagacaataaaataatctaatataccattttaaacttccattagtaatgttaaaaaccaattacttcgtctgaaaccagagtgcaaatcagaggaaatgttccaccggcgtgcgtcctcaccagcgaaagggccaccgccgccgggcaccggcggcgcccactgcggtgggaagaagggcggcggaggcggcggcggcgagagcgcgagcgaaagcgacgacggcagcagcagtagtaggagcgccatggccgccgccgccgctcgtagcccgaagcgaagccgacgagctgctcccatggccgcagatcgagctcgctctactatacttgatcaatcgttctctgaaatctgaagctggtagcactcggctgtggttttcacgtccaaggctttgcccccatatatatataacatataaacgcaacgacgcggtttgctatgacaatgcagcttctctacttgctagccagctaggagtgagcagtccatcactcaatagagcagtatacagttcgaactgtagtgtcaaatcctgctcaatcagccacaggttctgattataatgtatactagtaatattatgcttgttttgagaggacaaacaagtggactgcttctgcgtctgaccactgaaagattaggcctgaagactgaagtttccctaagagcaggtacaataggctatttaagccggcggtaatagtgccatgttggatttacggatgagctgaagaggacagagggtgtgagccggcaactatttaatcgccgactgcagctccaagacgagcaaagcggcacaggtctcctcctcctggcccacgtagtggttatggggtccacacgaacggcaggacggagcgatggctagcttttcaatcgctaactgaaaagaaaagagttgttggaaactgtgtaagcttattgcatacactactccctccattccaaattgatctacatatttcataggtacaccaagaccaagaaaagctaataactctctcatactatatttactctagcaacaaactcgatgcatgcaccatcccactatttcctagccaatagcaaatcaagatattgcatgtgggttataaatacttatgtgcatacatgcatcaatgtccatttactccaatacacaaataacgaatagacttaataaatgaacacaaatatgtagatcatttaggaataatctcaaaaaaattatatgtagatcaatttggaatggagggagtaatttttagcactatctctattatactgatgtgttatttttagagccatcagtcagctgtactattaaatttgctctaagatataccaaacaaagaatctgcttaaactcatcctcctcacagcttgggatttgtaaaagaaaatgagccaaagagccttccaacataaaaagctctccacaataacggcggtgacaaaaatcaaggaggaagtcaaggcctgagctttagcaagagcaaaacgtctctcagaattaggggtagtattaatgggtcctttcacaacccacttcagcctttaaatatttttagctaaaaaatgtactccctccgtcccaaaatatagcaatttttagatggatggaatatgttatagtactacgatatgtcccatctacctaaaagttattatattttgggacggagggagtcctaaatttcagtctaactctttttgaacccagccattacatttttccacccctgctcatagctcatccttggttttacttttagtgcggttctcgtttttacttatacaaaatttttactcctactttattcaatgaaattgggacatttagtactggttgtctggttcgttaaaaaaacaagaagttccccaaccaagagatgaacaattctttatggttactgatcaggccacgaggatgatgtattgtcactctccctggcaactctgatgaagacatcctccagcgttcgttgtgtcagccaagccccaggcaagaacgttcatcctgcgctttgcatgctccatgggcttcgccatctcgaacttctgcgtcccggagatgtggtacacaatgttcatggtaggggagatggactggaccagtctcctcatctcctcctccgcctcgcccgtcgcggttgttactgtgaggacatatgagcctccatattttgctttcagctgaaaaggcaagattatgggggttcaagttactaagttagcatttggaatcaatggccacatatgaaaaatgtgatcagtttacatgtgtagatgtacctctttagagttcccgatgcattgcaagctaccgtttgcgataattcctatccgatcgcatagaaattcagcttcttccatcgaatgcgctggaataggtgaaagtatgatgtgataatatgatgtggtgcaaaagatttccatggtgattaactggactaaggttatactgttgtatcagagttgaaagcaaagtgcagtacttgtgagaattatggccctgtcctgcttggcagacttgacagcattccataagtctttccttgatgctgggtccaaccctgagcttggttcatccatataaactacctgcagaatgttcaaaatgcatgatttatacatgcaagaatgttcaaaatttccctgaatttgacatatatgaattgtaccttagggtcaccaattagagagattgcaacgctgagacgacgtttcatgccaccactgtatttgcttacaagcttatcggcaatgccaccagcaaacaggcgcacatttttcaaagatttctcaatggcctaaaaaaataagaaataggagatcttagatgattgcttcagaacttgtatttataataatttctcgtgaaatcataatcacataagaacagaataaccactgggaaaatgtttgttgaactagtattataataatctgtgctaaagtgccttggaggataatgtgtcttggatcttatatgcagatgataagttcatctttcacttgtaaatagtgtttgaagtcgaatccatcatgttcatccatggaaaagaaatcaccatatattacttcctccgacattattgactttattgggtcaaacttttaaaactttgactatcaatagctctcaagatatttagtttgaaaacgtaaaaatcatatgggtagaattttacttattattgcttttacaatattataattttgttagatattatcgttatattctaatagaaaaatagtagctaaagttttgcactaagactggataaaatcaataaaattatatatttaaatacagagatagtacgattatttatcaaatggtcacatattacctgagataatggtgcaccctgcaaattcttaagtctaccatagaacaacaaatgctcacgaccattcagtgtttcccatagcaagctgcaacaagaaaaaaaaagaaggggaaaagttaattaaagttcaccaatactaaattgatttaaaggctgtcctaaactaaacaaaactgtaattcagaaacatcagagtgagcttagattactcgtgctgtggacaaacaccgattcctgcataaatcttgttcatctcgaattgtatgtccattccttcaatgtacgccgtgccagacgtaggtttagtaaatccagtcaactgttgtcaggataagaattaacccccttaaatccaataatgtcatgtgaccaaatgaaacatcagttatatttgtaagtgatctatatagggatcatttgtgataaacagaaaatgtggatcatttcttactacctagacatgtttcagatttttagaaatgtatatgcctgttcctggccttgaaagtggcctgtacttgggaagaggaattgtgcaaaaaatggtttacatactagagatttatggttatctaaatatattatttatttcttttattattaagatctaaaattaaatcatacttaccatgttaatgagagtggtttttcctgcgccatttggtccaagaacaccaaaacattgcccacgtggcatagaaagagatagccctctgacagcaattttttttgcattcccatcttttccatggtacactttcttaaggttgtcacagatgaccgagtagctattctttgattcttgtaagatctgttaacccgtttctctctgagaaatcattatataactaaattaatactcatgatgctctgtgcaaatacatacatgcaggactaatttcaacatattatgcttgtctaaactatcttatgtatttgtattccatacagcattaaagtttggtagaaggaaaaaaggaaggtaaaaataagataaagtaagactccaagtatccaagctaacttttgacgtgccatactataaaggataaactgacatataagctgtttctggcctatgattagaaagcttaacataaatggtcagaaagaccaggagtcttaccggctagcaccacaagttggtgggctagtcggtcttggttcgagacttacccctgcctaataccatcaatatgaatatccttcttttcatatccagctttttctttagaaattacaggaatatatagagatgaacaaacggtgcggcgcaggcggtgggcggcggcgcgcttgggccaagagaaaggagagcgaggggagcgaggaggccgcagaaagaggaagatgaaggggaaaaggagagagaagaggggagaggaaggagaaaggatgaagatgatgacatgtggggcccacatgtcggtgggtcccactattttttttagtgtggattacatgttggtcccacgtatttttgtttttgttttttattctaaaatgccacataagtgacatgtcaacgacacgtaggacggagaccgggtcaacactgccacgtaagcaccacgtaagccaaaaccacttccaaaaccacctgggatacatgttgcaccggttttgatagttggaggagtcaatatatccggttttgtggttggaggtcatgaatcatactcgtattgtagttttttttttaaattctcacagctagctttattcattcgagaatatagttacatcattaacaagaagttgcggaatgaaggcagggggatcatctatccaaacaaaagaatttttgcctatcaaagcttgcctagctagctcatgagccacaacattactatctctaatacaatgactaatggagatagaaagaaaatctttctagtactgggagcattcatcataaatcgcaactgctgccgtggcagaaaaacctccctcttgcattgttgtgacgacttccatgcaatccgattggaattccacacgactacaaccgatttgttgtgccaataataatccatctcttaaagctgctgcttcagccatggttgcatccaccacatgaggaatataactatgtgaagcagcaataaacccacccgcagagtctctaatgaccgctcccgtgctaccagctcctttagtttcatcaaagcccgcgtcgacattgatccttcaggaggtttcctccacctcttgttaatctcagtggttttctttgacaccagtttataatttgttgtgattgctacgatggacaacgccgatcgtggtggtgactgaatttcctctccatgaacactctgtctccgttgccaccatatataccagcaccctgtcaagataatgtccgctagaccaatattgttccaatgcatagctctccctcccattctgatggcttcttgaagcacgaagcgcttcaatctcctgctcaatcccaagagagctccaaacctgtctagcacgagagcaggcaaacaaagcatgtctcacgtcctcagcttctgttttgcacataatatgcttgtttgccaacgtaacgaagcaaggaatgcaaccatgaagcacgcgccatccaaaaattttgattttgctcggtatcgatagcctccaaagctgtctccatactgatgctgccagggggggcagttgccccgggttgctggataaagctcctaaagctgtgactccattgacagtgataggcagatttgactgagaacaaaccgtttcggttgaggtgccaagcgatcagatcctcccgctgaggagcaatcgggatttggaggattcggttcgcatccacagaccagaaaagtgatcttatcaaagcttcatcccatcgaccatcaactggattaataactagaatattacctctcggagtcaatactttcatgttggggctgcttgggatccagttatcgtcccaaatatttatctgtgtgccatctcccactcgccatataaatccctttttgaagcaatctaagccggctaacacactttgccatgtaaatgagctcccacttctcatcttggcctggagcaatttcccatcagggtagtattttgctctcaaaatccttgcgcagagagaatttagctcacataagagtctccaaacttgttttgcgagcaaagccaaattgaaactgtggaagtccctaaaacccatgccacctttacccttcggtacacagagtttccaccaagcttgccaatgaatccttcttttttcatcgtcgtcaccccaccaataatgtgatatagcatctgtcatccctttgcagatttttttggggattttaaacaccatcatcgcataagttggcacggcttgggcaatggatttgattaaaacctccttaccacccatgcttaacaatttctccttccatccactaactctctgaacaattctatcaataagatgtcgaaaacaatcgcttctatctgctcccactaaagaaggcagacccaagtatttatcattgagagactcagtcataatattcaaagattcacatacctccaacttcatatccggctttgtattcctagagaagaaaatactagatttgcttgcacttaagaattgacctgagttctgcaatatctgtctaataagttcctcaggcagtccgcattctttttatcagcatgcataagaattaaggagtcatcagcaaatgaaagatgggaaaccattggggcatctctgcatactctaatcccttccaatgctccattctcctccacttgttggatcatacttgataggccttctgcaacaaagagaaataggtaaggggataggggatccccttgcctgattcctcttgtaggtgtaaaagtttctgtttccattgaattaaaccgagcagtatatcttacagaagtcacacaggacataataagagacacccacctatcatcaaaacccaattttaacataatcttttccaagaaaacccattcaactctgtcatacgccttatgcacatccaatttaatcgcacataacccccttttcccttgtttcctcttgatagtatgaatacattcatacgcaatcagaatattatctgtaattaatctacctggaacaaaagcactgatcacttataacctcaggaaggatgctcttcatcctgcgagagagcatttttgaaataactttatacaccacattgcaaagactgatagggcggaattgagccaccatatctgggttagacacctttggtatcataataatagtggtatcattccagccctcaggaattgttgcagtatttaccgctgttaaaacttcctttatcagatcatctcctagcattgaccaaaaccgtttaaagaaaatggcgtgcaaaccgtctggcccgggagctttcagatctccaatatcaaaaagtgcctttttgacctcttcagctgtaaatggagctaaaaggctccgattcatttcaggcgtgaccttgaccttaactgaatccaaaactgattcatcaagctcctgcatttcagactgaaacagatgggaaaaataattttgcaccatagaacacatagtgtcgctattctcttgtctcaccccctgttcatcaaccaacccagtaatcatgtttcttttccttcgactagaggcaaattgttgaaaaaatttggtatttcggtcaacatgctttagccaatttgcacgggcgcgctgtaaccaaatcagttcctcctgctccattaggagttccaggcggatcaacaactccttttgggcagcgatgctatcatcagtgaggggccccttctaatctcttcaagttttttttgcagcttttttatttgattaacaggtcccttcaacacctttttatcccagacgtggagctcttcatgtacttgcttggttttttgcgagaaatttggcacatctcctctggccgcagcactaccgtctcttccttgagccaacgtgcttcgaagcatttaggacctcgccttgtattggcatcagaatctgcccgcacaacagtttcaacaatcagcggactatggtccgaattgagcataccaccattctccagtcgtgcagtagggaaaagagcattccactgcgcgtttgagacacctcgatcaagcctttctcttattctccccctttgccaagtaaaaatgtcaccactatagcccatatccgagagagcacaatcagccaaagaatcactaaaagcttgcaaaagacgttgttctctcggtctccctccctccttctcatgatggaaaagaatctcattgaaatctcctaactccatccatggcctatccatcatcccatgaagatatctcaaggcctcccatgttttgcctttgtgctcccaacgcgactcaccataaattccagtaagtctccattcccttccatcatcaacaattacatcaatgaaatattcagagacatcttgcacataacataagcagtccaccacttggcccgtcactctcgaaaatgctgagatggtcaaaatttctgccttagctgttcccaaatgtgtttcagacaggaacaacacatcgggtctctcacgcctctgtaaatccagaagcgctcgcactgcccgccgcagttccatgctagtattttcattgtgcccggtcactctcctcaaaggagagcgccgattgtgcattagagttgtttgttgcaatcacgccatcttcacttctcctcaaagggctcatattactaccgagttgggaagagtgttccagcaagttgatttgctgagcaacctgacctcattagtatctcttttcccggactcaggggccaggccaccatcttcccctaaggccaatagcagtgcgggtaacacacatgccgtaaagaaccacacttcacagtgcacaatacatgtttgtgggtcccacccatgttagtaggtcccaccatctctcttttcacattcatctctccctctctatctctatccattcttctcgcatgccactgaccaggacggcaagcggcaagggcgaggacggcgggcaagaaggcacagacgccggcgagctcggacgcggcctcaacctccggtgagcttctccgacgaggacagtggcggcggcgcggaccgaagcggcgtggcaacgagctccccggcgacaccgaggtcggcgacgcggagcggagagcgtggacgacgacgaggccctccctcactcggctccacggcggcgcacgacggcgaaccgcccgccccctcctctccttgtcgggccggacggcagtgacctcgacggtgggacggctgcgcgcatggcgaggtagcgggtcctgtggcggcggcgtcctcggggccgagtggcgccggctgtcccctcctccctccgccggcgccgactcccctaatcccgaagcggaagaagccggcgagggtggcagtggcgccgaacgatgccggggacgcggcggacgggaagccccggggcgaggacggcgggcaagaaggcatggacgccggcgtggcggcgcctctcatcgttggggccggaggccacagacgccggcgcctccctccccctaccccgctccgcagcaacgggctctcggtggggtcttcctcgcggaggtcgccgcgcgacctcgtcttcctcgcggacgacgagcggcggcacggtcgtcgtcgaccggagccacgcgaccttgtcttcctctcaaagccgggtggagcggcggcccgagcggcgacggcgacgacgctgggctgagcggccagatccggcctaggcccactggatcaaggcgacgacggcgaggtcggacgcggcatcgacctcgagctcctctccttctccgcgctttccccatcgagccggcgagcttctccgacgaggacggtggcggcggcacggatcgaagcggcgcagcgacgagctccccggcgacatcgaggtcagtgacgcggagcgggagacggcaacgaggtcgacgctggagagggcgcgaggggacgacgagttggaggcacgccctccacagcgcgagctctaggcgttccctctgcctcgcgcgagcgaggaatcgcgtttccttgcttgggagcgagcggctcaacaaggacgtggtgctacgcgacacgtcggcgaaattcctagctagcacaacaaggcaacgctctacctaggagcactgtgaagggcctaagggatggttaagggggttaaatatactttttcctaaaaaggataggagcgagacagacggcgctgggggacgaggcttgttgggccggccttagcccagactcacgacgcggttgtgcgctttctaggtggacggatggatctgctcgactgctctctgccgtcgtgagggctgaagtcagacgtcacgagctgattccgcctcccctcgcccctgccatctcaagcgccgccgttgtttgctccatccctcccacgccaaccgcagcgcagccgctgctgccgtcgattccgacgcccagccttcgccaccggcacccctccccgctgatcgcctccagaccgacgccgcccctccccaccgaccgcatcgcccccacctcaccctggatcacgacgggatctcctccccttcctctcacccggtgccagaccgccgtggcttctcgctgctctgcctcttccttgtgcctcatcaccctggtgttgaaaggaagaaggtgttagaagtagtgatagttcagagatatgcatgcatgcatatgcagggagtccggtgcatgtgatatgaatgagattgatttggttgagataaaaccggatcacaacagattttgtttcctgattgtaagccacgttggaggctatttccaactgagatcaatatattcgtgcggcctcgacaagaggtgataacgcttcctaaaaaccttttatggtatcagagcccgaaatcgccagaatcagatcgcatctgttatggcgagttcctccatcagcgccggcaatcccttctctggccatgccgtccctaagaagctaaccaggacgaatttccttttatggaaagggcaaatcctcccggtgatccgcggtgcgcgtttggaaggttacctcacaggtgcaacacaagccccgtcggctgtgattgacgccaaggaaggagaagccactgtcaagaaatccaatccggcatttgaaacctggattgcggcagatcagcaggtgttggggtttcttctctcaaccctatccaaggaaattttgactcaagtcatccacatggaaactgcggctcaagtttggaaggcaatcaacgagatgctgtcctcccagtcgcgtgcgcggtctctgaacacgcgcctggcgctagcgacgacccagaaggtcgatctcagcgtctcggactacatcaacaaaatgaagatcctcgccgacgagatgacgtccgccggcaagccaatggatgatgaggaattgatgtcctacatccttgccggtcttgatgatgattgggaaccagtggtgtcttccctcgtcgggagaccagatgcagtttccttctccgagttctactctcaacttctgagcttcgaatcaaggcagaaacttcgccatgcagcagcgcatcagtcctccgccaacagcgccaaatgtggtggtggaaggggcggctacacccccttcaaccgcggcggacacagcggcaacaatggtgggcgcggcaacagcaacaatggcgggcgtggtggtggtcgcggcaacaacaatggaggccgtggcggcaaaccgcgccctgtttgtcagctctgtggaaaaacggggcacgtcgtcgctgactgtttgtataggtatgatgagaactttgtttctgataataagatggcagctgcagcctcctatggtgtggacacaaattggtatgttgacaccggagctacggatcacataactagagagttggacaaattgacgacccgggagaagtacaatgggaaggatcaaatctacatggcaagtggtgcaggtatggacattaaacatattggccattccgttattcatacccctactcgcaatttatatcttaagaatattttacatgttcctaaggccaagaaaaatctcctttctgcacgtcgtttagcccttgataatcatgcctttgttgaagttcactctcgtttctttgccattaaggatcaggtcacgaggaatcttcttcttagagggccttgccgcaatggtctctatcccattccacagtcgtcgctatcttcatccaagcaagtttttggagccatcaaacccactatttcgaagtggcatagtcgtttgggtcatccatctttgtctatcgttcaaaaagttgtgaacaataataatctcccatgtttaggagatattaatgaattaggtgtgtgtgatgcttgtcaaaggggtaagagtcatcaactcccctatcctaagtctttcagtgtgtccaataatcctttagagcttgtgttttctgatgtttggggtcctgcccctgactctgttggtggcagaaaatattatgtcagtttcatagatgatttcagcaagtttacttggatctatttgcttaagaaaaaatctgaggttattcataagtttcatgagttccaacaacttgttgagaggatgtttaatcgcaaaattattgctatgcaatctgactgggggggagaatatgaaaaacttcattccttttttactaagataggaattactcatcatgtctcatgtccccatgctcaccaacaaaatggctccgcagaacgtaaacatagacacattgtggaagttgggctttctttacttgctcacgcttctatgcctcttaaattttgggatgaggcttttcttgcagctacatatctcatcaatcgcacacctagcaaagttatacaatactccacgcctttagagcgtctcttgcatcaaaaaccaaattactcctctttgagaacttttggatgtgcttgttggcctaatcttagaccctacaacactcgcaaacttcagtttcgctccaagcaatgtgtgtttcttggctatagcaatattcataaaggattcaagtgtctagatgttgcaactggcagagtttatatttctagagatgttgttttttatgaaaatatttttcctttctctaatctccactccaatgctggagttaggctcaaatctgaaattttactcttgccctcaacactgttgaatcctgaagttgctagtaggggtatacaagaaaatggttatatgtttaatagtcctcctgttgagtctaatatttttgatgagcaagtatctgaacagggagaagaaggagagcaaaattcatatgctgcacatgatacagaaaatcctgatgatggtggcaatgatttctctgttgcttctgatgctgaaaatagtactaaggctgtgtttagttcagcgcaaagtttggattttggttgaaattggagatgatgtgactgaaaagttatgtgtgtatgacaggttgatgtgatggaaaaagactagagtttggatccaaactttgaatctaaacacaggctaatgcaagtggttcagctgaaaatagtactaatgcaggtggttcagaacctgcagcaaatacacacggcgcagaaaatgaaaacagtgctactgctgctggaagtaccacagccgaacctgcaaatggcagtggtggtggcaagtctgcgagtcgcagtagcagcagtacagcaataggtagcagtgttactgctaatcagtcggttgatgactctgtgcaggtacaacagcagcaaactagacctaccactaggctgcagagggggatacgtaaggagaaagtctataccgatggtacagtgaggtacagttttcttgcttcctctagtgaagagccacagagtttaaatgaagctttagctgattctaattggaaacaagccatggatactgaatttacagccttgattcataataaaacttggcatttagttccaccacaacatggtaggaatgttactgattgtaagtgggtatataaaattaaaagaaaagctgatggtagcctggatagatataaagctcggctggttgcaaagggttttaaacagcggtatggtattgactatgaggatacttttagtccggtggttaaggctgctactattagagctattttgtctattgctatatctaggggttggtgccttcgacaacttgatgtgcagaatgcttttcaacatggtttgcttgaagaagaggtttacatgagataaccgcctggatatgagaataagagtaagtctagttatgtttgcaagttagacaaggctttatatggactgaaacatgcactacgggcatggtattctagactaagtagtaaatgatgtgatcttggttttaagtcatcaaaggctgacacttcattatttttctatagtaaagggagtgtgactatttttgtccttatatatgtggatgacataattgtggctagttcaactcaagatgcagctgaagcgttgctaagagatttaaaacaagattttgcccttaaagatctaggtgatctgcactattttatgggtatagaggttaacaaggtaagcgatggtattttgttaacccaagaaaagtatgcatctgatctgttaaaaagggtaggtatgtcaggatgtaaacctgttgccacacctatgtctacctcagagaagttgtcagctcataatggtactgaactaggagaacatgatgccactagatataagagtattgttggggctttgcagaacttgactttgactagaccagatatttcttttgcagtaaataaggtctgtcagtttttacatgctcctactttacaacattggatggcagttaagaggatactgagatatgttaagtcctctgttgatcttggcctaaagattaacagatcttcttctactcttgttagtgctttttctgatgcagattgggcaggatctgtagatgacagaagatctacaggaggtttttgcagtatttcttggatcaaatctagtgtcatggagtgctaggaaacaggctacagtatccaggtcaagtactgaggctgagtataaagcagtagcaaatgctacagcagaggtaatgtgggttcaaactcttaaagaaattggagttcaagttcctcctatggcaaggttatggtgtgataatttgagagctacatatttgtcagtcaattctgtgtttcatgctagaacaaaacatatagaagttgattatcattttgtaagagagagagttgctaggaagcaactagagataaagtttatagcttcaggagatcaagttgcagatggttttactaaaccaattactgtttaacagcttagagattttagacacaatcttaacttagataagttatgattgaggggggctgttagaagtagcgatagtttagagatatgcatgcatgcatatgcagggagtccggtgcatgtgatatgaatgagattgatttggttgagataaaaccggatcacaacagattttgtttcctgattgtaagccacgttggaggctatttccaactgagatcaatatattcgtgcggcctcgacaagaggtgataatgcttcctaaaaaccttttagaaggaagtagcaagcaccagcggcagcgaagtcgacggttgggagaccctaaaccctagaaccaagctccagaatcgatccccttttgcctaccggtaatgggcgacccagttctagcctacaggtacggactccttcctccctctctcccagacaatcacgacatcgatttatttatcccattgctcctgttaacttggtgcgttgtttgattcccagcacttgtttcagaatgacgtgtgaaattgcaagtacagagcccagtcagtcatctcctcatcagcacggcggtacgagaagtctgggcacagcaagcaagcaggaggctagcaaaggtttgtcagctctaatccaaaaacagcacctcattgcacatattttccctgtatgtgaaagaccatataagctgtgcagacaacaggtgagtttgatctccctgtgtgtgaaaaccatctatcgtgcagacaacatgtgttattatcctgtcgtttatatgcaaactatattgatagttcgagtgactgaataatcaaaatgagtcattgtcagtgagtagtattttcatcaggtgaagaaaaatggtagataatattactatatgtcaatgtcacgcagggtttcattcagtccctacacacagattccctatgaaaaaattcattagccaggttgtggtagtgtggtcttatctgccaccagtaatgcaaaatactaatctgagtgtaaccaaatccttgaaattttcaaatattcaaatagaattgggagaactgatgaaatttcattttagaatcctgcagtgtgtgaaggtgtgaaaatgagctttctggtatctccttttccaattatgaaattatttttctttatttatgatacatctcataggtagattgaagaaattactatgacagagtgagttctagatcccaccaaaaactcagattcaattttacctccagcatagtgacatattcaatttctatctcgaatggtgcttcaatatcaatgtggggttttttttggcccttttttttaaatcttccttcctctattctttgtgtaaaaatataagatgcagtttgaaatgtattgttttttatatggtcatcggcatattcttgtttgctaaaggaagtatgtttgataaatagtatgtttcatatcagagctttttcctccaatatcttgtcatgtatggcatttccaatagcttttcatggtgtcatctcgatggcttgcatgtataagagatagacgggaagggcttgtaactataggggtaccatgattgtgtcagattgctttgacctttacggaacattatttttcaacaaaaaggaataatactgtgtttcgatatcctcttttcttgtatttcagattctgtattatgtaactcgtcgcatttggtgcctacgtttgtactatatcttactgatttacagtaggacctaagtggtgttcaatttttcatttcattcctacccctaaagataggtactgtggcatggaagatgtatgtttctgtgcaagctaaatcgcacttatgcataaacgcatggttaattactttatctcctcagttaatctacacaacttgatttccaaaaacttgatagtatcaagtgaagtctcaagggattaatacatgattatgctttgaagggctttagaaaaaaaatgctgggcttaagtacaacatgctggatcactaattatccctcttctcaaattgatcaaatagtactgcccatctcgaactatgtatattctaatatccataactgcctactctttatgatcatatagtattgtctctaataaatttgatactgtgattttatatcatgatttcttgtatagcatttttcattgaatgctttgttgttaatgctatccctcaactatcagtaggaccagttggatctgtcgagtctcataaagaagagatgcttgtgcttgtgcttgctggttcatcaaacagctcgggaaaggccttggcctctccagtcggagctccgacaaaggccgcagcgcatgcatctaggcaacattaggacctgctttgtgctaggagctactgctctactaccatcgtcaccgctcaaaacatcgtaggtaggtagcctgatttcgtctatttctcttcaatttctgcaccctgtctgaatgtctggctttttagggttcttccgctcctgtacgcccacaatctttcaagtaattgccaccagcagacctccctgcaggacatcagcgagctgcaggttgcaacacgccagcaggtatttcttaatttggatattttaattgttataatgtgaaggaatcagtggatagatctagcttgaatatttgactatctgtcattaatttacacagaaatgagaaacacatatgtagccattaatgtatatgatgtttataggtcaagctatatgtgattagttttcttaaggaagataatagctcaaagtattttcttcctcagaggagattttacaaaaagtactgtcaccggcattgcggatccccgatctccaccgccagagctgcgtcgctagactcggtgacgcccatctccgtgccggctccgatctccacttgatctccaccgccaaataccgtcgcccgcctcggttgtctcgtcccgtcctccgtgccacccctgatctccaccacccgaacaccgtcgcccgccctgtcacccgcctccacacagccacggatctctgattcgcacaaaggtacataaatcctcctctcgtttcatcatacggttcttaatattttccagaatcaaccaaaatacaacgaccaaaacaatcattatggtatattatttgtgtccaagttctgatgaatataatgatgtttactatattaattgcaccactaaaatatgggatgtcatcagtattttattttttaagctttctgcctgaattggtttcatctgtcagcgtaaggaattgcttgagtataagactcagctgtcaagagggccgtctcgccgtcgtctcaggctagggggccgccgccaattatctattcccatagagggctgctatataccggtatcccgacgaaaaagggataattctgaaaccaacacaatatcgtgcgcgtgcgtcaacaaaaacaggaatagaaacgtatcgtaccagtgctcgctgccccgcctgaatcctcccgacgaatcctcctccagaatcgcgctcccgcgtgcgattcctcgccggcgcgagctcctccgcaacccgacgaatcgcgattcctcaccggcgcgagctcctccgcatcccgacgaatcagcctcggaatcgcgcgtcctcgccggcgcgagctcctccgcaacccaacgaatcctcctcggaatcgcgcgcgattccgagtcggcgcgaactcctccacaacccgacgaatcctcctcggaatcgcgcgcctccgtgcgtgattcctcaccggcgcaagctcctccgcatcccgaagattcattcgcggaatcgcgtgcctccatgctcgtttcctcgactgattccattggcgcacacgttgtctgccaatttcctctgcaatccggcgtcttatgtgattgctgaaatttttcacacaagtagcacatgattcttgtggttttcaaagatgatactctattaggatcatgtgatactcttgaggatcacatggtactcttgttatcttgtaggatcatgtgatacctctgtagcatcacatggttctcctcaaaaaagtatcattaagtgtgatacatttgaggtatcacatatgatcttacttaggtatcatgtcttctaacatgatccctatgggtttcacagatggtacttaatggtgtgatactttacaggtatcacacatgatcctactaaaaaaaatatcattaagtgtgatacatgtgaggtaccacacatgatcctacttagggatcttgtcttttaacataatcctacttgggtatcatgtatcctacttaggtatcatgtcttctaacatgatcccaataggtttcacaaatgctacttaatggcgtgatacttatcacacatgatcctactaaaaaaagtatcattaagtgtgatacatgtgaggtatcacacatgatcctacttaggtatcatgtcttctaacatgaacctacttaggtatcatgtcctctaacatgatcctacttaggtatcatgtcctctaacatgatccctatgggtttcacagatgatacttagtaggatggtgtgatactttacaggtatcacacatgattctacttgggtatcatctctggtaacatgatccctgtgaggtttcagatatgatactttagtaggatggtgtgatacctgtgaagtatcatacatgatcctacccaggaaaatcatctatcatgatacatgggtaggtaggatcatgtgatacatgagtttcattatgattgatacatgtgaagtatcacatgatcctatctagtatcatgtcttgtaaagtggttccctactggtttcacatatgatacttgagtaggatcatgtgaaccctgggaggtatcatgatcctcctcagtatcatttcctcaggtttcatatgatactgaactcggtttcattgtgtacaacgtactcaaactatatatagtccacagaaaaggtctacgcaatataatccacttctttaccaacatatatgtacatgaaaacagtagccacatacagagttcatgtctttgattgttgtgccccttgcaaccttccagttcaagacaaaaacagtagccacatacacaattctgaaacttgacttgttacatatgttggttgggggagagggagggagggagctacaaaaatggcctaagcacacatccgacactgcttgaaccgaatgagcatattggttctgaagcttagaaacgacgttttggatgtaagtcgttaaagcgatggtacaacaaccttttgcatagctcactacgatattctttcatgtagtcctgcatagatgacaagaatgagcagtgttagatttgtcaaagtggggtgaagctgagccgttgttcaaccttggagagcaccttgtcttctttgaaacatgcatgaaatcggattcgcttgaagcaggtggcaacgccatttcaactctgtgcacatgtgtgaacggataaagaaaatatcatttcaatggtgattcatcctcgattgaacaaaagtatctaatcattttaaaacagaaaacacccatgtagccactaagatatgcaaaacatcaacagaaaaaaaaatccaaatcatctgcatctatgactcagctgcatctgccatctctgtcgccacgcactgccctctatgacaaagaggataacaattgacaagcaaagcgtgcccggaactagaagccaacaaccgactgatgcggatttctctgattttgtttacacttcagttcacccaaaaaaaaatcctactagttgaatggagatttctctgtttcaaaacagtgtgtacttgttaacggcaaaattgcttgctccaagcaatatttgccttcccatcaatatacagctagaagcatttcaagcgatctattccaattcgaacattttgctgcaagtatcatatgattcagcacatacacacatccctcacctctgctacaaacacccccagtgaatgaacaaaaacacacagaaaaaagagagagagtattaacttactttgatttcaatttggatgtgatatgatgagccccatccacaaattagtgattcaacaaaccctagaaaatgcaaaaatgaagagatgttaaatcaaaatcaggaaatcgatgaaaaaagaggaatgagagaaaggggtatcgtgcgcaccggctctgccgcagcagcagccaccggctccgccgcagacgccaccggcttcgccgtagacgccgccgccacagccgccaccaccacgctcacgccactctccctctctggcactactgaccttgtgcgcatcggcgccgctgaagaggaggagccgcaagcaggctccgccgccggctccgcccgccgccgactccgccaccgccgccggctccgccgccgcagccatgctcgtgacgatttgggagctgtaggtgtctgtttgggagtgactcagggccgttttggattgctaccaaaacttagccttaccaatattttggtagtttaaatagtacatgtgcttgtttggattgagaccaatttattggtaatgcccatgctagatttgccatcaatctagaacaatcttcactagaagtcacatgttggctttatattggtaccaaaccaaatataatcttatcctaccaaaaaattggtaggaccaaaatttatctaagatttggcactactaaaaatttggcatggtagcaatccaaataggccctcaatgtttctcgagtgtgtgtatctgatccgtgagggtgtgtgtttgatccgtgggaaattgtcccgtccggggctgactccaaacggtataccggtgactagcatttctgattcccatatcactatgaacaggtgttttgcgctcgcaaaacctccttccctgaattgaaggtacaagcaatttcaagtttttataattttcataatgggaaacctgtttagattgtcgagttttcagattatttagaatggggtgcctgtttagattgcagcataggtaaaaaataaaaataatatactcaatgcagttctaacccctcgatgcattatttcagttgaagttcagcatctaaaaacgtatatcgcctctccaaacatgatgtgtactaaaactaatgagaaatgcttcctcttgattgagcagatattcattgtgaaacagcactataaaccatgtttcttctatcatcattaaaaggctgaatgaaaaatgccagagcgagcgttcctctgaatatttctgaatttggcgatatcatttctgggttgttcttagtgaattttgaatataatcatttttattttaatcatgattgatttgcacactaatgtcgtcatctggcaggagcacaagctacccattcaaaaatcggtgttgggcaaccagccgcttctcttcttgggaccccttgctgtttcccgtcgacgtcgggctttttctgacttgtgggttctactattttattcccctgttttccttgtgtgatcgatacgattggttaattaatgatgcagaactagccttttgtttttccgtggtaccaaaattgacctttggtagctatgaacgacatatgtcttggcatatttcttgcggtaaaaaggttaaattttattgtacataggatccgtgccctttacagttcctaaatcctactgggcagatatgttcactcgagctttgctcaatgcgatcattcacactatatgtttctctgcttattttctgaataagctggtaagtagtattatgccacctatgagaaaaaaaaagttattatctgcatgtgtgagaaaataacttattaattatctgcatatgcttccctaattcaaatagcaggcttaatcttttgtcaagccaggaaaaatgctaactgtctcagcattactgcagagtgtgtttgggctgcaactaatttttgaagtgcagtgagtctcagaccttggagataaattactgaagaactggactctaatgtgagtacctgtttaatatctgttctattaaccttcaaggatttctttgtaacaagttttaaattcagtcaacattgcttaagacttaagataattcagtatattttgttataaattatgtgccgctatggctcttttcaatgcgcattcgctgtttggaatgcgagtatgttcaaacttaagaggagcatttggatcttgctgttttaaaaccatattggtgaatatgcagatttctgaattgctctttcaacaaaaataaactataatatacacacattacttcagcaaacatgactttagcagcttagcttttctgaaacttgatgggtgtgtgtttagtatgtttgttgaagtctgatttcagagataaacttagaggtacaattgctcagctgccaagatctgttttgtagaggtacaagtacaatggcagaatttatctcaccatgattcctttttatatggtgaaagaataaaggaacaaaacaaaacaatgataacttgctcagtagcactttgagacaatcttatcctcactttagaactccatgaagtgtgtgatatgagtttctgaccatattttctgaatttggcttatgttgtattttaattttgtagtcttgggaaaccattttaagcctctgaattgttgtagggttgatcactttttctaggccttttgtttttcacctggcgatctggcatcagatcagactaattatttgtctagcccttaattgttgtatatttgaacaatttgcacaattatttgagaaaaaaaggaattacctcaggattgattagtcgcacagaaacccatcctttattttcacatggcctggaaacataaggtgcagatattatcaccttccatgaaaataaagtgtactatttagtactgtatagtgcacaacatatgctatttcacaaactgtttttagattatcataagttgtcatgattccttataagtttctaattatgaaaatgaaagtgttgtaagcatgtctgcttgttttccattgccagacagactccattttggattttattaaccaatgtggtatgtattgtcctggttatttctcaaattgctcctctaccagattggctgaatctggaaaaaaaattatgagattgtttactacatactaagatttaccggtaaattatccaattactctcttgcgtccttgattcctcaactattaattaatcttttgcaccttgtattttccaatattgttattccttcgacaaaataagtttttactcttactacgattcactggtcaaataagggcatctcataattaatgtggtgtcaatgtatatattatacaatacatgtgcgacatatttaattgcaattaggaattttacatgtcaagttgttgaaggaatcaaacagtagatgatatcttgccaaatcggactttgctctaccaattgatataaatataaagtaagcctctattgaaacctatggtgctgaagttaatctttgccaatcagtactatctatctatctattatataatatataattaaatgaatagaaaaaaggagcctccacgttcgctctcatggcctagaaattctcacattaatcggagaaaaagaagaaaaagaaaaagcagagtccatatagaaatacaatttaaaaatagaagaggagactagagtccatatagaaatacaattaggaaataactgaaattcggaattaaaatataaggaatattagaagaggagactagagtccatatagaaatacaattagaaaataactgaaattcggaattaaaatataaggaatattagaagaggagactagagtctatatagaaatacaattaggaaataactgaaattcggaattaaaaataaggaatattagaagtagagtatatagttcatatagaaatacaattaggaaatgaaagaaatttggagttaaaaataaggaatattagaaatagagtatagagtccatatagaaatacaattaagaaaaaaaatacaaattcggaattaaaaaataaggattattagaagtagagtatagagtccatataggaatttaaaactaactaaaatttggaataaacgagtccatatagaaatacaattaggaaataactgaaattcggaaataaaatataaggaatattagaagaggagactagagtccatatagaaatacaattaggaaataactgaaattcggaattaaaatataaggaatattagaagaggagactagagtctatatagaaatacaattaggaaataactgaaattcagaattaaaaataaggaatattagaagtagaatatatagttcatatagaaatacaattaggaaatgaaagaaatttggagttaaaaataaggaatattagaaatagagtatagagtccatatagaaatacaattaagaaaaaaaatagaataactaaaatttgatattaaaagaaatattaaaagacgagtctagagtccatataagaatatatataatttacaaataactaaaatttgatattaaaaataattaataactaacacgtatataaaatataatataaaaattcagaaataaaaataaataatataaaaatatataataatgctagccgcgcaatctgcgcgggccaccatgctagttttctgtatatgtactatggtttctaacaacaggtagcggctttggtgaggtgtgatctgattgctcacatacatgtttatgctttatacttccaagttgcaaaaaaaataaataaatgataccaacgtcctcttgttttatacagcacatcatcacaatttaattggaataatgtgtaattatcttctccatactattgcgttctagatgtgtcagtttgcaccgggctgataatatgactatatgttaacacttgtatttctttaaatttgtactttagcatcggcaaattttcgttgtcgttccatgtagatcttaaaagaagacgttaacgagatgaccaacaattgttatcttgttttacatggtaaaactattaatttgatatatgtatcatatcaaactgttatttgagtttatattcacgatcttatgctaacacaaaaaatattttttttgttaacatgaaattttattgagcttatattcaagtcttatgctaacacaaaaaatatttttttgttaacatgaaattttattgaggttatattcatgtcttatgctaacacaaaaaaaaaattttgccaacatgaaattttaaactttattaaagacaaatagaaatacagtgtagcgtttagcactgacatattactagtaatgactggttattcattgccaatttaaaaccaccattattttcgccgtggggaaatgcagatgggccagtccaattaggcctaatgtatgcatatatgatggttcccatcatcacaaaaatagtccgcaaagagattttaatcatatgaaaatataaaacgaccgacatatatacgagcagtgttgtggaaaacggtgttaacggccgttaatacgtccgataatacggatacggagatcagtccatcacgtcacgccgatccggtcattattagtcggtaacgaacccataaatccgatcattaccgattaaatcgtccgtctccgtctaatcagacgtataatcggcgtgatgacaaaggtcgattccacaatccagctcattagctgtgccctttggattcggatcaagtgcagtcacagtagtgactgcaactttggcagtacctaatcatccaaccatccagcacatgagggatggtccagatttaactgtgtcatgcatcattttagctatttgaacaagcacagaacagcttcagttcagattttgcctgcaatttctctccttttgatctgaattttcttgaactttcagaaaacccaaatattgttaaagaaaagtagacacagacttcatttcattatattgaacttcataatatcttgcacgcataattgacaaaatgagctagagtttaactattttcgctgaaattgggtgtcatgcatccactgagacaaaagctttcaaaatcaactagccatgctactgctagattaacccagtaacaaaagctttcatgatccaaaagtagatcatcatctgcttcccaaatcagcacgatgccttctaagttctattgacctcttcaaatgaacttttgagataagatgacatcttcaacgtcaatagaaccctagggaaaaaaaaataatatccaaattaaaataatttgttagcacatatatttatctttgaagaaactggtcagcataccagtagaagttgggcatagctgctaattgcttcacattcttgatgttcttccacatcagtttgcatgttttcctcctctgccttttcttcaggctgcataacagatttgagaagtggctcaatatatagttctcaatatatatagctgcataacagatttgagtagtcgctcaaatatatttacctttctcttttttgttttttgcagtttatcaatccaatttgttttccgttttgttacacgtttccggctctcctttttcttcagaccagagacatgtgccaagttctgagctaactgggatgttgactgatcattcgactttgcaatgccatcactgtaagtttgttttattttgtcctcaacttttttactaacggcatgaagtgcttcttccacaagcaagtaacattcttcaaagtctgcagctctggaagccaaaggaagaaattgctggtacagatatctgtacctaagagtagtactcagcttggggtcttccactatttgtctgccatgcatatcttgaatagctccacattttgcttctcgagtccaacgcttcaatacatatttttcaggcaacaatttaatgttcactaaatcaagagctttcaaggcatgtctacacagtagacctattctctcaaacaatcgacaactacacgacacggtctgatcaaaagggttggcagtcaacttgtgctcatcttcaagtatgaactgatcatcaagtgagccaattgcaattatgaaatcattacttccatttgatcctttcgtataggcagccatggatttcttttttttcgccgggccggcgaatagccggccgatgtatattaagagtaagaaagggaatgtacaaggtagcgcggtgcgtcaatgcaccaccatttcagacataaaatgaaagctaaaatctcacagaatgagttgctacagagtgacacatggggctaacaagacctgcagctatccaagtctcccattcatcccccatggcggaacagccatggatttctcatattcggcttggaagacttcaaataaagcaggtgtgtaaagcttacttgcctgtaccaaaataggtgtcatcatcataattcttggcaaattctttcttgattcatattcagattgcaattccttctctctcttttcttcaacaacacgctctacacgattaaggaacctgccgatgtcaagatctgatttctaatgacctttcaagttactattcaaactttcacttaattgtgtgcttcgcatccctattgtgaaaacatctgacatgtagcactcagcccacttttcttttaaattgtatatgctatccaaccaagtcactttacgcaccttttgtctcatggcatcaaatacttcttcaaattcttctttttcctcatactcatacatacatgcactgaaatctgctaggatacttgaaccttctgtttgttgaggactcaaatgctttactgcattttgtgatatgtgccaagtacataaaccatgccatgcaccagtgaatacttcagacacagcctttcccattgcaatgtcttggtctgtaaaaatggtttgaggttgcttttgattatgggctgataaaaatgtattgaacatccacttgaatgattcaaatgtctcatcatacatcaaagctgcaccaaaaaccactgtctctctaaaatggttgaagccaacaaacataccaaaaggtctactttctttatttgtcccgaatgtagtgtcgaaggtgatgacatcaccaaagtgagcataatcagcaatcatcctagcatctgcccaaaatatattagctatttgttcttcgcaatccaattgcactgcatagtgaaatgagggattttccacaattttatcttggaagtactttagtaaacttcctgcctcaccataaagtaagtccctttggcgcctagaacgcaaataattcttatgatcacgctgtgtgtaaccaagattagctgacccaccaacatgccgaccaagaaactcatgtgctgctttaggtgtaataccagaatcatacgccacctcaatttcgactgcttggtgtttagaaatgttcctttgtgatggcatcaaacggcttgtttgtggagtttgaagaagatggctgtgttctacagctaagtcatgaaccttgtatgtcattgtttccctgagtaaagtgatgcccatgcgaacttggcaaccagttcgagtatgagttcgattacgttttgctacagcatatttcttttcttctgctctagaaccctgatttgaacaaacaaacctactggatgttactaactgatcaagatcacttttgttagtgtaattctttcgaacatcaaagccaatacgaccaccatatttgacccaaaaatcccaagcttcttcataggaattaaatgtcataccaatttgaggcatccaacagggaggtttagtagatctgttacattacagtatagaggaataaaaagtttgatgcatgaacaaaacaggaagaaagaagacaaaaatcagaagacaaaggatcctatcgcgatctgtacctctccaggttttgctccatggccttctcaacggtcatggctgaacagagaagagaaaaagaagcgtgtgatgtgcagcagtagggggtaaagtatgcttcccatggtagaattggcgccaattctcacctccctctcagacttttccctccaaaacacatctgctggagtcagagagtaggtgaaaagttgggggaaattgagcaaccaatctagaccatcccttgtgtgctggatggttggatgatgggtactgctaaagttgcagtcacagtagtgactgcatctgatccgaatccgtgccgtttactactattgactagaagtttgctcttctgaaattctcacaaggcagcaagatgtaaaatgacaaggaactgacttcctctaaaggttttgaacatgagttccttgattttgatgagtttgctcttccggaattctcataaggcagcaagatgtaaaatgacaaggaactgatttcctctaaagtttgaacacgagttccttgattttgatgatgatcacgttattggagtttgtatttgatgaagctcttcgaggtaaccgatacacatgttatttgggactttgattacggtcatttatgctatgtaacattctcttgataattcatttcatgcattatgaacaaaacccatcactacgtgagaattgagatatacagtaacagctatccattatgaatttatttaaatgtcatatatggttattctatttaaggatatatatagaaggaatatatttagttatatgcatttgtttatcaaaaagggaaaactattatcaactactacctccatcctaaaatataataacttttggctatgatagctaaaaatgtttatatttttggacggagggagaatgtacatatatttttaaaacgttatatttccgccaaattccgattaatcatttggcggtaccctttgtctgatacccgtataccgttttccacaacactgtatacgagtattgtacagtttctgtaaacatcaataatatcctcgaatttcaaaccatcaataatacaatttgttactccatctgttttatattataaattgtttgacttttttttctaatcaaagttctttaggtttgctcaaatttaagtaaaaaaaatagcaacatctataacactaaattagtttcattaaatttaacattgagtatattttaataatatgtttgttttgtattgtattgtaaatgttaccatatttttctacaaactcggtcaaacttttttcggtttgactaagaaaaaaatcaaacgacttaaaatataaaagaaatggagtattatcattccttcaatccaacaacaaacggagcatcccattacgcggctctcaaaaaagtgagatgcaacttatcaaagtcgatgcaacctcgcgtcaagtgtcaagttttgtcggtgataaataaaaacctcgggaagaatgatggcaatgcgccgagagtaattgtaattatctatgagataaattatagggaccctgctatgagataaattatagggaccctgggtatacatatttatacacacaaaccgataagagttctatttagacatgacacaaacatttgtaaagataaaagaaaaaaacattcataaatacaaaacttatctgccatgtcgtggtcttcgtaactccttttcaaactcgatctctgttgtataaatcttgtcatatttcgttaacgaaatttacttaaatattcaaaccaaattttagcattaacagttctctatgcatgccacattttgccacggccttgtttagatccaccctaaaatttttcaccctatcacatcgaacgtttgaacacctgcataaagtattaaatgtaggctacaaaaataattaattgcatagattgcgactaatttacaagatgaatcttttaaatctaattgctttatgatttgataatgttgtgctacagtaaacattgctaataatgattaattagacttaataaattgtctcgcagtttatacggcaaaaattcagtctaaagtaattcggcgggcgatgggccccacagtacaacatctcgatttgctccgatgagataactgtcccgtatggccgtatatatctgtaaattgcccaacaaaaaaaaggaagaaaagaaagaaaagcttctccccgagctccgagctcccgtgccgcccgctagagagatctcgcccgccgtccccgagatcccgccccgccgtcgagatcacgcgccaccgaggagaggagattcggcggtccgcctatcgcgtgaggacgagcgagactgcatactccagaaggtgcgtgatttcttccagatcgaagatactctttgtcaaaagaaaaaaaaaatatagaaaagaaaaattttgaatagaagaatatcaatagagacgatgatgcggcggtttgtgaatttggtggtggacaccgccggcgtcggcgccgacgcgacggcgtgcaagctgtaccgcgtcgctgcatcggccctcttttcatctccagcacgtcgtcaagcagcagccaaagaactagatccagatgacgtggacgacgccggcggcctgcctcctccggccatcaccttccacccctcctcattgtccggccctggcaacgtcgatttcttgcacctccccggcgacgacagccttctcgccctcgacgtcgacggccgcggtctgctctatagtgccgcctccgccgccgtccgctacatgcccgacccgtgcaagcccaagatggagcccatctccttcaccgccggcgatagcgtcctctacgtcatcgagagggtgcccttctccggtaaccccggctgcttcgaggctctcacctacggcctactcccccacgacttggacaggatgggctggtactggcggtctcttccgccgcctcctttcgccaaggttggctacgacggcgacttccggcgccaccgccagcgccgagagtacgacatcaccgcctccgcggtggtgaacgagacggagctgtgggtgacggcgcacggagctgggaccttttctttcgacacgcaggttggggagtggagggggcgcggcgaatggcggatgccgttcaaggggcggggcgagtatgtggaggagcacggcaaatggtttgggctctcctccacgccgctgcaggggctgcacctctgttcctgcgatctctcccatctctgctgttcctacgatgtgccggtggtcaggcgctggttggatggcctagaccgtctgccggcggcggcgccgcccaagcaatcctttctgatggaagcctacgccgtgcacctcggctccggtaggttctgcatcgccaggttcatggaagaggaggaggaggaggaagttgaggaggagaaggacaacatctcagttcatccattcttccacgtcgccggcgtcaacaacaacaagaagaagaacgacaggttcttgctgctcaccggcgttgatgtggtggcctgtgacgacgccgtcctcgtgcacaagtctatacgctacccattccaaaacggcgatttcgttcgtggttactctcgactcttttaatttcatctaatttacttattatacctctctccggtaaaactagctatattttgttttgtgacggagtgaatatatcatttttatatatatatcccttttcctttcgattgcaataatagtaataatgctgtatatgaatggtactttttgggtactccattcgtttatattaagaggctgtcctcttatagtcttattatacatgctcattcttgactctggaaaaagaaactttttttttgcaagttagaccgaaggattgaccgaccaaattttattaagagagaaaaggggttataattgtttacaagatcgacattaagctgtcaaggcaaagtgacaaccaaaccagtcatcagccgaaaagaaaaagtgaaaacagaacagaggccaactaatcacattgccaaaaaaaaaattcctgcttccttctaatgatcatatgatgaattccacttacagtactacaatttgactgcagctattttgacaattaagaaagcagagtgttgtaaaatttgggcataataagatgatatatcttccttagcagttagcacagcaacaacatcccaaaggtgaaatgtttttgaccggagtgatgcaactgcaacatatattccaaatagattctctctgcaaaattaaattattcaactagttccatctcattgcacgcctgcctgatgtgttgttcattgtatctcaaaaatcatatttgcagcagagcagaaaaaaaaaatcatttgcagcagagcagaaaaaaagcatcagtaatccatgattattattattaattgctcacatcacatccggtggctcatggacgcgagcaaatgagtaataatgcaatatatatagatggacgagatgatcatggcatgtcggcagcgtgatcgtgatcgatggcggcgacggggaggtgagtggaggaggagggcggcggctggtcgtcgtcctcgtggcagcagaggcagagcatgccgcggaggaggttgcacttgccgccaggaagccgagctgcttgcagcaggcgttgcacttgcctctaaaatccgattttatccccttgaatacgacgcgaatttggattcgttttcgagtttatctctccgccaaaccctaggttttcccggcgtgattccttgcgttccaagcccgatctctctctcccgtggctataaatagagtccccttcctctcctctttcgtttgcctcaagtcccagccatcgctgttgcctgtagcgccctacccgcggtcgccttctgtctccgccaccggcagccgttccagccgacgcccttctgcgctgccacttccctcggctccgaaaggctgatctccatcccggccgctggttaccttgcgccgaaactcgccggaagcccttcgtcactttgaatccgatctactccgcctccggccgaacaccaccgttgtttccgtcaacgccaagcttcgccgttgccttcctcggcatcacagcgccaagacgaagcccgtccacacctccgttgctcccatcgtcacctacggtcgccggccgttttccgtcatcgattctcgtcaccgtcaccaccggtgagttcgtctcgtcgtcctctccgcgttggtgctctcggatagcccggctgagcctcctaacaccggcgacctcgcggaccagtgcatggtcggctgtgatgtcatcgatgatgtcattatctatttaataaatcgtgaattctttgctgtataaggctaaaatcagtttaattaatcttgtaaaattcataactaattcatatgaagtcggaattaagtggttcaagtctctaaattcatctaaaatcatgatctacatgtttgtttactttatatgtactgtttatttggtttttattagtttttttttctcgttttgcgtgttagctcgtcgttttcatcgttgcgaaggttcgcgagtgcgtcggaagtgttcaagaagactaattgaagaccgattattgtaaggcaagtcacacaaatcccaaatgaccctttgagcatgttgaacccatttaaagctattgttttattttaaaatatgcattattttcgaatgtcattgggtggtgagtctttctcatttaattatggccgaagatgactttattttcctatggtaataaattgattagcttaaaccttatatattggtttggttcagctagatgttggacataattgcttagccatgcttagaaacattagcacatgattgggataactaatgttacactatcacttatgattatatttaatggtacccatgatggtcaatcgtgattggttaattaattacttgccaactaaaatttgattaatggtgggttgtgagcacatggttttgatggtcgtgctcatgacaattaaggaccggttcgtgagctactgttgtgagacattaaccatgccaaccataagccagcgtgggcaacggctttaccttttgtatagcatggttcatcacggggtgccagactgagaagcggcgagaagttcgtgggggtcgctggggagtccatgccttgttttataagggggtgattatgatccaggaacggtgcactgtggtgagttgtgttgtgcagaggatattgtcacagcctctattcgggtactttccagtatcgcgacgcatggtagacatgatgttgaggctttgtcttgtgggtacagtggtacacctctggccagagtaaaactattcgaatagccgtgcccgcggtcatgggcgggttgagcaatgtttcttgtgattagtctcacacctctcacaataattattggtgctataactggtaataatttgcttagctcctggtttggagttagatctgtacagccgggtatggttgtttaggatggtcgggcctgagcagcatgggtgtgctgttcagtgttgattaaaattgatgaataattactctactgttttacttctaaatgtttgctaaatgctgcttttgcaaatgagcctatattatgccatcctttggtatccttgtgcacttgcatatttgctgtgtggcttgttgagtatgtcatatgctcaccttgcaataatcaatcaacctaagttgaagaaaaatgatccagaaggagaagacgtttggcttataccccagttgagctgcctgtgggagtggagccggagcttcgctagatcgttattccgctgttgttttttttttcttttgtaagtatgtaacgttattattatgatggatttgtatattaaattatcagtttgtgtacctcggctgattcctggacgaggattttttgcacaaattagttcagaaattactagtgaatttctgggcgtgacagtgatccacatgtcaaggccaacgcgctgctgcaagctcatttttcaaggcgcactatcttggcagccgaccagcgggagatactcctttctgctcatagattgctccaggcaatggttgatgttatctccagcaatggatggcttacgcttgctcttaatgcaatggagctgagtcaaatggtgacacaaggcatatgggatcgtgattctgttcttttacagcttccacatttcaccaaggagttggcgcggagatgccaggagaatgaagggaggcccattgagagcatcttcgatctggctgagatgagcatcgatgagatgcgggatctgttgcagctatcaaaccctcagctacaggatatcattgaattcttcaagcgtttccccaatgtcgacatggcttacgaagttggcgagggtggatgatatcagggctggtgacaatgtaactgtacaggtgaccctggagcgtgacatgacgaacttgccttccgaggtggggccagttcatgcccccaggtacccaaagcccaaggaagaaggctggtggctggtaattggtgatagctctaccaatcagggttgcacttcagaagagggctcgagtgaagcttgagttcaccgctgcttcagaagctgggagaaaggagtacatgatctacctgatgtccgattattatctgggccgtgatcaggagtacgagttcaccgtcgatgtcatggatgctggaggggattgatcccaaggcaggaaagaggatgatagctttgcccagcccccaggttgtgtatgaaactgggtggttgcttgtacgctcgtagcaattcctagaagatatcaactttaaacactaactaattaatatcctatccacacttgtatttgtttgttacttgcttctatcttgttcattttctcattgtaactgatgcgcacctgtgctgctacttgtgctcagccttggggatctttattagcctatggctgcatgtgcttcttgtgatcatccttcatgttgtgtttttgtcttcctgtttcatctaatcaagtcattcatgtcctgattctatctacatcatttgatcatgcttggtcgtattatttgttgtatctcatatgttcatatagattgctccagccaatgcttgatataattattgttgcgcaactgcttgcaacgggtttggcttgttctggaaacaagaagtgatgtactaggagtaggacgtgctgtgcagtgtacagtacaccgtcaatccctaccctgttgctcacatggaccttttggattctcgactgcatgcatacatacaaaactgtcactcttaactaattgttgtttgtgtagggtatggatgtcaaactcaactattgttgtttgcgtagggtatggaggatatagtatataactggatttttaaaaataagatcgaacgtggcaattccattaacaaccaaacaaaggtgaagaggtcatgggctaactaactgtgtgaatagtcaacgtagagacttatcgaaaccaccaaagctaagccagagaataaaaaagctcaacgcgcactcttgttttgtttgctttgcgtacgtaagaaaggaaaaaaaaaaaccttgacaaaaacacatgatggataagactagatggaataatattatattattgcctcaagtataaataaaagtcattacggactttttactagtactgctattccaaaataatatccacaaggtaaagttagaatatgaggagagttagtacttagtcttggaggaaattaagctaagcaagggtaccagcagcaacgccaagccaacaatggaggagacctggctcttcctcctcttctccatctcgctcgtcgccgtcttgctcgccaccgctcgccgccgccgctctagcagcatcaaggcgcgcctccctcccgggccgtcgccgctgctcttcctcgccaagttcctccgcctccgccgctccatcttcgacctcggcccgctcctccgcgacctgcacgcgcgccacggccccgtcatctccatccgcctcttcggcaccaccctcgtcttcgtcgccgaccgccgcctcgcccaccgcgcactcgtccagggcggctccaccttcgccgaccgcccgccgctcccggagctcggccgcctcttcacctccgacacccgcgacatcaactcctccccgtacggcccctactggcgcctcgtccgccgcaacctcgcctccgaggcgctcagcccggcccgcgtcgcgctcttcgcgccggcgaggcggcgcgcgcgcgacgtgctcgtccgcggcctccgcgaccgcggcggcgacggctcccggcccgtcgagctgaggccgttgctccggcgcgccatgttcgagctgctcctgtacatgagcctcggcgccaggcttgccccggaggcgctcgaggaggtcgagcggctggagctatggatgctccgcgccttcaccagcttccccgtcttctccttcttcccggcgatcaccaagaggctcttccgcaaccagtgggccgctcacgtggccgttcgccggagggtgggcgagatatacgtcccgctgatcaacgccaggcgcgccggagacggagacggcgacgacccaccctgctacacggactccctcctccagctgcgcgtggccgaggaaggcgaccggccgctgacggacgacgagatcatcgcgctctgctccgagttcctcaacgccggcaccgacacgacggtgacgttggtggagtggatcatggccgagcttgtgaaccgccccgacatccaggccaaggtccacgacgaggtgagacgccggccggagctaaccgaggcagacctgcaggcgatgccgtacctcaaggccgtggtgctggagggcctccggctgcacccgccggcgcagttcctgctgccgcacggcgtgcagagcgacgcggaggtcggcggctacgtggtgcccaggggcgcggagctgaacgtgtgggtggcggagttggggcgggacgaggtggtgtggacggcggcgagggagttcatgccggagaggttcatggacggcggcgaggtggaggtggacgtgacggggagcagggagataacgatgatgccgttcggcgtggggcggcggatgtgccccgggtacacggtggggacgctgcacgcggagtacctggtggggagcctggtgagggagctggagtggctgccggagacggagggggaggcggcggacatggcggaggagctggatttcaccaccgtcatgaagcacccgctccgtgctcgcgtcctcccaaggccctcctccctctactaatcgtgcttccatggatgaatcatgcatgaagaataacatgccaatcgatagttttgtgatggttgtaaaagcatgtgtagttttatgatacgtactttatgtttaaatatgtgtaatactgttgatttttgaaataatatttcatcattgtcttatttaaatatttagggtaaatataaaaaaacataaatcatgtttaaattatagggtacacataagttgtaataatatgaatgacacatgcatgttttttgttttgtaaaatgaatggtgaatcgtcatatgagtcaaccgcagcgagacgtacgcggtgatttcgtgaatctcaagatataccagttgagtctttgatggtgcttataaagaaagagtgtgcatatgtgtatccatcttatgtttgtactatcattcaaaaaaacaataaccatgaaaaactcaattcatcacccaaggggatatccccttattttcgcatgtcacttaaaaagtcatcaaaaaatatgaaaaaaaatagtaagataaatcaatatgtaatatgtcacttcacagacatacaaatacaaattcaacttatacaagtagaaacaaaaataacaaatttgtgaatttttgtttcgaattgtataagtcaaatttaaaatcgcaggttgcgaaaagatatatcatacattgatatatcatatattgatatatcctgatatgttttttataattttttttgaacgacatgtagaaaacgagaaaatattccctcgagggacaaaattccacttcctatgatatactaacaatatacgtttgaaaacggaacggtgaaataattcattgtagaggaaaatatatagatgaaataattgcctgcggaaaaatactttgggctttgatgggcccgtggtttttcctcgttcagtcggttgtgttttatcgtattttcccctgaattcttgttgtgtaaaggaaaaaaacaaacaaaaaaaaaccattgtagaagcagatgcggcggtttgtgaatttggtggtggacaacgccggcggcggcggcgcgacggcgtacaagctgtaccgtgtcgctgcatcggccctcttttcatctccaccacgtcggcaagcagccaacgtactcgatccggatgacgtggaggacgccgccggcggcctgcctcctccggccatcaccttccacccctcctcattgtccgtcggccctggcaacgtcgatttcttgcgcctctccggcgacgacagccttctcgccctcgacgtcgacggccgcggtctgctctacaacgccgcctccgccgccgtccgctacatgcccgacccgtgcaagcccaagatggagccaatctccttcaccaccgccggcgatagctgcctctacgtcatcgagagggtgcccttctccggtaaccccggctgcttcgaggctctcacctacggcctactccccgacgacgacgactcactgtcctccaggatgggctggtactggcggtctcttccgccgcctcctttcgccaaggttggctacgacggcgacatccaccgccaccgccatcgccgagagtacgacatcaccgcctccgcggtggtgaacgagacggagctgtgggtgacggcgcacggagccgggaccttctcgttcgacacgcaggctggggagtggagggcgcgcggcgaatggcggatgccgttcatggggcgcggcgagtacgtggaggagcacggcggatggttcgggctctcctccacgccggtgaaggggctgcacctctgctcctgccgtctctgttcctacgatgtgccggtggtcaggcgctggttggatggcctagaccggctgccggcggcggcgccgcccaagcgatcgtttctgatggaggcctacgccgtgcacctcggctccggtaggttctgcatcgccaggttcatggaagaggaggaggaggagaaggacaacatctcacttcatccattcttccgcgtcgccggcgaaaaaagcaagaacgacaggttcttgcttctcaccggcgttgatgtggtgggcagtgacggcgccgccgtcgtcgtgcacaaatctatacgctacaaattccaaaacggcgatttcgtttgtggttactctcgactcttttaatttacttacacctctctccggtaaaactacccagtatatttcccttttccttttcatttcgagcgagattacaataataatcttcttcgtttgtaatagagtaataatcgaaatgctgtatatgctccattcggcctttcgtttatattaccaacagacaaggaattcacagccttattaagaggctgtcctcttattatatatgctccttcattctggaaaatgaaaacttttttctttgctagttcgaccgaaggattgaccgaccaaattttattaagagagaaaaggggttataattgtttaacattaagctgtcaaggcaaagtggcaaccaaaccagtcatcacccgaaaagaaaaagggaaaacagaacaggggccaactaatcacatttcccaaaaaaaaaaatcttgcttccttctaatgatatgatgatttcctcttactgtactacaatttggctgatgctattttaatactacttccatattttaatgtatgatgctgttgactttttttcaatgtttgatcattcgtcttattaaaaaaattgtgtaaatatcatttattttattgtgacttgattcgttatcaaatgttctttaaacatgacataagtattttcatatttacccaaaaattttaaataaaacgaataatcaaacgttagtcaaaaagacaacggcgtcatacattaaaatacggagggagtaacaattaaggcaaggtgttgtaaaatttgggcataataagatgatatatcttccttagcagttagcacagcaacaacatcccaaaggtgaaatgtttttgaccggagtgatgcacctgcaacagatattccaaatagattctctctacaaaattaaatttattcaactagttccctctcattgcgcgcctgcctgatgtgttgttcattgtatctcgaaaatcatagttgcagcagagcagaaaaaaaaaatcatttgcagcatcagtaatccgtggttattattattaattgctcacatcacatccggtggctcatgatccagccaacatatatatgtactccaactataaatgggagtagatgagattggtacctgcagtgcaggtatgtgtgtgtgtatatagacgcgagcaaatgagcaatatatatagatggatgaatgatgatcatggcatgccggcggcgtgatcgtgatcgtgatcgtgatcgatggcgaggtgagtggaggaggaggaggagggcggcggctggtcgtcgtcctcgtggcagcagaggcagagcatgccgcccaggaagccgagctgcttgcagcaggcgttgcacttgcctctcttgtagcacaccccctagcacttgtagattgggtagttgcacgtctccgcctccgccgcccactgcatcatcgcaccatctgcatttccatttctaaatcccatcttatttcttttctttcttttcatttttctagctagctatagctgtttgcatttgcaataataatagtattttccatcttcttcttttattgctgcatgtatatgcattcatgctaacttgataacttaaactaatagtcaagcattgaacaggctaactgaaactaatagttaagcactgaggaggaggagggaggagctagataattagtaattaagatgactcacgcgaggcgatgaggacggtcactaggaacagcgccaccaccggcttcatcttcacagtcatcctactcgtacgcctcaatgctcactcgctatctagctgcctggcctcttatatactactcgttgcaagcctgcagctagcttttgacatggcagcccataaaattatgctccagagttaattaacatcgtccttcccattgtaattacaataataggcttaagtaattgtttttcacttttttcttcttttcttcccaaacccccttcttttctttgttttgccttttgtgtaaattttattcctcttaatacaaaagtgcgcaatccttttacgtattccaaaaaaaaaattaaatcgtcttgctgggggtagctagctgtcgtctcctcgtgcttgcttgcaagttactagtattaggagtttctgattatctagcattagcctgctttaagtaatgcgatcaatagtattgtgcgactactatcttaattgagatcgagacaagcatccagttcgttcatcattgatctcttgcaaatcgatctggtacatgtctatgtcattgctcttaatctgcctcaatgactcaatatggctagctcttaatctcagctcgattatgtcatcgaacaattcaagcacttatcttgccatatataccgagacctgatatgtgatagatggacaaattttgaatgtcttgttcgatgcacaacatttggagatgatgcgtgcgatttcgaagctgggacagaatttgtgaagaccaagaaaatgacaactcaatcacaacaaaccaaccaccgcccaggcagatcgcattcagagcatgagtaaataaatttcaagtctccctgttcttttcagaagaatacatgtccgaatgtggtataattaagcctgctaatgggttaaaatccaggccgcatccaccccaatccacctcctctgcaaccactccaccaaaccagtccgctccactttctcatctctaacatccaaattaatccaacccgcaggatgtttgaaaccaacccaacccaaaccattgtagctaagtggattgaatccatttcaaacccatggactgagaccacatgaaaccgccgccgccgccggcggaggaacattgacgcaaacccaacgaacgcatgcaacggtagtagcttgtcgtcgtgctcgatccgtggccgcgcgagcccgccatgtccagagactgcgtgatgagtgagcagctggcctgttcgacgcacacgacaatggctgcccgccgccgtgctcgtggccgcccgccgccgtgctcgcatccatggccgacgcgcacaacaacggcgggacggagctacttcacgacacggaggtgcgcggcgagcttcttctcccgccggtaaggaatagtagccgatgaacctgacctccattgtcgccaagctgagctcgaagagacagccatggtacagccggaagagcaccgcgccgctgctcttggcgaagcactcgagccggacctcctcgtccactgtcaatggcggcggcatctcctccggcgcggctgactccaccaccctcgccaggtccaccgcggcgcggcacgtccacctcgccgcgccgtcgtccttcgacaacgacgacgacagcggccgcctcgctgcgctgtcgtccttcgacgacaacgatcgatatctcgtggcgcctcgccacggccaggccgagcgtcccgtccggctacgacacgaggagcatctccacgctcggcttggcgacgcgttcgaggttcgagggatgagggagtttgatctgcgccgacggcgatgacctgtcgaggcggagcgcgggggcatagcagccgagctccgcggcgttcgagagcacagccagcagcgcagcgtcgtcgctgtctccatggatcgaacccactctagcatccatggatttaatccaagttggacccgaaattttatacccaaaaccaaaccaacccaaaccgttctcacatgcagtccaaaccgccccagcccattagtctcgtcaaaccatttccatccaaccaaagccagcccaaacttgaaaccaatccattttacccacttcaacccaacccattagcaggcttaggtataattaaggggagctccatgcttttcagtgttcttttcaaaagagtacatgtccgaatgtggtataattaaggggagctccgtgcttttcagagtttcagacgaaactgaacacctaaaactgcccaatgtgacggcaacagccaaaatattctgagatttagaggtagcgaccaccggccacatcaacgaggctctcgtctccatgggcaacttactttgttagttcttgctttggaaaaaatataaaattagcaagtggtattttgagaagaaatcgaaatgctaatggcacaggtcaagctagtacttgctgacaatagttgcaatacttctgtcgctatacatagccacgggctcacatactcgtatataacaacaggacttgatcaatttatttcatcatttttttattaccagtattgtccttggagcagcaataacagccagtgtcaacgggagaaaaatattacatcatcaaagccgagtttatgaccctacaaaagttgaattcgctttgcgctctcagtacaaactctccgaatgacatagtttcagctacactcccttggggagccccgtgaccgaatcgatcaatgctaggctttcgtcagtgacaacttttgggccagctccaagcctgctacagatgaagtagctcacatctcccttgaatttttggctcggcatcttcgtctcggcaggagctgggagggcctccacatcttctatcgatttcagtccagcatcgcttagaatcgacttgtcgccaaccatatagctgcatcattttgtttgtcaaatagattcttggatagattggtatgtcatactcatgacaatattaacgcacctgctgagatcattatcttgaggagggaaataatacaagagcttctgaaggagaatggttgcatttttgcggtttggtgcgattaggacagcattgggcccagcatcgaaggtgtaagcaacctgccatcaaaaaaagctcttgtagaatgagaagagttgatagcacaactgtctactagttccatactcgtatagaagaaaaatgcatactagaaaacataaacagtacaaataagtcctagacaaggattttcaatgaaagaacttccttatcacgaagccatattatgtacagccagattatcttgtgcattccttgggcttttgtttccatcataacaaagtaatgaattggtatatatatcatatccaatatatgtactaattaaatatgatcctccatagcattaacaccaatggactgatgacaattagaaaagggtgaaaagggtgtggaaaatgagcttagagtcaaacatttgctatttctacaaagatcattgagcaatgtgagtcatacacgttttggctagggcagtacaaattgtttgtgccaccatatgagcttatggtccattatacccttgttatgaactcagcatgtaaccaaccctatttcatggtatggacatccataaaccgcaacagtttattgagaaaaaaaaaggagaaaagaagagtatacctgtggggttccttctgactggttccacttctccacaaggctaattatcctgtgattaattcagacagcaatgtcaaagctgatgtgtcattagcaacagaagcccaaaacagagcactgataaataaaagatcacctgtgtgatgtatcgttcatatagaagatgggagggctcgtgtccaaacatacagcatgaaattggttgctatctgcacaagttaacctggcaaaggactcaaaattacgagacttgatagcctcttccattttcaacacccgttctggaactacagtctgcaatacaagaacaagcaattcaaaggacataagaaaaaagaagtaacagctaaattgacagaaaagctcaattaatattttactgcagtataaaactgcccaactctacttcctctatgaatcatgagaaatttaaacggtcaaaacagtcacctgggccctatattgcaaaaggggacttgtttcaacactgtctcgcatcccactagtgctacttgtttccttctgctttgaactgacctattttacacagggaagattcaattattttgaaggtgtcagacatgacataattagtaaatgttgttaaaaagcatgataaaatactagagttaccatccgattcaaatttactggttgtgaagccacaacaccaggagacaggagtagtaatgctacaacagattatacgcagtaagaggtatgttaaatgcacatcacataccaccgctatgataataacaagatcattccagtgtgcctcatcagcaagttgtacagctatgctgtcgcttccatcattattctgtaagtgtagtataaaacttatcattactcgctagaaaggatatgcgataaatttcaccaaggctgttcctctttcatagcatcagataactcacttttcccatacaccatttcacgaatcccccatatatactgcggcatgcacttccagacccttgcctgcatttgaatttgtcagttataccagaaggagaaaaggagcagttccatagcatattgatcagtacagatgagtacaagcaacaaaataccttgctatggaagaaagttcaccatgatcttctttcacattcattagctttccaagggtgaaaactacaaaaagcaatcaggtgataaatatgtgcttccattcaccctatttagatttttttaaaaataaaaaaatcaccaataagatgattgaaccattgtctgattttgggtggcattatcaaatttgaaaatatttgagacaaaataagtagggaaatatcattgatatcagaagtaagagactttaccaaaacaagccaagccagcagccgaagaggccaaaccagcagcagtggggaagttgttgaacgatgctatgtgtacatgtagcttcccccagtcctctttcttgatcctgatccccttcttctcatcctcgacatcttgagcacgcttccggatctccctcaggcagctctgaaacctccctcctgacaaggagatctcctgcacagttcaaaacgaaaagccagcttaagacatagtataccattaaaaaaagtaaaggatcatcccttaaggtctagcgtggtgatagatcacagacttttaagtttcacacagtgtaaatctaggatttgacagtttgtatttagataggatcagtgactgtaacagaaacaaagctagaaacacatactagatgctagtgcatatgaaatcaggaatgtgattcttttttaaaataataaaagaatggaaattagagctccactgcctgtagaatttgtagatgggaagaacactgaaacagattgccattattcagatctaagcagcagttgtcatcagtttgatgaacagagtcccattattcagaggggacaacaaagcataaacatcaatgcgaagcaacaacaaaaaaaaaaagtaggaagcagcagagcagagagatggaagagtagagaggaggaggaccttgccgttgagccacatgcggtcggaggggaaggaagggctgacggcgacggtggtggtggcggagaggtggtcggggtcgagggtgacgctgatgctgtcgttgacggggaggatgagcgcctcgtccctcttcccccagtacttgatgacggcgatgttggtgggagatcggccggtggccatgagcacccactgcccctcctccgccgccgccatggaaggagaccgatctgctgcggcccagaagagcgagcaacgcgcgtcagggattcggactagcaacctcaactagatacagtcccaggcagcttaccggaacggaagcaacgacggggagcgggagcagtcgccggcggcggcggaggcgggagggcgggagatcggagacggcggggcggagacaccgaggaagacgagagtgagaccgaatcttgatgctaaatccaacggctgcgatttatctatcccctccttagtatatgttttttcacaaaaacccctcactcgggtcgctatcgcagccagcatcttttgtttttctttcctttttgcacaaagacccctctgaataataataaataataatatgacggctcggttacttcctcctccaagttcaagtccaagctagcgatcgccggcgatcaagccggcgaccatgcttccccggccaccgcgccgcgccgccacccccgtctatcatgatcatatcttctgtgaatggcttttcataagctgttgatccttcctgcagcatctaccaagtgaaatctgcatacacaatttgagatcaacatcgataagatgagatgagatgagatgcacaagtgaaatctgaatgcacaagttgagatcaacatcgataagatgagatgagatgagatacacaagtgagatctgcatgcacaagttgagatgcaggattcctattggattttgaagagagacagataatttacagggggtggattgactgattctcctcatacttcctggcttgaaaacgggaaagcttggagctttcggctctgatttgatccggtcagttctactgcttgacaaactgtggagaatctattccttccagccatatacatccaatttcttgacaatctggaccggacgatccatcagaaaaaattaattcagaatgcaatttggagtgcagcagcttttttggctggcacatcggtgtagtgcatctatatgtgaccttgcaactgtgcaagggtcaaacagcacggccacaagtacttttgttgatgaatcagttattaccacatgacttcgtcaatgctagcccagcaagtgatggaaggaaagatggatgaatgataaggctccagggctcataaatacctgagactgaacattgctcattacagtcttcagatgtaaagcagtgttgttcttcttctctattctgctcaaggcagctgcatccagatcactctactgatgaggaccacgaggatcatctgctggaagaaaacaaagatttgcacattgactatgcactgctgtaattgtatcaatatcgaattctaaatgctgaatgaacagttgctgatatgatcctgtcaggaagcaaaaacaagatactaattgccctcagagacatatatagtggacgtgcactagtgttttcataccacaaatcctttggccactggagtcaacttttgatcatctggataacataagtaaagaagattctatttcctacaagagcagcagcagctaagcacacacatccttttttcctttccagaaaggatataatgatggattagaatattcagacagtagtacagcttcaggattgctgcaagattagtcataaaataatactagtagtagtatcatcttactaccatccatggggttcaggacaaattagttgaactaggagtacatacagctgatacagttgtgcagtgaagcggtgacaattgtcaattgacaaagtgccaaggtctcacagctaatccccagctcagctgcctgctgcccccttgatggtctgcacatctctgcccattgaaatctttggtcagcaccatcctctggctgtcaagagttaggtgcagcccgatttgagtcaaccctttgattgcatcaagcaaaggtatactagtatcaatgcccctttatccaattctgcaaagtttcttccccaacttgctgtgtcctgaacaactggatttcattcggtcatcagcttacacggctggttgaatggttggtcaattgcaagctgttcatctgagagactgaaacaaaaccatttggatttgcggttgcagtcttgcagagatcacagaatgttgatctttcaggattagaaacaaaatgcagcacaaatatgatatgagtatatattctgatgaccagaatcagcacacacggttggttgaatgattggtcaattgcaagctgatcatctgggagactgaaacaaactgtttagattgcagttgcagtcctgcagaaatcaaagcaagtgcagcacagtatcaggcttcatatgacatgaatatatgatgacgatcagagattcagaatcgaaatcctcgtctgaaatttacaatttctgcattccttcactagtttcaacaacatttttttttgcttgctcttcagcacaaagattgaacagcaatacacactaacccaacaaaaagttagtttttacaagcaaatgtacacttcacaggatcacaaaggcagcagcagcagcacataaaaatcaaagaatggtagagtacagaaaggggaaaaagagagatttttttttatcatcctcctaattaaatcaaatcaacagccaactaccatcgtgggtttccctccacggaaggaaacctcagaaggaatggtggtgaggcggcgcgccggagccggacgccgccgccgccgcggcgctggcggtggcgctgctgttgctgcgcgtgctgtgctccatgatgcgcaccacctcgccgcggctggccaccacgcggtggaacacggcgcgcacctgccgctccagcggcgcgaggccctcctccagagcccggcacgcggcggcgagcgcctcggcgcgctcgaccacgtcacgcgcgcgctcatcggtcgcgcccatcaccagctgctcttcctcctcctcctccgcgacttcctcgaggagactgctcagctcccgcgcggcgcgctccacagcctgcatctcggcgaggagccccgtcgccgccgccgaccccgacgacgaccccttcttgtcctttttcctccactcgtcggcgatccgctcctggagagcacacatcggggccgcccactgcacctgcttcggcggcgccaccggggggttggtggccgcggacgaccggtcctggcacggcaccgccgcgaccagcgcccacatggagaagacgagcaccgagctcatggtgtagagcgccagccccagcccgcaacccgcgccgggggaggcggacgtgggcgactgcggcggcggcgcgaggtgcgccgccatggcgtggacgtggcggccggaggaccagttcctggagacgctgaaggacagcgcgcgcgcggggccggccctgcacgagggggacggcgcggcggcgagcttggcggcgtcggggaacagcctggagatggcccggcgcgcgcggccgaagtgggcgcggtgcagcggcggggcgaggaggcacgaggcggcggtgagcgcggcgcggtgcgagccccggagcgaggcgagcgtgagggagacggcgttgagtatgtcgagcgtcttgacggtgcggtcgaggaggtcagcggcgaggcggtcggcgggcggcctggagagcgcggcggcgacggggccgatgccgagaacctcgcggaaggcgtcgtcggaggagagcaccgcgtcgagcagcttggagaggaaggcgagggagaggagcggcgggtgatgggagagggcggcgaggcggtcggcgacgtgggcctggagggcgtggaggacctgcagctcgtcgtcctgcgcggggtcaaaggaggcgacggcggtggcgctgcggcggaagctgaggaggccgaggaagcccatcccggtgggcggcggcggcgggtcggcggcggccatcgtcgtcggggggcttcagcttcggggctgtgcgtgtgcgtgggcttgggcttgggctttgggcctgggccttggtggtggtcgtcgagggaagcaatggtggtgggtggagcgggcggtggtggcgcgcgccctcatatacgcacgcgcgccggctccgaccacgtctcgcgcgcaagagctacctttgactgcaaggtggggccatgggtgtatagggcccatgtgtcagtgggggtggagaggaagaggaggtggtgcgctgcgcggagaggaatgggaaaggtggactggttcttggagctgacttggttgcctcccactaactgtgtggacctggtgtacagcacccagtaatccctttttttttttcattcgctcccattttctaaatactattttgttgcgtattagttattttcacgtatattctgtgtgagtttttttccctggctagctgcctgagattaaggtgttttttttcagagatgttttcgcttcttatcagcgcagtactacctccgtcacaaaatacttatcgtttagagtttttttgtaacgtttaattatttatcttattcaaaagattatggaattattatttattttgtttgtgacttgctttattaacagaagtacgacttatttttttatatttacgcaacttttgaaataagataaataatcaaacgtttgcaactgtattaatagaaatgtgtaatgtgtagtactagtagtatttgttgtttttatttagttgcagctggcagcttaggacaaattgtaccttgaaggcttgatggctggcagggaatgaaaagtcatgaggtcttaagtccctatcatatcggatgtttgaaaattaattataaatattaaatgtagactattaataaaacccatccataatcttggactaatttgcgagacgaatctaatgagcctaattaatccatgattagcctatgtgatgctaccgtaaacattctctaattatagattaattaggcttaaaaaatttgtctcgtgaattagcttttatttatgtaattagttttgtaagtagtctatatttaatactctaaattagtgtctaaagacatggactaaagttaagtccctggatctaaacaccacctaaaggcttaaagcatgacagggcagggcaggccagatggagttaaattaaagccaaaacagatacggttgtgatagaatcatactagtagaaattagaagaggacgcatgcaaagcttgtatcatgtgacagtgagaagccaaacgcataggacacacaccaccaacatagcacaggtatgtaaacacaacgacaaatgctccattttagtaaggcgagcaggatcttaattcatcttacaaagaaaaaaaaaggaataagacagtgtcatgccactacaaaacactagtactaaaataaaacattagcaccaatcatcttctctctcttttgatctcttctctgaagtagtactagtagtacttcctccgtcctaaaatgaagctatttttgaggttggcacggatattaagaaagtatgtgagaatgattggaggaagtgtgtgattggttgaaaagagaaagtaggtgaagaagaatagttgtgattggttgagaggaggaggtaggtgaagaaatagctttattttgggacaagacactgtgctagaaatagctacattttggaacggagggagtagtaaataactagtgtagtttgaccatgtctattttgacgcgagaacacatctccaccgtcgatctctctgcccacgtgtcgtcccaggatgatctgcgccgctgaatagtaagtactacgtcaggacagtgaccctgcacttataattcactaaacgaaaaggaaaatgaaaaccaataatgattactggaggactacttagtttagaagatacgagaaatactcaagctaattaaccttggactgttctcaaaaaaaaaaattaagcttggaccacgtcagatgagagccggccgagcgtcgcgttatgtgctgcatgcttgcatagaccaagtctcctagctagctaattcttcatttaacttaaatttgatgtaattttcacaatacatatgcaaactaactatctactactaataattaaaacgagcttgattgttactagtatatattcaatttatagtacatagtaattagctcgcggttgcactttctgtaattaaattaacactgggcgatcggcttcagctagctagctagaccaagtcacctgcaagctattagctcgagtactttccagtttcaattcaagtcatggatataattaacaacacatgtaacacggattagaaatcaagcaagctatctactccagggaaggcaggctgactcagatcataccaggtcagccaatcaacggccatgcatacatacatcagaataaatattcatgtgatcgcctagcttatggtttcaaatgacacaaagaatttaactcacgtgttcatcaagagaatgcagtttatacattccaacaaaattcatctttcacttcactcgacgagccggccggctgctgctatttagatagtgatgtttcgaaacagagcaacctctcatgactcatcagattcatgatattttctttttcaataatacaagaagaagtaattaagctgatgataaaaaaagatgagcacttacacgtgtctatgcaggtatgaactcaggtgactgtcaatcgacctccttgattccatcttataccatacatacattagctatgattgaacatatgatgatgagttccatgaatcaatggatcaatatatatcgatcgctaacgcgaaaacaacaagctaatgaccaggagaaaattaaattaaataagcaagtgaataattaatcgtgatatccctaagtagctaggtagtaattaattgtaatctttgtcaattgagacagatgctgctgcagtaatagacacgtcttttaccaagaacagccttgcgtgcatacacatcacaatacatcaccatctcctgggatgatcgatgtatacgtacgcactcaccaccactaagggccccttttatttgtagaaaaaatatatgaattttagaggatttcaatcctatggaaaaaaaaatcctatgaaagcctttgaaaggattgaattatatccaatcctttaaaatttctaagaaatgggtaatcctatgcacattttggagaaaagttagccagaggtctaaccacttggaacatttcctctgagcctatctctctcatctgattcttgcgtttttcctgtggtccaatcaaacggccattcatgtgtttttcctatgttttacaatcttctgttttaaaattgtattcctatcctgtgttttttctattactctgttttttcattcctacgattcaaatggacctaatttcagataggtaaagatggagtagtacttcctatatatttattactcactcggtttcatatataagatgctttaattttctctaagttaatttttctaagtttaatgagtttataaaaatataataattcttacaacaccaaattatatctattaaatataacacttaatatatttgatagtatctttgtttggtataaaaatattattatgtttttatataaatttaattgaatataaagaattttgacttaaaaaagatcaaatcaaagtgtagtacaacaaagagagagatagagtagtatgatcttattatggttgattcgcgtgtatggacggtcaggatcgagttatatatatccggccgggtggctgcattctggccatatggacgtcacagtcacggccgtcgcctctgatccgggtcaagcagaataataagaggagaaatgcagctggtcagccccagatgcaaaactatactagctggttaattataattagtcagtctcccatgtaactggttaatcaacacgcgctctcgccgtccatagtaattaccgcagtgataacaacgggacgatggattgctacatgttagtagtacttactgtactagctagctattagagtaagtcccaaaataagtttattttacacccataccagatataccaatacaaaaccaaagaaaactataatatcttatttttatcaaatttaacattttatcttttcttaatacaactattcgtaaaaaatgagggcgaggcccgagcataggcacggcgacagagaggagactactccctccgtcccacaaaacgtgattcctagaagcccgatgtagctttagcagcagtattaaaagattagcatgtcttacaaaatacaaccactaattaacagtaaaaaaaaagacaagcaagatgggtgttttgtagagaaaatcaaccgatcgacgggacggcaacacgacgatcgagcaaggaaaggaattggaggaagggtccggccgcagtcaagtcggcgcgcgggataagatggagacattatctggacgctggctaatttgggatatcttatccggactctcactgaggctcagaattaaggttcatctatctatcaatccctaattatattatgttatatgcctaagtattatcgttgttaatcccttcgattgtccatgggcattttacaagaggcacacggagcaagcggcaatctaaggcatcaagcaggaaatagtcccggaacatcacgatggtttcaagcttttattcctgggcttccaccaagtaatatacgcatgtaatcatcagatgagatgataaaatatatcattgtagtacattgcattatctaaaaaaatcattgtagtacattagatatttgttctctgctagacataagctttctcatcaccatgtacaaatttccgagacatacttcaacggccatctgactgactccacaatacaattgctttgagcccttaacgaccatgaaatgcccattgtacacaaggtaatacaaagttacaaactacagtagcacaaatgattgttactcgtcggctagcaagcaaaaaaaagatcaaggacgcacccccatccatctctgctatcaaatcaagggtaaactccatacaactcaatgatgaagtaacaaaatcaaccgtcctgtagttaaagctatcgtctccgtatatgatggtacagagctaaaatgataaccagctccacaaacctgctgcaaaaaaatcactagccatcaccctatcacgagaagaaccgtttctaaactacaaacatgcctccgcagaaatcatgcatattggactccagcacatggccttgtgcaggctaattttggtgattttcctctgcaggttaactaacacttggggcagacgcctcctcttccccttcatcctttgtcctggtagaatgcaagattattgtcattgcaacatccaatcacatcaagataaatatatatcattttacccaaccaaaggtttgaataatcctagcctgattaatcatggaaagagggtgtcagaaccaggaaatagtgtttcgtttacgtaaaaaatggtgaattttggagagcaaacttgtctaatatttaagcagatcctgcttttcaacagcacctagaggtacagaacttgttctttcagaagagcaatcttattttaccagaaatgttttgtgggcaaacagttttggcctgcagaatgggacgttgcattgaatttcccttgaaacagttttgatacatggaaccgcagtacacagaaatactaacacagtactaactatattcagacaaaagcagccttgcaacaaaaatcttgggtagcattgcagtaggaaagcagaatagaaaaacaccagtgcagcttgcagcgttactttatgcccttaaggaaggtgtgcaagtgggcatgtaaaagttggcaagctttggaagcttaagcagcacacataaaccgagtaaactaagagatgacagaaaaaagtatgatacttgaatacttcactcagcataatcaaactgaatcagtacccatggaaaattgttacaatcaacagaaatatgtctttttggttctctctctgtgtgtgcgtgtggtttgtggggggtgatagaaatatattctgtaacaagacctaagttgatacaatatgcagagctgtccccactaacctttcattgcaacttttgcctgtgatatcgtcaatggcttgatcaagtgcatatagagctatcttcttaacctggtgatgcatattcacagggttcaattagatatgaatgtcaaaaggggagaaactataaaacatagtgctagagctatcacagttgtcaaattattcaaatatgtgtgcagaagagtatggaactgcggataaaaggattagctaacctctagtttatcttcattcaccctatgacccttcggaagcaagcgaaattcttctgtcagcctgatgcactcttgcacattttccggagaaacaaagtcaagtgcaacctttatacatgactgtccaataaaagggaaaaaaaaagcaggttggtaaaaagaataataccacagataagattggtccattttaattcaacacatggtattaacagcaatggtaatggacagttggaaactgcttccatgtctgtcatagcataccttcaaatttctgacttggtggggacatcctgctgggataaacacagcctcaccaagtttctgttcaaatgtccaaggctcaattcctgcatatgaaatgaacaatatatatcagtaagtgagaacaaattacaaaagacatcagtattttttactgaccatgttcttccttgagctttctcttgtgctcatttgttagataaaagcattgatcgtgaataggatgagaaacctgacaacatagggcagttgtgtgagatgagaaacatgacagatggcattccatggacaagtggtagaataactaattacctgtttgactgtttcataattataatgtctaaactcttctgcatgcttcatcagataatcatgcaatttgctgacatcttcacgtcggaagatatcccacaatgcaccaccctctgtctgatttccctcaacaaatgggtgatcatctttgggctcaatagatatggtaaatttgttagtctccatgctggtttcgtttatttcccctgttgcactggaagagcaagcatcacgtcgcctactgcgtctttgacaatcagaagattcagatgatcctacaccatgagaagatttacatttatcttccctcccaaagccattgcccatctcctctcccccattaattgtgcagatagaatggtctgtttcccccttggagaaagtaatatccatattatgtgcatcactttgattgggtgattgcccattagacagactcaagtttccctcagcttcatcagctaccatatctgtatgaacacctccctggtccattacagcaacatttggtgctggctgcttaatgcttgagccattttcaagtcctcgagatcttggcacttcagttgattcactgagagctattgatgtatcatcgtcatggtctggtcgcagaacatgaagattcttgccatctttacgtaagctctctttctttttctctattgctgtaatcctttcagctttgagttctacctcatcagtatgcatgagaatattaacctgtttacgcaataggaaacatgtgattattactttattagtcaaaactgaacaaagtaaacaggtgtataacaaatggaaaggcctgaaatcaggaaaataacacgatgatacagctttttattaaaaaaaaaggaaaatcacacgatgatacagctttttattaaaaaaacacaatgatacagctggatactgtatgcatcagatacattttcataattaaaattaacgttccattggttttttcccatataattcatgacatggtcaaccaactatccagcattgtcagccaccgtagcaagaattaaactaaggagtgcagctttcagcagcaagtaacaagacaacacaagcaaatatcacataattctttttatagatgattctataaatttatgctgtgtttaataactagactagatgttagcattggtaatcaactataaagagaactgaaaaatcaaaaatctaaataagcaacttccaacatgccaacagaagaatatttgaagccaaaaacatgcaggtagaacccagtgccctgaggttgagcaagctttgtcctgcttggttcggtactagtacaaaaattgtccctttataacagggctcactcttaaactaggaaggagctaaatatagtagaataacttgcagacttgacatgactacaatctaaagttaaactaggaaatggcttctatatattcgatgctcgtactgtcactgtagttgtcttccagccactgttcaacggcacgagctaggctcatggggtgctgaaggtctgtaagattttacaactccacatcagtaggcaatgattggccgaggccagcagtgaacaagttgacttgctgttctttcagaagagatggtgaaacctggtacaagagagcaaagaatttttttggtactctgccactatcctagtatggtgtaatagagataattggttcaaggcattgctgtgcattggagagccatagtgcatgttgacaaagtcgcagttttttttccacaagaaaacgccttcatatcatttaaaactgcatatagcacttctgtgcctcgcccatcatgtggtctgacacaagccattccttccctcttcaagagatcacggtccttgaaaaattgctcgcaacgattaaaccatgggagtgggtcttctttgccatcaaatgctgagaaggtcaatttgtggtagaatagcgcaccacacgcatcttcatcctgccctagcactgatgccaagacattgctgctgcggctagtgctggttggaatgaggccatgagggccagggtatcatgctacagcccttgcatcacttgtgttcatggcatcctgcctagaaatgaggatataaatcttcttgcccaggtctgtaccccagctgtttgaagagctcttccagggctttggagttttatatggtggatggcagggatgggttggtcagagggctagggctgctggaggaggagattgctatgatacgaaataatgtagtaaagaggaggaagaaggtcaggaatagaaacacaggcaggtatgaaccagcactctcaggtcaagcagggttgtcctgctcagctagatgctcggttggcaaggatttagagttgggtgaagaccttcagctttattgactgattgctgctagtacaaaattggtcccttcatataacagggataactcttaaactacgaagaagcgagatatggacatatggtagtacaacatacaaacttgacctgaatactaggaaatagctactatatttgatatataaagactaggaatgtatatcctcccagactactgcaggaggccctgctaattttgagttcccagcagccccttcctttccatgtttacgtctccgatactttctatccataacatataatagcatccaaggatagcaatatgtacaatcaatatgaattaaaaggaaacaagattttaatccataaatctacatatacaaatgccagaaatcacaagaaattcacttatttaccgcatcagacatgtcgcaatggatcttcgtaacagaatcacctattcccaactcttgggcgacaccataagcaatgtatgtctttggaccaagatctggctttttaacatgttttggaagcttcactgccagattaaggggaccagattttggatctgtatactcacgaaatggtagtgcagacatgaactcagcaccatgccgcggcaggcgctcctcaaaggaactatgttgtggccaatctttaagcttaagtagcacaggcaaatcctccgaaccaacagctccacgggaatacccctcaaaaaacatgtgaatatttatatcaacctgcattatggttaaatgaaagcaatggtattaggaagttaccagtttgaaatataaagtagtttcaatggtgctgttgaaccccagatatgaaactggcaccaccaacacatcctggtggtacataaactaatatattgatatgtgaagttcataagttctaccactaccaggcacataagctgagctgacattaggtagatatacagttctttttcttttgttgtgtgtacattttcatggtatcagggattccactggcacatctacacacctcaagaaatcacgatgatcaatgtttcaactccacacgtttataattgtactcgtgtagattatgtgactgacaatccctagcatcagctctacaagaggcagcttattgcaattttattaacataatgttacttacctcaaaccatgtcagacaatcaagagctataactgagagccgttcatgctctttcttgtctctcttttcccgtaaggcccgccacataaccattggctcccagctcagtccagaagttagctcaagcacgtcacgaacaatgactggctgaccattcaaccaatgctgctgaaaatgatctaaagctccactttgaacttctctagcagttggacaatatatgtagttatcattggagtcctctctgcaagctgatttccgtgatgtttcattgttcacttcaccggattcagtgaagcaggaacatctagagcctcccaactcctgctctgtttccttattgaccactgaattgactttatccagtaaatcagaaataaagttctccttaaacaaacacctaagttcgagaagacaatccccgcaaccacctgcattaggtgggcatggtatgcttccgttgctttttgccctccatatcaaactaggagtgcaatcctctgaaggagctgcactacctatcaacctgtcattctgttgatcagaagccccttgacctacagcactgctatgactacttccctcttgcaaaccttccttgccttctatttcaggtacatcaacagctgtgtcacaagtgacaacagtaccagtagtaagaccttgacgcaactcctggcagcagctgaggcagagatcatagtgaccacttttacaacttctgtggaagtcaacaatggatgttctgcagttatcactgtttcaaataaaccaaaaaattagatagttcacacttgaaagaacatatagtccacatgctttacaaataaagcaataccaaccagtaaatccgctcatcattattaaactgagcttgaggaacctccaagtcagttacatcgatccctgttgcagaattaggattaggaaccaacaaaagaaacttagtgctaaaagggaaccgtgttaagctatgataatacctttaattgtggcctcaacacttttctctagcatctgctcttggtgaagttgtttcaaccaagggagcaaaaagcgtgcaatacgcagagagtatttaattttgttcttaccatcggcaaactccttgtcaccctgacaaacgcataacagaaaatatcaaacaaaatgaagcaatgaggccaggtaataaaatagaaacgggacaacaaaaaaaagaggtgtaccttatttattacatttgtccgcagacaagtcttacaattgcagttattgtgacaaactggacagcagttctcaaaatcgtcctctgttagatgcgggtacctgcttagatcatgccacagaaacaagcaacagatccatattagtagctaagatataaatgtaaatttgtgcatgaactaacataataagaactgaaagggtgacacaactaaggtgatcaacattgagtgcttttagaagggcacaaaccagcgtttgatgcacttgacacaatatctgtgcctcctgtttttttcagcaccattccggcacctcacaactcttccactgtccttcctttggcactgatggcacatggttgaagttccatccatcttttttgtgtgctgcaaatcaaggaaatcatgatataaggacttagcaatgaattactgacatacaactgcaaatacaccatagagaatatgctgtataaaagattgcaatttccaccttattctccttgtagtctaccgctggaacgttccgcctgtccctgagcttcctgggtggaagttcagtcgaagagggatcagcaacaggacccttcctgcgctttcttgcggttctcgaggcctgagtctgccctgcgccattctcctggaaccaaaaagagatccatcacacattcggaacatggtaaatgtttgcatttccagtccccggcaggaaaagaaaacactaacctcaggagaagcctgcgtttcctcctccttgtttgtcttctcaccgttttcctgcaaccgcacccaataactggtcaagcatttcgtatgcaaaactacatattaagctcttcttaaaaagaagtggagggaaaattcagcgcaattgcagaggaactcttcagtgctgcacattccgtgagcaacccaggcttagaaatccaatagattggtagatatccaatgaaatttgacaactctgtagcttagacaagcaaaatcagggaaatggtcgattatccaaataacagtacactatgattgaagaaaagggagcaaaatccattatccattgcaagcgcgaaaaggaatccaaggatattgcccacttcacatccccgaccagaataacaaatacagaaagaaaggggaacaactcaaagcggcaaaactaacacaccgaaagcaaacatgaagcagccagtgttgctcggagatactagcacgaatccatccgctagggtttaaacgtcccaacatcccctcgacgacaacggcgcgaagaagacgcagcacatcatagcaactccccgggttttccgaggcgttgcccgaaggaacgagagagaaaataaaaaaaaacgagacctaatcgaagcagcttcgcttcggttaccttggcggcggcgtcctccggggccttgcgcggcctcccgccaccgcgcttcctcttgggcggcatccccggctagaccccgcggcgaccggcggcgaggtcggcggcggagaaggaggaaatcaaatcaaattgcggcgcgggtcgggtcgggtcgggtcgatctgtgggcggaaggggattcggagtggaatggaagaggaaggatacatatgacacgacggagcccacgatgtgtgcgttagggcccactggtcagtgaccgtggagggctccggtgggccaggatggtaagcttctgggcccagtttcagcgagagctggagtaggggatgtatggcccactcatcggagaatcgtggccgcgcacgtgtgccgaggagtgtactaggaatggtttgtttatgtttttggttttcgcgggctgtggtgcgacgtgtgagtttgaatcgagcggcggttggtgaaaaggaaaattcgaggtaaaaaaaaaagggactgtctatctgtctcagtcgacagaaaatttggtgtctaatctgttgtttttttatcataagatttcgatcaaagagtctcagatttttcacagaaatactttaaaaaatatatatataatcttattcatgacccattggatacaataaaagcccaaaacaaaaagaagcccaaaattaaaacatgagccaaatccaatattacaaccacatcaaaactgacagagagaattcacgtgaccacattgcctattgaagaaaacttgagaaccaagaagatgctctgcataggcacgtgatctgatcattaaagcaaaaaaagcaactttgcttccaaagagaaaaatcagagcaatagatcgaacaaggaagaagaagatggaggtggaggagaagattgcaaaaaaacgaaggatttagaatctgcaaacaaaattcaagatctgaggaatatgaaatcaacaggtactgaatcttgttctgaacttcctaattcttgaaatcaacactcttctaattcttgttctgaatcttctgaacttccttctttgaatcttgaaaaaaataactcacaaatgactcaagttcatgggattcctgtgaagaggcaaaaaattgcattaatccatcagtcctctatactggcgtatgtaaaagaagcataaaatagcacaacactatatacacagtacttcataactcatttgacaattgatagaatcttcatatgaatctacaatagcacaacactttagactattgacaaaatcttcatatgaatctacaatagaactatcaaataatagacagaatttcatcactcatttgacaatcaaatatgttagttacaggattgcactgttggtattttaactaaattcttgtggacttaagatctctattcatattgcatatcaatttattgggaacaaattcagaaattaataggaaaagtcaatcatagcaaattttaatttaattatagttcaactaccatcaacctcctaactcaaagctttcaaacaaaggagcaaaggttcacatataaaatgactaggaaaacacaactacaaaattcaaaaaaaaaatcgcatggcccctgatacatatcagcaagcaacacacaatgactataagaaaacaatcacatggccctgatacatatcagcaagcaacattcaaggatttactgtccagactgtagacttaaaaacttaacataatcaaaaatttgaaaacttatactctgcaaaattcgaatttacttcagactattaacataatcttcatatgaatccacaacataactttcacataatatacagtacttcataactcatttgagaatcaacaggttagatacagtattgcacttttttgttttcaactaacttcttgtggacttaagatctctattcatattgcatatcaatttattggaaacaaattcagaatttcataggaaaagaaaatcagaacaaattttaattatagttcaactaccatccatccactaactcaagctctcaaataaattattcagagatacaattgtcaatatatttgtactacaataagatagactgtatttgatggccctgattcacatcaccaagcaacacacaaagactactgtatttaaggattattgtccagtttgaagacttaaaactttacataatcaaaaatttgaaaactcaaaacagaaatcattcagagaattcagaaaatagacaatttatttcatatgaactgattagaaggaatttcagaatatcatatgaaaactatatgagataaaaaattacaatacaagtcaaaatgaaatcatcaagtgtactcatcaagtgtactgataatatgttctttgttttgattgctaaatgtttgataattaagtgtactgaaatatacttatgctttgttttcacaggtttgacagatgagaatttgaaaggttttgttggaggtaagaacagacttatatgtttatataatttaatgaggttatgcatacaactgttcattaaaaaaaattactaatttttgaaaattctatgtatacagaaacagcgaaaaaacaacagttgattgacttggatttaaacaaaaaaatttcacaatcaggtgaaaaaacataaattttttatgttgtttatttcaatatgaaatcagaattataatcagaaaatctcattcaaacaggtttacaattaattgagcaaaattacaataggacaagatcatttataatagatgcaaagaaaagtagtacacgatcaagtactgcacagtcaggtaagaacggaaaaaaaacatttgtccatataaatttttatttcattgatatgtttaaattaacttagaaagaaaacatatgttgtgcaggtattttgaaggatttaagagagagagacaaaaacattgagaagaagacaatatcaaaagatgaaggtaattgaaaataaaattacataatttcttttgactaattgtattcagagtttggttttaaatttcataagaaacaaacatcagattaattcaatttttttaataaataaaggacttgggttactggagcaaaattataatacgatgagatcatatatgcttgaagatggcaaaggtgatacaaaaactggtaagaaacataaatttagaaccattaaataaattagaatttaacaataatctgtctattctattataatatgcaggaaacactcaaagagattcagaaattgacaagggaaagagaatagctgttatcgagaatgtaaaaacaatggaaaatgaaagaattcaatttgaagaagatatgttaggtatatatatttttgactacacagaatttgtttttttgtacatattttagattgttttattttttttcaggagaacaggatatgaactatgcagaagaaatacatcaaaccaatgttctatcactattggatcaagatttcattgatgtaattatacattgtcagatatcgtatatttgttttattttgatttggttttaatttaattaatatattttaagcaggataaatttacttcatacactagtctaatggaacatattatatcttcacaacctacaagatgcaatgatttggaggtaatttaacttgtactctattgaaaattagaatttcttcattttttttgaattgttttttaaaaactatttttattctttgcagaattcgatgtgagaaagcagcagcacaaatgttgacttcaattataatttggtgaatgaggtattaaaaaaatttattatttgaatatatcatttagaaaacattaagattaataaaaaagatcaaaaaatcattatgttgaattttacatgagtgcaggttgaacaaaatggaaatgattctatgcagactgtcattgatgcaaaaaaatatgtctgaggtgattccagaaattaattttgaagctcaagttgattctgtacaaccttggtctctagatttgttcaatctacaagaatctattgaggtatgaatttttcatgaatatgtatggttcatatcaattaagattgatataaagataaattttcaataatgtaaatttatggtccaatgtttaattacagcaacagagttcaattcagtctagtgataaaggcgaaagtactactgaagttgatcctgatttgaatgaagaatttctaacagaagaagatattgaacagtttctagatgaagaacaacaggaagcatcaaaaggaaacaatgcaagcatagacagaaaatatattccagagttgaatcagaaattcaaatcaatagatgaggcacagaactacttcaatttttatgcatacatggctggattttctattgtcaatgctcacagtgctagaacattaagtaaaaaaagaaatggagaagttattagagaaacattcaaatacaacaagtatgtgaagtcggattgcaataagaaggaagaaacaattacttctgaaaggaaaacaaatgaagtcatagggactgaatgcaaatgtgttcttgtaatcagtgagaggaattcgatttgggttatatcgaggatagatttagatcacaatcatgagctcagtcctccagatgaggctagatttctaagatctcacaaatacatgtcgacagaagaaaagattctaatcaggactttgaaagaatgccatattccaacaagaaatatgattgtaatattatctgttctaagaggtggtctaacttctttgccttacactaaaaaggatataagcaatgtcagaacatcaataaacagagaaacaagcagtaatgatttgatgcaatgtttgaattttttgaagaaaaagcaggaagaagatcccaatttcttctatgagtttgatcttgatgagaatagaaaagtgaagaattttttttggactgatggaagatctagggagtggtactacaaatttggcgattgtataagttttgacacaacttttttgacaaacagatataatctgccttttgcaccatttgttagagtatctggacatgggaacacaatactatttggttgtgcttttatacatgatgaaacaactgaaacttttgagtggctcttcagagcttttttgaaagcaatgaatggaaagcaaccaaagacaataattactgatcaggatggtgctataagggcagcaatcaaaaatatattcacagaagccaaacatcgaaattgtttcttccatatagtctcaaaagctctgaagagatctggttctctattcaagaagagacaaggtctttatgacatatacaatgatatcatacacaactcattgactgaagaagaatttgagtttctttgggaggatatgattcaagtttttaatttgcaagacatcaattttctgagaaacatgtgggaaatcagaaaaagatttattccagtgtatttcaaaacaaatttctaccctttcattcaatcaacagcactaagtgagggtacacacttagtgctgttggcaattacacaaatcaaaaactgtaattacagagataaaaaactgtaactgatagtagtctatatactaatgtaattaaatatagatttgcaaagtctagtcattcatatcatacaaaacataaagtagaacatctcaatcataccatattactgcacaatattttcatctgaacagtcaggttaaaaagcacaaaaacggtataattatccttcactcaacagcacaaactgtactttactatacttatttcagtactcttcactatacaactgacaaataaaatattaaactgtttgaaaaaaacagtaacatgcagtttcaaacatatacaatataaacaatagctaattaaaatgaggagaaacaatatcaaaccaaaaaaaaagatttgaaaagaaaattggtaagcaaaaataaagacatataatcaaacctattattctgttttggcacaggaggataaatcactgagaatctgttgaaatcaatagagtgatcttgaacataaaggttccaggcaagactaaaatttgaaatctacaaaaaaaatattaatagaagttaaattttgtagatgaataaaaaagctgttatgaaatatttacaaattcataaatgtatataaaactaagtataccagtttaggtcttaattcagcatgatagaagctctcctcatcatacaatgaatccagaaaaacaaatctttcagatttcaaatcaatgacaaatacgaaccagtgacgactcttgacaattgggaaaaagagctgaatgaaaacaaaaaaatacatgaaaaagaatttaagttatataatgcaaaatttagagaaaaaaagtaagaaaataaaccaggtcacatgtgtgaacatgtcttgctagtgaagctccatcaaaacacttctttacagccgagatatttgtcatagaacggtccttaaggagatcatcctaacattaacaaaagaaaaaaaatgagactgatattatttgttaatgtcaattatttataaagatcaatatagaaaacaactacacaactacagtttctgtcatattaacttgcactacaatggtattatttcataagaaaaaaattaatactaaataaaataaattacagtcaatttctattgcaattacagaaaacaaaaactgtaattacagagataaaaaaatgtaactgatagcagtatatgtactaatgtaattaaatatggatttgcaaaagtctagtcattgagatcatacaaatcataaagtagaaaaactcaattgtaccatataacagcaaaaaaatattttcctctgaacagtcaggttaaaaatcataaaaacaatttaattatccttcactaaacagtacaaaaactgtactatactatacttattttagtactctttacaatacatctgacaaataaaatatgaaaaaaaacaagagacaagcagaccctgcataatcctagtaaaatcatacataaccagcgagcaaacaaccagtaaatcagaacaaacagcaaaacagaaaagtcatctcaccaaaaaaaaaatcataacttaaaaaagaaaaaataatcataaattcaaaaaggatgccatcagatattaaagaaacacgtcaaagctctgcaacatcatcagacaagaattttaattattctttttaattagtataattaatattcttgcctgatgacgtgctgaacttagatttgcttaatgtagaagatatttatcatcatctggcgaaaagaaaattaaaataatgaaccaaaaaaaatacaaaaattatctacactgtagtacaaaaagacattagaaaaatcaattgactatcaatcaccactaatgttgtaacaagagtgcagaaaaggggttcaaatggaagtttttcattgtgtgattagtaagtaaaagtctaaacatctaatatgataagcaataaaaattgtaattcttggttgatgaagcagaagaagaagatggagagaaacacatcatatataataaattacagtcaatttatatggaaattacataaagcaaaaaccgtaattacagtaatacatttcggtaactgggaattaactatagattaatgtataaaaatgaactgttaacaaaatttgaatattgatttgcaatgtctactaaatcagatcatacaactcaaccaatataactactaaaacaaacatagaaaataagaagttattttacttagaagggcatgtttccttgcttcaagttaagaaattctttctttttgatttccatgagaccagcagggatgtgagcagacctgaatccctcacggaaaatagtccaagtgattggctcgtcaggaggaatgagagttttgtatgtctcccaccaagcagctgctgcaccttgcaggtagtaagcagcaaaggtagccttctctacaggatcacaccggcaaaggttcagcttgatttcaatatcacgaagccaatcatctgctgcgagtggatcagccgcaaaggagaaatgaggtggatgtgttcgttgaacatctgctagcttggagggtgcttgattggcctgctgtgccatggcagcccccatgttttcagagttcgctaccatcctttcaaaaagtcggttttgattagccaggagttgagcaagagatggttcatcatcatgctgttctgcagtggcagcacggcgactacccccggcacgtccagaagaatgtaggccagtgcgaggctgactcgctccctcaccattggcatcatcagtaagagcagccatagagcgagtatgtgtcatcctgcactcaaagtacaaaagtacatgagctgcttgagcatagaattggcatatacattaccctaaataggtagcatacaggaatgatttcttatagccgaatttacaagtcatccatcatatatttgcatgaaacaaatttctggacagcaagcaatccattccaaaaggagcataagttcattccagtacattagttttaaaggatctaagtgatcacagatacataggagtggataatggtcataagaaaccaagttcatgccttggtgttacaaaattttgaccgttaaaaagattacatattagggtgtcatctcatacatcttaaagaaaagaaatgaaagttacaccccatacatattctttttccagtacaccattctatggaacttcggagaatccgatgggaggttgaggcactgtggttgacggagtggccatagtcaaacggtattgtctcccattccgctcgaactcatagaatggccccagcagcaccggatattatcaattaataatcaaatagacaaatattagattaaaaaaagaaactacactatttttagatacttactcttgaaaattactcttgctgatcttgcaaacaacattataaacttgtctatcatattgtgtcactggaaaagaatgtctctcagggctgtatggatctgtatagtatctagctggttgtaaaattcttctgagatcatgttttggtttttgacttgtgctgcactgtccaacagatttatcaacattgcacaacagaatcctctcaggactgcctgtagacatcttcaacttcttgtctagtttaactacaaatgtgttgatcttattgtacaaaacattagtcttcgaagttatgtcaaaacaattgtctggacattgtttttctccaagaaatatgacatcaggtgaatcctaaataaaaatagaagaaaaaatgagaaaaaaatgtatttattaattttaaacattgttcttgaaccaaaacataatccactacatttcatttcaaggtaaaaacagaattacatagcttcaaatggcagaaacaaaattttcaggaaagcacttttgacagcacaaatcaaacagaaaaaaaatttcaggaacacacttttgacaggcacaaatcaagcaaaaaaacaatcttcaagagcgcacatttgacaggcacaaatcaagcagaaacataatcttcaagaatgcacatttgacaaaaaaagataaattcataatatattagtaaaacaaaaaaaaataaaaataagaaaacatacctttttctgtagttgttcaatgttcaagttttcctcttcattatgttgagtcaagatttcagtatcggtatcctccaaagttatcattactaacttgtcctgtgaaatattaaaaaataaattttaaaaaagtattataaatgtaaagctttgtacaatttagaaagttacctcattagttgaatcgttcaattggctttgtgaatcatcatcgaaatcttgtgacaggtcctttggaatgatctggattaacataaaaaaaattttgagatgaaaaaaacagataaaaaaacatataaaaacatacaaacaggacaaaaaagaataaggaaccattacatttgaattgtcttgatgtttgggtgttacttgagtcctgaaatgtttttcttcatttggaaaatcatcatctgaatcccagattttaaagctaggcttctcatgacccaagaatattgattttctttcattgaaaccaacaatgcttgatattgctttctttggagaagtattactgagtcctgtttccaaatttagaagtaatataactgagattgataatttgggaaaaaaataatcatcaagaaatttaaatttaaaaacaaaatatataaaatagaaaattgaagagaaactaaaatttacctggcttggaaagctttttcataattccatcaacaacagctattttatcctaaaaaaacaaaaaataaggcatatttaatcaatatgctgacataaagaaaatctaaggcagcaacgtattgaagtttatattatgttttgcttttcacaaaaatttaaataaagattataactaaattggaatgttcatatcaactaattaggggcaaagctagaagttcataggaaaaattaaattatatattcttaaagaattacaatctaaaatatgtactaaaagcatttttaaaagaatctacaaaatttcaaaaatcatattacttcaacgagactaaactagcaaacccatcaaaagtagatattgtacggttagaattcagaaatattgaaagcaaaatattatacagttagaattacctttggagaagatgatattttcataggagtttgctcatttccaattgcattatcattacaggtattctggtcttttaccattgaactatcatcattgaatttactcttgtcatcttcattcagattaacatctacataatttaaaagacaaatgtatatatttatgagttgtaagttagacaaaattgaaactaaaagttctgttgttgctggtactaaaagtaaaaatgcagcgattaagaagaaagaatatataatgataaataaatattgaacagtaaacaaaatcatattcaaaatttaaaaacttactagtgttttcaggaacaattggcttgctattagataaaagaacaaagacatctacaagaagattctttgctctttcatcaatgcagttctcatcaggaccaaaatgttgaataagcaattcattgatcttgtttttcatatcttgagttaaatcagcaccaactgaagaatcaagcatatctagaaagcttctctcaataggtttaacaggaacattttcttttacatcatcacttccaatctaaaaaaaagagagataacataaaatttaaaacatgaaacaattatattttttaaaaaataagaaatagatttataagtttaccattttgtaacagcactcagaaaaatctttaactggtcttttgccatagacacctttgctgattttatcaaactttgaaatttttttgatcattgaccctttccatacttttattcttggaacatgtttcagtactaatcgcataccaaaattcagaaaatccaaataattcacctattacaataaaaattaaaatgaataagtaactggcagaaaaaatagttttaacaaataattgaaaaaagagagagaaataatactaaccaccagacaatagaagcaacctccaaaagtttttgacttgtcaagcttgctcagatgtttcattaaccaatcaaagacaagactgctccaatccaaattgtcaatacaactaagatcttcaaaaacactcagatatttcgtgctaggttgaagagaagaatttgggcacaggaagcaattcaaggatacaatcatgaaacacattaagatttgttcatcagacattgtttcatttttgataagcttctctccaaaatatttgacagagggcaaagaagagaggccgaaagagtcaagaaggatctgtttgccaacttcaaaatctgaactaatcggtaaacctccaacatgcaaacccaaaacaatatgaactgattctttggaaagtggaatgactttatctctaacgatgatatcacaagaggtgacatcaactctttgtgccacccataaagcaaatttatatggcacgggacatttttcaaagagtaagagagttttgaaacaggttttggaaataatctctctctaatgttcagacaatgaagctagcacatgagaaaagtatttcacagaaaaccttgtcagtttagtatctaaagttgcagcactcttcattggatttttctgcaaaagaaaagatattttcattaaaaagtttttacataaattttgaaaataataaagacaactaataacatcaaactaatttaccttgcttttatgagaatagagtttccttttcattccatttagaacattatctctatatatctcaagcaaggctgaatccaacttatttttgaaatcaacatctactgtttcggtttattttctctatcaaaaataagagaatgcaaaattaattttttaaaaaaggagcaagacaataaaaggggtaataaagaagagagaaatacaaaaaaagtatgagaaatgcacaagatctaatatgattaagattctacattattggaattgttgtatagaaaatgacatgtttcaaagttcatcagcagatatcaaattcaaaaactaaaaataaaatgcttctacctttagacaagcagataatgtatcccaattaaaactctacaaaccacatttatgtggagtgccctttttacattattttctcaaaaatcaacagcaagacaagtactagaaaaactgaatgtgagcacatattgacaattaatgacataattgcagcaatgctctaagaatgtagaattgatattgcaaatttcaagtattgaaaagaataagaaaaaaagttaaaggtatagctaagggatataaaacagaaagcaaaagccaaattacagtcaattacagtgaatttatatggcaattacataaatcaaaaactgtaattacagaaaaaaaattatgtaatagagagaagtctaaaatttaatgtataaaaaagcaatgataggaaattataatagaacatataacttaaactaaacatagtgttgtaaacaaaaaatgcaataatattttgttaccttggaagtgccttcatcagtatttttcttcttactcaactttcttttcaaagagttcaaaagttcatccttagaaattccaacataactagattcggagtcctacaaagaaaattaatgaaatctaagaatattcttacaaacaatgttaaaaaattatttcataaaaacaaacctcattgtcacaaaattcatcatcatttggagaactttcatattcagaagaaatagaatcaccaaaaagatctttaatatcattaggattacccatctattaaaaaacaaaaaaattgaattaaaataagatagagaaatacacaaagcatgcatatcagaaatcatatatacagtcacaggttcacatcacagtttcacaactcaaggttaaaaaaatgtacagattttaacagtaacatgcagttgcaaatatatctaatttgcaaagtctagtcagaagcacaacataagagctaaatcaaagcctatattgcatataaactaaaaaagagggtgattcgtcaacattcgcacaaaaaatacagactacaacactacaagaccttcgcaatcttgagctcaaatcacaataatggcacctccaattcgaccacatccacttagtgaatcaccaaaaccacccccacgacaaacaccacaaaacgacagtcactagaggccaggataaatcactaatgaatcattgctgaataaatcattcaaataaataactactgaatcgcttgcaagagctcaagagggttattgagtggattagtgagttaacacaagaaacagtatccattaacagattcaagcaaaatgctgcatttgttaattcataaacaaaataacattaggaactagtagtttttggtcatgaatgcaaatgcaagtatctctggaaaatatgtatgaaaaacagataaacatgcgctgcagttcttaatgaacatcataacaaataggctaaaattctaaattaacggcagaacaaacagattctgcacaacatatgagaacacactaagaaaaaatctggatgacttgtgaatgacaggaaggaattggatactcaaacaaaaaaggggaataatgccattgacaaaatgacttgtaaatgacagtagactagatcttattttgtatgaacaattagatctacacctaacaacctaaaaatatcattaacatctaagccataagtgcaaaattagcttctgaatattggatcaaatgaaccatgtcactgatttggattaaaaagtacttctctaccttaaaacagaaataaaacaaacaacaacaattgtaactcaatgtctcataacacattcagtaactggatcaataaactacatgattcacaaaataacagatccactgaatccaaacactcaaaactcacctaagataccagcttcaaatctaagcctcagccaaaagtaacctacaatccaaaacaaaatagagattaaacctaaaaacaccacagaaaaaacaaaaacacaggggaaaaacctaaaacgttgtagagctgaccagatctgagactcgaaacaaaaataaaacgaaatcctcacgagacaatcacgagttcatcacgagttcatcacctactgcacatgctacgactacacaactcatggagttcatcacgtactgcacaagctacgcatgttccaaaccctaacccgtgttgtccgatcaaacaacaacagtgaaatcctaaaaaacaaaaataaaacgaacaaatcaaactaaatcctcacgaaacaatcacgagttcgtcacgagttcgtcacctactgcaaatgctacgactacacagctcatggagttcatcacgtactgcacaacaacagcaaaaacacgagaaggatggggaaggagacggtgaagagcaagagagaagaaaggaaaaactcacgaatcaaatagaggtcaacgagcagctctacatcagcagaaaaaggacgacgaactctccggcgaaaatcctcaacaccggctagatctacgccggcgaaatcgccgtggcggcgaaatcgtctcatcacaacggcgaccttgccgaagcctctctgtctctgtgtgtctctctctcccccagcgagtgagtgattaggggagaaatatcaggacaaaagtgggacccacaaaaatcacggagaaagaaatgcaggcgcggagatcaaaatttgaaaagtacaggtgggacccacaaagactgaaaatgttaggtgcgtctctggaaaaatcaagtgggacccacaacagcccaaaaaaaacaggcccaacaacccagtcaacccagaccacgaacgcaaaaaaaagcccatatgaagtaaagaagtccatctctcagcacgaatcttgaacagatcaatggcccaaaaaacgacagattcagcccaaagaaaactgtcgacagaggaatagcagttccgaataaaaaagggcgaaaatttacagcagccgacgacggggcctctcgaaaacaaagagaaaaatgtctcaaatttgggtggaatacggtcttgaaaaatatctcagattcactgtgctactacttactcctacaggaaattggattattattgtgatgaaaagaagcgagaaacctaattcgcgcgtacgcgttgccgccgcgcacgccggcccactaaggcccatgcacgtaagcgcttgtgcttctttctttatttctcttttttttacaccgccgtttcttcctttttctttattttttcgctgattgttattcctaccgtacagatagattagtctcctatttttactagcgattagtttactagtaatttttaaatcttaactttaaaatttttaaatttggatatgaaagttttcaaatctcgagttgaaagttttcaaatctcaagttgaaagttttcaagattttcaaatctagacttgaaagttttttaatcgagttgaaagttttcaaatcttgagttgaaaatttttaaatcttaagttgaaatttttcaaaattttcaaatctggacctgaaagttttcaaatctcgagttgaaagttttcaaatatcaagttgaaagttttcaaaactttcgaatctggacttgaaagttttcaaatccgagtgaaaagttttcaaaatttgactttaaaatttaaatcttaaaacaaaagttttcaaatctaacttaaaattttttaatctattagtaaaaaaatctccgaatttttttttgagaatcttccctaattactcgtcattaatgttaagtgtatgttaactaatactatagagtagttaggaaggtaatacagagtagttagggaggtgctcgctgctggcgcgcacgcgccagctagcagccgcagaagatgcagatttggatcgagcctgagaacatataccacatgggccgcaagattccgtggcccgtgggcctctgatgatagcctactactgtagtactgtatattgcccaatcaagacagtagtgtcggaatttttttcatttttaaatttttttcttttaatatttacagaaataatctatcggcgcaaaaaattacagaaataggccctgccgccctagtggagggcgacaagctgacgtggcagacggcggctcgacaacgccgtctgccgccgtctgcgaaaattgcatttagcctagggcggcaaggggctaaatgcatttttcgcagccctaaagagcatttggctcatacttttttgcatctgggtcccttgccgccctagatgcaaaaagtaccagccaaaaagtactaggcctaggctggcggcaagggttttcgtgcaaaaaaaaacctccctctcccgtctgtcgtcaccgcccgtctctcccccgtttgccacgtcagcttgccgccctagtggagcgcggcagggtctatttttataattttttgcgccgatggattatttctgtaaatattaaaagaaaaaaatttaaaaatgaaaaaaattcgtagtgtcgtcgtgcaaagcctgtaagatttgtcggtttggaagttgcaacaacttttgcagtgagctgccaaacaacctgtctcaaaacaacatatgcatccttcatccagttgcaccacctatctcccagttgcctatactactactgtactgtatattctactatgactctggtatctgctattctgttacacatcgctaatgctcagcacgtatctactctatcgatctgacaattataaaaaaaaaagataggcaggaaaaaaaccatcgtatcatataaacaaacaaaaaaaactcaatcatatcggtcgagaaaaggcaagaaccctaccttttcacaccgtcacacgagtactcatcccttaggcctaatcggtttagaagggattgagagaaaataattccacacctcaataggtgtggaacaaatcccatcatatccctgcctaataatatcggtctgtcaactatcattggataactggaccaaaaccggccaccgaacaacgtcgatgcgagacagatagcacagtactcctactatatacataaactcctctgaaactgatcaatggagcaataaggtcatcagacagtcatcacctcacctcacccacccacccccaccagctgatgaaagccacagcacaagcaaaatcacaaagctggtatacagcacagcagctcagacataccctgaatattcattgatcattattcactcatgtaccagaaacatttcttacacgacaagggaacatgagagagcatatgaacaccagggatcaataaatgaatgaatctagtgacaaacaaatcacatcacaggtggtaacagtagtagtattaattcatcatcaaccaccagcacaaatcaatacattatccaaatacaacactaagaaccagttaaaactgtgggggagaaaaaaaaatactcgagataatagcgagctgtaattcacaacaatggcattttagaatctcaaacggcaaacacaatcatcatcatattcttcctagtctacaacacctttacacatgtggttttttcttcttcttccctttatgttacaaaggccaccctccatcaccaggtgaggtgagggtgtgttcctcaactcctgaagccaaagttggaccacctcctcccagcatctttcttaacacgctgcgagttggtcacgaaaaggttttccagcgatttctgcttcctgttccgggaccgccctgcctccttcagaagctccgcaagccttagcttctcgtcctcgacatccgggtttgctgtgccgagcttctcttccctcaccttaagtacgtgttccagtatttcaatggcgtcctcaaccctgaaggcaaaagggaaatgcacttactcatgtatcaagttaaaatattggaaatctaaaagaacaaattctatctgttttctttttgcacagggaaaaacaagttgtggcaattcctaaatttatagatgcaacctcacaggtatataagcaatcaatacacccactcaaaaaaaaggggggaaaacagcacgcctgtaagtttggaaatcgactgagttgatgcaaatcaccgcaggttaatagcatttcaatgaatagtttatatcaggcaactttataaataattggacagttgtaatcatacactggcatgcagcaacatgtgggcaatttgatggtggtccactaaactaaatgatgccttcatttatttgttgattgattgcaatctctttgttaatgccatcgaaattatgcaaccttacataggatgataatctaattgatcaaccaatcttgcctatccatccaaataatactacacatgaactaaccgcctatccatccaaataatactacacatgaactaaccaacattcaacatttcacggattattagaggaggaaacccataagctgacaccttcagatagcaaaacaaattcaggggattacttctacagctgtgaatgataagggtagatgccaacataactcaataagcatattcaggtgcttgtcaatggcatttcttggattttccccataaccatcaagggattgctaccaagatatgatttgatcctaattctatatgaaacagctgttggttgaggaaaaaaaagtttctggtatgaacacatacctgcccatagcatcgtagattgcagccaaattactgtagacgccgagagtatctggatgagaggcaccacactcctgttctagaactgcccttgcctcttcaaacaactgtgcagcctcatcaatcttgaatagctgcacacaagctagccccatctggttcaacagaactccaaaaaatgccgacttcctctccccgctagctctcaatttggcaaccgcattttcaaatgagttccttgaatcggcatacctccctaccatgtagtacaacacacccatttgtgcctcgatgccagcaacagtgctccactgtcctggtgagtcctcaagcaactttagtgccctttgcaaaagcttcagtgcctcatcaaggtctccaagcgcctcatagatggcagcaatctccattaggcctccagcaacctcatcaggggcagcgccaggcgcgggctttgcatagacacggagtgcattctcacagtaggatttggactcgcggagcctccctgttcggtggtaaaggtctgcgaggcggacaaagacagatgcaaccgaagggtggtcatcaccacgggcagacttgagtactgtcaacgccttctggtaggagaagacagcctcgtcgaagcgggcgagggcaaggtaggtgttgcctatcgcgacatcgatcgtcgcgacctcaatgtcacgtccattggcgaccatggtcatggaggcaagcacaaggtgctccagggcaccatcatagtcacccttggcgtcaaggatgagtgccatcaggcggcggtcggaggcctcctcgagcgaagcgggagcgctgtgctcccggtggatctcgagggctttgcggcacaacttctctgcttcatcgaactgcagggcttgcacatgcgcttccgccaaatacctgctcatagtgcaaaataaatgttgtgttggtcaagtgctagctcttgcagattattgttacttctatctctactttttttttttttgcataataatgcgatggacttgatgaaatttatggcgagatcggcggaaatcacaaaatagcagagggaaattaaaaaagatgtcgcttttgaagaggtagattggagttgaaaagcaaaatggcgtttctaacttttaagagaggagatctagatcgagaaacgggcgagaaggaagggtttttgacctgcaggtctcggcgacgcggggatcacgctcgccgagcgcggccatctggatctcgaggcccttgccgtagcaggcgatggactcgtccatgcggccgagcatggcgtgggtgtcgccgagctgcatccagccggagaaggcggcgagggcccactcctcccccttctgctggtcctcgggcggctgctcctccgccgagctctcaccctcaggcggcggcggaggcggaggcggcgtgacgacggcgacggcgcgctcgaggacagggatggcgtcggcgtgcctgccgaggccgcagtggatggcggcggcgacgtggaggctcatggcgagctcgagctcggccccctcgccgcggcgctcgagcgcgcgggcggccctctcggcgaactcgagcgcgcgcgcggcgcccccgccctcccccgagaccatggcgtcgcgggcctgcttgagcaggaagggccccagatccgggttgtcgagcgccgcctcgtccgtctccggctgcgccgccaccttcctgggcttggcccgcgacgaggtggaaggcgacggcgacggcggcgcccggctcctgggcagcggcgacgacagccgcctcggcggcggggccgccaccggtggcgagttgtcggccgcggcgaggcccggcatggtcgggtgaggcgagcgcgaggtggggagtcagagagggacacagctgcttggccttggccttggccttgcttgcaatggaagagaagaagaagagcggcgcggcgcgggggtttgggtggcgtcataatgaggagagcggcacgagtaattaggcagcggttgatggccaagtttagtcattaatcaattaattaaggtcctcgaggtaggcaattaaggtggctggttcatctctctctctctgtcgcccaagtcttctcgtgtacctagttgattcgtgtactacggcctaaggctacaatgtactgtggctgtgtgcctgtgtgatgcgatggtgaatgggaatgggcttgattagggttgattgtgttgacctgtctcagaatgacaggtgggccatgcgtggttagcttgtgattaaggtgacaaattgttgggggtcttcatccatcttgatcgctgacaaatctgcctggtgttgcaggcatacagagcataactgagaaaaattattgttacagattactgctccctccgtttaatgtttggactttagagaaggcgtcatttattgagagtatatattttgacaaataaatttaaataagtggcctagataatacactaggaaaattatatttttttaagtgtggagcaaatatttcgtttaaatggttcagtaaataatctgaaaataaatgcttgacttagctactcacttgtctattgtaagtgtattttccgaaccactaaacgatgtatttataaatattttttacataaatatttctttataagtatcaaatattttgttcacgtttataataattagtatttaattgattacatgttaatgttaatgattttctcgtttcaagtatcgtcttgacaagcacagggcactactacccccagctcaaagctctgaaagttcgcttggtcggtatcgacactgatcctatgatatctgcttctacgttcgtatacattagcatgtagtttaattaattatatagtacgtacagtacagtgtatgagaaacattataattaagtagagtaggaggaaggattaaggaaggagtgcattacattacgcatgcatgcctacttgcaagttgcaaccaccatcggaagaagagatacaacgaaaatgatgaaatggatcatggaggatcatcagagctgtaatgcttccctggcatgcacaccctgtcatgaactaattagctcgatcatcacactgtatatgtttgtatgtcctaatcattgttttcggatccatccaaattatcctgacagatcttaaaacacagcccatcacaacgctggtttcgtacatggatatgttcttttcagacaccaattgctgacagtacattagtgtactccataggttcatcttgctgctgccattacttgagtgtagacaaagaaaggagaattattgctcgtgcatgcctcggttggtccgacattttcattgccattcgagcaccctatggattacagactgacagttaaattggttcgctaagtgtgatcagtgttcagtaacattttgctctgttcttatctccaagttcccaacccatctccctcgttttccgcgcgcacgcttttcaaactgctaaacggtgcgttttttgcaaaaaatttatatatgaaagttgcttaaaaaaaatcaaattaatccatttttgaaaaaaaaattagcaaatacttaattaatcatgcgctaatggagcactccgttttccgtgcggggagtttagttcccaactccccctatccgaacacagtactcctccgtgaaacctgtcggtgtaaaatccgaagagaagttgtctaacatgttggtgggccttgggcctcgtcgtgggctttagatttaggttgaggcccacttatcaacaacaaatagtacaaaggccacaacaaggggatgacgaactgccgctgctactcgccgtcgccgtcgccgtcgactcctcgtcgccggcgtccccaaaccaagcaaaatgccatctccgtctctcctcctccaccaccaccaccaccgcctctcccctcgcttcgccccctcccgctccccctccccccgaaccctatcgctgcatcctgctcctcgcctccgcctccgcctccggcttcgcgccagcgcccgcggcggcgggggcagcacacgggaccacgatgacggcgcgcggtccatcccgatagcgcggtgctacgaggcagccctcgcgcgcctcgacctctcgggaaccgcgcggcgggagcaggcggtcgcggcggcggcggcggccgatggaggcgcggctgccgaggctcacctcgccgctgtcgccgacgccatggtcatggaggccttcctccctggacccgacggcgcccggcgcagcgccatgtccacacggctggtgagcgtttcggggttccactcccacctgtccctgtatcttccctttgctgatttgctccacacaaccgattgatgatgagaccaatgtatttatttgttcccttacttgtttactgcttctgcctagtgtgatgctcgaagttgcgtcctaaattccacccggactcagcatcccatcagaattagtgtaacgcacctatatctatttactctaagctttgatgctttattttgcgctaaattcggagtattggttgctctggatttcgtcatttcatacatattacgtgaaatgtttgttggcatgtacacagcctattcaccacacggtagtacatatgatttttaagaacctgtacagggtgaaacaactaactgtacatgctaagttcaccatgtaaaattaatctcttggaactattggttggtactaggagtccaagtgcattagtgactcagtgtctcagcgcaagtggccggctgggaattttatgatacaatagaggtgcttgtacttgtagcttaacaacaaatcagtatctgtgcttttctatcatgttgtgtctaggaagagaacttattgccagttttgtatatatcgaacatggttagatgctttaatttcgatcggaatgtctgtccttgttggatcatgaggaagttctggcatttcattgtagattttgcaagcaaatgaagttacagagaaggccagtaagctaaagaaagaccttggcactgaatttttctctgaaaacgaacctgatgcagagagtgttttggcaatggcctttaagcaagttgtaatggatcagctcacaaactttcggcttgaagtgttctccccaggttcagagatagatctccaagatttgagcaaaccccgaaaggtgttcctctgtaaagtttgggacttgtatattattttgtttcgtttgtttgcttgttgctaatttgtggatgcacaccaggtgcctgcggattttagtatcagatcatcagatgaaaaacttctagctgctcttgcggaagccattttctcctgtgtcattgaggatgccagaaataattacctagggggcactggtggtttgtttcataagtggaagtcaaactgctcattggattcctctgtttgcatagacataatttctgagtcagaagtagtgaacagtgctaggaggcgcttagatagttttgatcttgtacagtcttctcatgtagcgggtaaagcaaagaatggatggtggccagctccaaagtctgaaaggttagtgaagattggtggccctgattttatgctttgggccagtgagtttgtgtacacatataaactacaaattgatgccaaagcattcaagaatacaaagcttgggggtcatcatgtgttagcaaataataagggggaagttctcttatcccacgcccaaatggtacattattattctctccttgtccttgatgtatacattacttgttgccattcttatttattgtatgctattctccatctcccaaacctgtaggtggagttagcaaatattctggacatgtattttgaagatcagttcacattacctggaaaaaccttctattccaactggaattcagaaccatcaaagattaaaaagaacaatgtatgctgctattttttatttcagagcttacttgtgttaaatattttttttttatttatgttcatcaagcattttttttggtgcagggttatttgaacaacctttttgctttgttggctggtagctctattgtttttcttgtcggcgccattgctcagttatgctggcctcagtctcttaaagataaaagattggccactgttagttcatgtgtctcatcatcacagagctattgttctgatatccactctctagatagtagtgaggtatgctttctagttcttgaaatgttgttgcttgcccagggagaatcctgtttgtttttaagtgtggaaacactttggtattttatactattttctggatttttttttacttgataacccattcacaagacattgatcgtcattgtgttgtaatttagaaataactactcaactaattggaagtgtcccaaaccttttgatagtgcaatattgttctctacgtccaaatcaaagaaaaggaaacaagctacctcgatttttagttgctctgggatattttgattgtctgcattatcctatgcaacatagcatgtaagagccgctgctttaaaaataaaggatctctaagaaatggtctgaaactctgcatgattcatgtagaagtcatttcatcaacttgttatggcttcatgatgtgtgttcccattaggaacatcatgtagcatgtctcctttttgaactattacccttttgccagcaaacctagttgctgtttaaatttaattaagggcatatctggtgacaaatctatcataactactttgttgattatctaacatatctgttgtatgcaacctatttacccctgggcagttgcaggcttactgtgtatctgttgttgagaaaattaaagactcatttggttgtactggtgatctaatggttgatgcaaatattggtgcttgggttggagaactgcctgaattcttcaagggcatcaactgtgacagtcatgatgattatgtcgatattcagagtactggtgctattagccaaggagagcaaccctcattggtgtcaagtcctattaagatgtcttctcatctggaacaaaatgatgacactcaagaaactctgcagaatattgctagttttcaggtatgctcatttcctgcataaaaaatctctttgtatcagatgaagaacttggtatttttggtaaaatgatgtgcctaccaactcaaatgtgtatttgccattaacatagttcatgaagagggttaatcaccataaaagagattgatgacgatggtttggaagtagaactgaacctaaggggtagagggttggcaggctgaggaacttggctagggaggatagactggaacatatggctgagatggacttggtgctaacttatatggtttcgcttttatagggacgacatctaacaatccattcaaacctttcctttaaatataataattctaccccatctgataagatcatatcctatctccaattaaacctaagttgctagctaagcaatgtgttgcagataaatattgtaactgccatctcacaccagccctgatgggcccgtgacctaccttatggccatatgcagttatgcacataacaatatcactgtgtgaggtttttagtctgtctattttatattgcaaatttccccaaaatattcatgctaacaggtttaccacacatctgtttatgatgcactgtcactacacattttcagtacttttaagttaccatgtcatttctttatttggttcctgtttttattgttcaatttcctttcatgcttggtagcaaaatgcacttgttttgccatctttattattctaaaacaattgattgatttaagttttgctgttctttacattaatttcctggttttcttattttcagcagcatatatccaagatctaaagtggatgttctataaactataataccctgtttggcatatattcatttgttctttggacataactcatcagtcatgactcaaaagaaagagactacactttctcttttctatttcgtttaatactatgaccacaatgaaattaatcgtttaccttgagtgttacaagatagcacaataagactgcaaaataataatgttttcgttcttttgaataagttgtttgcagcatctgttaacttttcctgcaagttgggttgcacgaatcacccaatgccattgtcttatacttttgaaactatatgatggtagaagattacacttgactttatgatggaaactattgttctattgttcatttccttgagttaaatagttcagacttacactatatcacccttttttgatacaaacttgcaggtggtcatgtcagaaagaggtaaagtagttggatttcagccaacaaaccgcctagctgtgaatcattgggcaacaaatccattaacgaagctcctgtacgaggggcgaaagatctctccaggtaccatgattgaagtatcaaaccatggaattttattgttaatacctgtgctaaagctgtattttgtctttgcttaatactatggtatggatattgtcagcctttctggagcctaggcttagaatttctcgcccagctaaggttgtcccagttgagttgctgatgtcggtgaatccagaatccttttttgctttggtgaggcctgttcaagatccatgctaatggaggtacttttcatttctcctccagttgttctccatctactaccctcaccctctcttctctctcatgtaattctataatcgccagtactttatttacccagagttctgtagttgctgtcctagttaaagctaatgtcatttgttgtcacccaatctatgcttatcttacccttaaaacaggattttacatgctttgtcattacatggtgctgtacagattcatgaactttttaaacatagtagactgggcagttttcttgttggttagtggatgcattttatagtaaaggatatggaattataaactctctaaatagtagctttactctttgtcttgcatgcgcttgcgaatcaaatagaagaactgcaagtaggtgttgcaagctatggaccatgaatcattgcagcacaggctctcacgttggggttctctatgtggttaaagcatggttgaatcgatccacatgtagaagttatcagttattacttcttaatgactccaatccagatgacacaatggagtccctttgtggaatatcagcaccatgccagattgcaatacagctattcgtgacgatatgctgtctgttctgctcatgttggagtttatcatcggttttctgtttctgaagtctcaggtaattaacctcgaaccttctgggtaaattctttttatcagtagtaacaatggtagctcttcatcatcggtatcaggatgctcattttgagttttttttttggggaagaatttgcctcaagcccattttccagtttctacagaaggctggaagcaatttcattttgcgtaatcaagatatcacctgctagacaactttgcaaactaacatacaccctgtaagagttgtcaagtgtacaattatagatcacagtgaaagtagaatgaatggtaaccacttcagttgacatcataggtcttgggcgtctatgatgtaacactctctttcgcacacagcatattttgtatgaaaaatattatataatcgatctcttctactgaactattgttctatgtgctcgtatgcaccacagtaaattaggatgctaaattgatttgtcgggctgcaaatctgaattcacaatcgtgagctaggcataaatttctccaattgagttcattatcacttcctctgtgataatttggttcattctctccgtgtggtgggcagcatcccagtatatgtacttgctgggatgtgtgcatgctcttcggcctctgcatgtttgcccaacttcaataactcctgttccacaacaacctcttgaggtttctgtcaggcctgtagttcagaagaaaatatttttttgaggttataataccaataagtgcacactttaataaggatgctctgaaatataggacaacttaccatagttattggggcttattgttgccatgccgatggttgtataagtatcaacaaatgtagccctgatatttggttgattctttagaagacgcaccacttcaactagcctctcattaaatgaggttgccagcaagttcatgttttcatggcatctggttgtacctgtgcctagcaatgttctagcaataggtaaacacccaattgggggcactccaacaaagacaaatctccttcctccaagtgctgccatcacctgagtaacatggcaatgattaggtcttgagcaaaagttgatataactcttttctgacaagtgcttacctgggtgtagttagcaacgcgtgatatcagctggttttcgtactgtgggccgctctctgctgctgactggtttgaggcaagatagtgaaaaagcagatctgttgttccagcacttacgacgaatgtagccctcctgactagttcttctgctcttcttcgtccaactaacctctgcaggttccttttgtaacgccaaaggtcctctatttggttgggaaatgacagtgcattctatcatgaaaaaggaaagaaaacctgtcatgacagttcattctaccatgaaaaagaaagaaaacctgtctagtcactacccaatgctggccctcaataatcaaattaacttggactactaagtagtcatgattcacatatcaaactaggttgatcatgcattatctgcttggttatccaattttgactactaaaaaatatttggtagtagcttctaattctgtccctggcagattgatttaatagcttttccttactttctgacggtgaaatatttgtgctttgcaggttatgcttaccgaacttctggcagtggcctcgtcatacccggaacctgctgatgcaaaactcacacccctcctgagctgtcctgacctcaaccttgggtcgcggaatcctggaatactcctcgctatacctagtttttccgctgcataaccacaaagcttatcctcaaatatccctactgaacaatggtgaacaccactactaactcaggtcaccttctaaatcaaagcacatctgctcaactctgaaatacttgtgtaaatggagatgcaaggcaatgggtgtatttgtgtctgtaccgagtatgtccgtgatgagccggccgttgctgaaccggccggtgggcctgccgccgaggaagtcggcgccgtacggcaagaagttggccttcatcgccgtctgcagccggttgttgttgccgggatccaccgtcgagtcaccgaacaccagcatggtggtacacccggtggtggtgtagttgatcaccctcgccggcggtggcggcactgaagaccagcccggctcctgcggcggcaccaccgtccgcggcggcgccggctccctccttggtggcaatggagactgccacggctgctgctgctgctggggcggcgttggtggtgctggctccggcgtgtcaggctcctgtgatggcggggaatccggcagcggcggctccggcgaatcggaataccccggcgacggtggtgacaccgggagcccaggcatgggcgggtcgtcgtattggtcgtccggtggctgtggcggtgacagctgcgccgctgccattgttatcagggagaagtgccatgcgacgaggagcagcgccgccgcagccaccgccagcctcctcatggacttgctgcgttgctttgctcagttcagttatgtgctagcttgtcaaggtccaaagacaagagtgcatgcatgtataaataaatgctcagctaagtaaaactgccgttgcctgtcaaggtggcttggtgccatgtaggtaagggagcgactaagggtgtgtttgaggattggggagattggggagattggggagattgggaagatacgcaaaacgaggtgagccattagcacatgattaattgagtattaactattttaaacttcaaaaatggattaatatgattttttaaagcaactttcctatagaaattttttgcaaaaaacgcaccgtttagtagtttgaaaagcgtgcgcgcggaaaacgagggacaatctccccaaacactcacaaacgaacggtgcctaaatttgcttaagagttcgagcttgctttgtgtgacatgactaaatttagaagacattttcagtgaaatcacccacttgttagtggccagtgggagattaatcgggagagattcttgtaaaaaaaaaaggagatcggaataaccaaagaggcacatactgcaaaattgcaaagaagagcaggtggtggttggttcagtggtttgtgtgatctttgcgtctgccatgcaaattcgctcttctagaacaatcttctttttttcttttttttccagcgaaaaaggtactgtgattttgtatttcctccttctatagtcaacaacagatgtcaaaatatgcatattcttcctccggtaaaagaaatacagcgtttcaacatttttcagttcgatcttttaaaattttgatcatcaataatttttgaaatgcttattttgaaaatataaaaatggtcaatgtagatttgttatgaaaaaaaatactttcgtaatctcataaaaatgatacatgtgtagattttataagtacctagccatgaaattgattttcttccttcacaaggtagaaccgaaggtaaatactgaaaataatagcaggagagttttcttttaataacaattctcaccatcatggcatcgtctgcttcaaaactagtactcgcaaatccatattcctctagaaacaagtaaacaaatagacatgtcacaccaatacacccaattgtttactcataagggattactcgcaaattactcgcaagaaaattccatttattatgccaaaggacatgagtgtcaaaattttgacattaattaaacaaaaaatgcaaacatttattatgccaaaggacatgagtgacaaaattttgacataaatgcaagagcctcagctagacaaaattgtcatttacaaaagagagtcctacatttattctacgacaaaattcaaaggaaaaaaaaactcttctaaatgtctatcctatcctaaccttggaaatgactgaaaaacaaaaaacccaacttcttcacgttggaatccggtctgcccacctataggcctgtagggatataaaccttcaaaaaataattgaattcttcatacctctaaattctaatatgataatttttgtatactgtatgatcttttggtatcatgtcatgcactctaaaacctaagaaagatgatctaaataaataaataaataatgaggatcaatttccctcatgcttcggctgcttattgtcattagagctggtgccctgctccaatgaggccttcacaaatctgcctctgacacgccttcgcgtgtctgctgttgccttgcgggaggcgtacattatctgcttgacaaacctgaaaaattcaaaagtgtaccagcaacttgtaattgcaatcttgtttcaaaaagctcgtactgaacaaaatattattcctaggcaactaaataatatttcagatgcacatttgagaattttaactgttctttctgaagactaatctgcaatgtaagctacaaagtgagacgaaaaatgcgtattgatacgtacctcctgttgctctttttctccttgtatctctgcacagctcgctgtctcttctccggatcagggcaagatttctcgggcagcacgatatgcgaggtctgttgatcttggccgtcaaacatgtttgagctcccacccagcagcgagcccgtgttggagctctgaaaattcacacagggaaactctgaacctgtgttgttgttgctactgtttgtgtctatcaccggtaactgatcatatgccgtttcgtcgtttatgttcagtggttgcagaagactatgatctgaagattgcggtatgagctgtgcgagttctgaagatgaagttgctgctcctatctcgttgttgatgttcgcgtccatcatcggtaactgaacataaggtgcgttgctcatgttcagaggctgcagaaagctagtatctgataacagtgcgatgtctgaacacgatgaggatgccatttgctgatgatcagggtccagataggatcccaaatcgaaataagaaggatccaaatccagataagaaggttcctgcgatcaattgaagaaaacaagtttgtgaggcggcatcaaactgtacgataattttgatgaatttgaaagggggtgaaataagcagaaccatcgtttacttgcaatgctcctggttccattagtgcgactgaatcaaacgagtttgtccaggcttgaaagtaatcttgctgatttgcattgtcaacaagtaaatcttctccacctattgtcgccatctctttactaatgtcaggattcgcatcttcaaacatctcaaatgagacatgtgtgtatatatatattagtatgcttatgttaattgaatgatggtaataagatgatatgttagtcatataatggaatgctatatattaatgggattgatcaagggatgaattaggtaaggaaaagaaatgcaactcacttttgtttaagaaggcagatcacttagagatttaagagtttaccattggcttcttttaataccagatcacttatttttaataccagatcacttagagatttaaggaaagaatgagtttaccattggcttcttttaatacctcgggataataacaataatttgtatagctcatactattgtcgtatgggacgaatgggagtgtgtcggtgatccacggctcatccgtcgccgccgccgccggcggcggcggcggtgccggcacgtcgatagagaagatgcgggccatctcggcggggccggggataccggtgtaggcggcggcggggcggtggcagtggcgcgaggcgtcgcgcgcgcacgaggcgcagaacgcctcggcgtggtggtcggagcgcgccacggcgggcgcggcgtggcacgcgtcgcagagcggggcgcgccggtgcgcgcgcgcggccgcggcgtggtgggcggcgaggtcgcagaccaggcagaggcgcgcgccgccgtgctgggcgcagtgcacgacggcgcgctcgccgcggcacgagtcgcatgacgggacgacggcgacaccaccaccaccaccatcatcgccggcgtccatcacgacgtgtatcgtgacgacgacgacgacgatgacgacgtacgttgtcagtagcacacgcatctaggcggcggcggccggtgcgcgccgcggtggcggccaccggcggcgatcgaggtgagcgtaacgtggcggacgagggtggccgcagggatcgttggatgggggatcgatggacctatttatagccctcgatggatttagtgtgttaaatatagtacggagtagttagcaacagaactaacagaccgacgtacggatcggttcatcatatccaccgactcaaacacgtcacagtggacgccgatacttcgtttcgtggtacgtacgtttagacacgatcagtttcgttcccaattataggaaaggttttcctttaaaaaaaaattagtataggagagcacgtaccatgccgtcttttaaggttcagttttattttatttttctgataaataatccctctatacaattatcaataaaatcaggtcatatctttgttcgttgaaaagatatctcctgactttgtgtagtttacagttataccacggaccccactttactatagtccacatgttacgcgctggaaagcgatctcctgattttgtgtagtttacagttataccaccaacctcacctacatgttactgcaagtcggccggtctcttcattcgtctccgttcggtttttggttttgtcgccgtttttcttttcaatccttttttttttttgcacgtggaagggtttttatgggtggacccgctttactcccgttttttttaccatccggtagttctttcgtcgctggtttttccttcgatctccagccgccgtggagccgaaccttactgcaacttcgatttgcctctcgatgtttcttcctccaattaattaaaaaatcgattatccactcatttctcattattttctccatgattttgtctttcaattcgacttaaatttggaaaattatatccctatttaaccgttagtggccgtctttttcccgagttttttcaattcggctttaaatcttccctgatttccccttttaattcgggaaattcaattcctatctagagcaagtacaatagcaggttacaagtcaactataagcacatatatgaagtagaagagaggagagtcacggctttaattcggggaattcaattcctatttagagcaagtacaatagcagaatacaagtcaacaagtaaactataacaccatatgaaagagagaggagagagaaagcgtgctacagattggtagcgagctactacacggattccaaaagttatatgtgtataagaggtgagactatatattaataatatagtaagcaactattgtatgagttgactattaaattggttataaatgatttggatttagtagttagctatactattaaacttttgctcttataagtaactatttgatagaatgagctattagattgactatagatgatttggagccagtggttggctatactattaaacttcctctcaaccatttggagccggtggttagctatactattaaaacttgggagaatttgaaccatgccacacaaaattttgtaaaatttgtgatatgccaccctgacccacatgtcattgactcatgtgggtcctacatgtcattgagatacgggtggcatatctcaaattttgcaaatataggttggcatggttccaacaaacccaatccgtggtagatgatgtccggcaagcgagcttcctggccatctttattcccgagttttacatattttgattttggaaaaaaaaagggaaagagatgattgagtggatcaaaagccctaaaccaattttaaattttaataaataaagaaagatcagaggtgattgagtggataaaaaccctcaaccaatttaaaaagatcaagaatgatccaattttaaaacatctttgccgaatttgatgggaatgatggcatcggcatcggcatcttatggacagtatgtgcgagctgagccggcttctctcgtggactggccgtaaagagactgaaaatcgtggactgggccgtaaagagactgaaaaggaagaaaagattgggctttagtccaaaccgggactgaaaatgaagaatttattagctttcagtaaaaaaaatatttttcaatttatttctcacctcccaacaactatatattctatttctgaaaaaatatctttacttattacaacgactgacatttttcatagcattagagaaaaaaaaccatgcatgattatgtgttgcaaatgctccttactcccgtagcacggatgaatgatttacgggattcagttttatctaatttttctcattttatctgatttttgtatcgagttcttgtttatcgtaagaggatttagtatgaataatttcacattataataggtgtgaaataaattctctaaatcaccctgagattaactgaacaaaatcacccctggtgtgaaattaccctcaattattttttgtgtgagagattaaccgagcaaaatcaccccaatccttttgtgtgagagattaaccgaactaaaatcacccctcgtgtgatagattaaccgaacaatgcaaaatagaaaaatatccccaaccatatatactccctctatttcaaaatgtttgacaccgttgactttttaacacatgatcgttcgtcttattaaaaaaatttgtgaaatatgtaaaactatatgtatacatcaaagtatatttaacaataaatcaaatgatataaaaagaataaataattacttaaattttttgaataagacgaatggtcaaatatgtacttaaaaaatcaacggtgtcaaacattttgaaatggaaatggagggagtatggattaagaaagacacgttaaggatacaaggaaccctaacaaacattgtgtctcaaaacggcagcaaccaatcgtagacgcgatgatggcccacgtaatctgatttggttatacaaacgtgttgccacactgtggcagcctcctcctccgtgtacttgtgaacgctccagctaattttgtcatacacgcctagcacactagagtcagtgtcataacgcaagctaccacacgtagctgataagtccgatcgtcgccgcgcgccgcgccatggtgccgtcgttcccgcagccggccagtgcggcggcggcgacgcggccaataccggggagctacggcccgccgctgctcggcccgctccgcgaccgcctcgactacttctggttccagggccccgacgacttcttccgccgccgcgccgccgaccacaagagcaccgtgttccgcgccaacatcccgcccaccttccccttcttcctcggcgtcgacccgcgcgtcgtcgccgtcgttgatgccgccgccttcaccgcgctcttcgacccggccctcgtcgacaagcgcgacgtcctcatcggcccctacgtccccagcctcgccttcacccgcggcacccgcgtcggcgtctacctcgacacccaggaccccgaccacgcccgcaccaaggccttctccatcgacctcctccgccgcgccgcccgcaactgggccgccgagctccgcgccgccgtcgacgacatgctcgccgccgtcgaggaagacctcaacagggcccctgaccccgccgccgcctccgccagctacctcatcccgctccagaagtgcatcttccgcttcctctgcaaggcgctcgtcggcgccgacccggcggcggacggcctcgtcgaccgcttcggcgtgtacatcctcgacgtgtggctggcgttgcagctggtgccgacgcagaaggtgggcgtcatcccgcagccgctggaggagctcctgctccactccttcccgctgccgtcgttcgtcgtcaagcccgggtacgacctcctctaccgcttcgtggagaagcacggcgccgccgccgtgtccatcgctgagaaggagcacggcatcagcaaggaggaggccatcaacaacatcctcttcgtgctcggcttcaacgcgttcggcggcttctcggtgttcctgccgttcctggtcatggaggtcggcaagcccggccgggacgacctgcggcggcggctgcgggaggaggtgcgccgcgtgctgggcggcggcgacggcggcgaggccgggttcgcggcggtgagggagatggcgctggtgcggtcgacggtgtacgaggtgctccggatgcagccgccggtgccgctgcagttcgggcgggcgcggcgagacttcgtgctgcggtcgcacggcggcgcggcgtacgaggtgggcaagggcgagctgctgtgcgggtaccagccgctggccatgcgcgacccggcggtgttcgaccggccggaggagttcgtgccggagaggttcctcggcgacgacggcgaggcgctgctgcagtacgtgtactggtccaacgggccggagaccggcgagccgtcgccggggaacaaacagtgtgccgccaaggaggtggtcgtcgccaccgcgtgcatgctcgtcgccgagcttttccggcggtacgacgacttcgaatgcgacggcacctccttcaccaagctcgacaagcgggagctcactcccagctaagctttgctgccgccattctctcactcgatctccatgcacatatgcatgaagaaattaattaaattcaagttgctagctccattttttctctttgagctgctgataaaaaaaacatctctattcttctgtgcaataagccaataattaagcattaatcagagcgtacaagtaaaaattgttttcactgttttatgtggatatatatatgtacagggatccaccaaaattaatttgatactacgtagtacgacatttgtttagggatcaacgattcacgtttcacttttttttacagcgtcaacatatataaacacatagatatgagagtatttaatatacttattactgacatactcgcttcgtcccataaaaaaaaaccaaatcctatgtatgaatggagtattctagtagtacagtagtgtaaaaaaccgccaatagattgatcctgaatttcaggtcaaggagacaaagcaactactccatagaatcatagtattaggatatgtttcatccagtaaaaaaatatatttgaagatggggagtaagaaacacgaaacggaaaaacgagtgaagaagagaagacatttcagggtctgcttgtttctgatgccaaaagcatttttttagataatgccaaatgcgtggacagaatgcttgttctaataccaaatgcatggacagaatggttgataggtatctgcttgtatcttgctcgatggaaaccgcatggacagcgacgcatttcttctccttttgcatgttactactgaacggttgacacaggatatattactggcgaaaaagtacatgttaacatgggttcaaacagtaacacgcatttcaatcaagtgtgcaagtgcaaacacaaaatgatcgtctgtaaccgtagcgcgtaaacaacaagacgtacagttatactacctccattccaaaattttgacgccgttgacttttttaaaaatgtttgtccgttcgtcttattcaaaaaatttaagtaattgttaattctttttctatcatttgatttattgttaaatatacttttatgtatacgtatagttttacacattttacaaatttttttaaataagacgaacggttaaatatatttaaaaaaagttaacggcgtcaaacatttagggaaggagggagtatatgccaaacatatccctgtatggctatattgattggcaacaaatacagtactattgatcccgtgttgtgccaaccacaacagcgacaagtatcctgtcaatttgtggtgctaacaacttgccattgataagtccagattaactagaatagacgcaccaaggcacatacatgtaaatgctagctcctggataggcaaaattgatccaaagaccagctaaactgccaaatcgttgggaaagtttacataaatgtgtctcccttgcaggtaaacaaaaacatatagtgagctgaagaaggctagttcttcgtgcaagagatcagctgtgcaatcctcataaaagggatcggctgatcatagctgatgaagaaaatgaatttgttgatttcatgaataacagtggcactaaaaggcattctgaatataaatgaaaaatacagtgttagaaagacaccaaaaacaaacaaacaaagacttgcaaggaaaacagtacaagacaaacagtcaccatagttctacttctttcacatgtgaaacatggctaggaaaggaaaatgaaaacctagacatgtaggaattgagtatacgagaattgccatggtttgtaatttgtactctgtagtttgtaccataggcattgcatttattcatttactatggcaagagaagaacagagaaccaagagcagttcaagaatagatagcagtctgttagaggagcgagttcaatgcagaagagaagttataatcaattggtatggaaacaatggatgtatcaaatggcatcggaaaatgtcgttgctgcactcacatatctagctacaaaaaggacagatggcttgaaggaggagctagctacgtacatcatgatggtattattccaaatacaatctgaaacaggtttgtagcctgagtttaaatgataaaaaaaggagtaactgaatataattttaaatggttggtttgccaagtcagtaagctatacaagcacagcaatgtacaaggttatgaatatattaccaacaataatctgtctcaatgcagaaaacatgtcgaaataacaaagcacgaatgaacagagcaacgtctgtcatacaaaaaactaaaatttcttgtgtggtcttagcagagccacttatagccaacccaagtacagcgaaacgtagtcatggcagcttaatttctcaatgaaattcataacaagcacatgttcattgattattaattaaacatgttttcttttgctaaggcaggtaaatgtacctgcccatgtttgcctctatattggaattaatttgtttgttttctttccatataaaaaagtgctgggaagcttctattgcatttgtatacacttcttatatattctgtaaattagttaacttattattattattattatctcttacttatggaagaaaagtaattaaccaatgttgcgtgtcctcacaaggatgtgtttgttctagttctcgtaaaaagaaaagaaaagaaaaggaaaggaaagagaggaggtgggtttggcccaactagaaaggcatctcgtacgtaagcccacttagcccaactagagaacgttgtaggggttgcgggaatcaacagccgccgggagaggttaattagggttccaaacttgcatggagcgagagatcgagatgagcgagatggagacgggtaaggcgatcgagttggtgttgaagcggttggatgaggtgcgtacgcgcatggatggggtggagaagctgttgcgtatactcatctgcagggaggagaagcgagcgaaggttgggaggaggaggaggaggtcgacaagatgcagatggtgacggcggcggcaggtggcggtagcagcagcaggaggaggaaagccatcaagagaaactttaaggctaaagaagcagaccgcaaggagacggaagaggagggcaatcaggtgaagaagatcaccagccagcagctgtaagtgtatttaagtactccctccatattttaatgtaggatgccgttgactttttaacaccactcgtcttatttaaaaattatatgtaaatataaaaatacttatgtcaaaaattttatgcaaatataaaaatacttatgtcatgcttaaagaatatttgatgataaattaagtcgcaataaaataaattataattacataatttttttaataagacgaaaggttaaacgtttgtaaaaaaatcaacagcgtcatacattaaaatacggatacggatagagttttatctgtaccgatggatgatccgatccagctattatccatcatccattctgagtttattggtaatgatgatactactgatatggtcaatttaaccctaactagttagtataccaatgttactatgtgatatatctgggcctcccaaaaggaagaggaagaggaagaaggaagaagacgccagcgagaagaagaagaagaagaagcggcagacggaggaagcagaagcggagaagaagattgaggcgaggaaagccaaaaaagaggcgtacgagcggtacctggcgaatttctttgattttgagcccttcccacgcacacccgaccacatcctcaacgagatgcccgaggaagagcgtgccggagaaaatcaacttgctgccttcgctgatagtattatggaacgtcgcaggctcctataccagagatgcatcaaggactacatggacaaggacaaggacgatcacgaatagcaagtgtcttcgtctgtctgtgatcaaagctactactactggagtatcctattctgagttggactgtatcgtatcgtctcacttcattatataataatgactatgtcatgatcgatgtaatcggcactgagatatattaatattaactactccctccgtttcaaaatgtttgacaccgttgactttttagcacatgtttggccgttcgtcttattcaaaaaatttaagtaattattaattcttttcctatcatttgattcattattaaatatatttttatgtaggcatataattttacatatttaacaaaagcttttgaataagacgaacggtcaaacatgtgcctaaaaagtcacggtgtcaaatatttcgaaacagaggagtatatattagtactaatatcagattcttctactgctgacttcctgaatgagacgaacattcgatgcaaaattagagaatggttggtagtacgactgagatagtcagatagatgatcacgttgggtgtgtgtgtttgtcttggagggctgaaaacgacagttaagcttagacctgctggccgccagctagactccattgtttcgcttatttgcaaacagaaaataatttgcaaataaaacttttatatatgtgttcttagtgataaaatgcaaaggctgaaaaaactacgattaaaaaaaacctcaaaatcaacttaaggttgttcaattttggtttataagcatacgcataagtcaaaagatgaggctgttagtgttaatttcccagtggccaacaaactgtttttgatcagtgaagaaattaattcaaatgaatgaatgacggagtattggagcttgcacacttaagtatcttagttacataaatgtacgagcatctccctcacagctaaacaaaaacaacgcaaggctagtccttcagttctcatgcaggaaatcagctacgtaatcctcgtagaaaggatcgagtttgaaccaacgtaatccttataaccaacgtaatcataactaagaacagtggcactaaatgaccacactctgaatataaatgaaaaaaaaaagcaccaaaaaagatcaagaagaagaagctgctgctttcaaggaaaacaatacacgacaaatagtcaccatagttctttcacatgttaggaaaaaagaaaatgaaaacccaaacatgtaggaattgagtatacggattgccatggtttgtaatttgtattatgtaccatagacattacatttactatagccagagaacagagaagcaagagcagttaaggaatagagaaactatcaatgggtaattcctacatgtttttatattagaggagcgagttctatgcagaagagaaactatcaatgggtaattcggtattggaaacaaacatgtataaattgacatcgaaaaagctacaaagaggacagatggctttaagaaggagctacaagatgcattccagccaaacttgaaacaagtttatcacctgagtttaaatgacaaaaaagcagtaactgttcctcgagttgaatgttcacaccaaaagttggttgactggatcacggcaaatgatggatatgaaaaaaaaaaaaaagggtgcagaaataccatcaaaatgacttatctttaccatggaacctggaggcaggtcgagctaaaaaacatacatatctaacaaaaatagtacaacagatacacatcatgtaactgaataaaattttaaatggtcagtttgccaagtcagtaagctatacaggcacagcaaagtacaaggttgtgaatatattaccatcaacaatctgtctcaattcagagaacatgtcgaaataacaaagcacgaatgaacagagcaacatttgtcatacaaaaactgaaatttcttgtgtggtcttagcagagccacttataaccaacccaagtacaggaaattgtagtcatggcagctcaatttctcaatgaaattcatagcaagtacatcttcattgattattaaacatgttttcttttgctaaggcatggtacataactaaatgtggggtttctaaaaaaagaaaaggtaaatgtacctgcccatgttgtctcccaggctaaaaaagaccacttggccaatagctcagcaagcaaaaacaaaagaaataaaacactgctcttcaattcaaaaggaagatagtactatcttctcatgaatggataaaccgctacgcacccatggcaacccgtttgcccctcttggatgttgatgatgcattctctgccaatatcctagacaaaatgtctgcttgctttgagtaccctccagcttttaagctgtccatcagggcatcgcaacccttttgatccacgacacctcctttgttcttgatcttgcaaagcatggagtatgcaggcaatgtcttctcctcagtgtacagggcctccaagactctgtcataggttgagaagctgacatcaaagtccctgtccaatgcaaaatcagccaacttatgtgcctccatcactttgtcattctcgcagagggcaatcagcaacttatctagatcaggcaagcatccattttccaccatcagattgacacggccgattgcttcctccacatggcccctcatgaagagagcttccagaatcttatgagccatgtccatgttctctgtaacccccttctcaatcatactcttcataaccctgctagcagtctgaacccggccactgttgaaaagcgctaccatgacagacatgaacagggatgggctcggtacatgcccttgttccatcatactgtcaagtgccgtctttgcatcagctggctcattcttcttcaggaagctatcaacaagcagtgcatgcgattcagggtcagtacggacaccacggcgtgtcataatggcaagaatctcctgtgctgcttctggcacaccttcctttgcatgcccacggataagactgttaaaagcagccttgtcatcaacgcctttcttcatcagctgcctgaagaaagtctcagccttgctggtgttcccattgctgcacaaatactcaatcactggattataagctggcccttcaagcacagggctctttgggctcaacagtgtccccttctcaagaagctcatccatcacctcaacagcaccatcacactttccacccgcgcacaagctctccatcagcaccccatactgtcttggatccacaagaacatgcttgaactgcccactcttctggtgcacatccaacgcaccatccaagtcacccgctcggcatagcgtcgtcacaagcctcaaaaacactgacttgtcctttggagtgagccgccgctccgccatgtcatccattgccttccgggcctccacaacccttccctcatcatcacagagccctggcatcagagcagcaaacgtcttctcgctcaacctcaaccccttctcccccatttccgagaacagccccactgcctcctccaccttacctgcttcaacatatcccttgatcatgacattgtacgacaccgagttttgtgcaaaaccagctcctggcatttcgtcaaacactttgcgggcactctccagatcacccgcccgaacccaagcattgagaagagtgttgtacgtcgtcacatccggtgtcaccccgtgatccttcatgtccccgaacaccctcaaggctgcctccatcttcttgcacaggccgaacccccagatcaatgtgttgtaggtggacaggtcaggggtgacggcgtcggcgatcatggcgttgtagatccgcctggccatggcctctcggccgcggcagaggatggccttgaggacggcgttgtaggagagcgcggtgcgggcgatgccgaggtcgggcatcaagcggaagagcttaacggattcctgcgggatgttggccttgccgtaggcggcgatgagggcggcgacggtggcctcctcgggggcgatggagaaggagggcatggtgtcgaggaggatgcagcgggcgtggttgagcatgcggtgggaggcgaggatcgggatgaggagggagaaggtggctggctcggggctgaagccggcgcgacggtaggcgaagcggaagaactggagggcgaggtcggcgcggccggcggcggcggccccggagatgacgccgtggacgagcggcgcggcgagcgtcggggagagcaggcggatggagttctcgaggcgggtggtccacgggcggcggcggatcatgtagaggatggtctcgtggaggggctcctcgcggcggggcgggttgggggtcgccgccgccgcctccgccggcgtcacctccggcacagcctcggcctcggcctcggtctccgggggaggtggttccggcgtgtcgagggtggagaaggcatggcggaagagaggcgcggaggggttgttgcgggagaggaggcggagggggaggtggaggtggtggcggcgcgacatggctgcggcggcgtggaggagtggagctcggggagaagagtcgagggtttaggaggaggaggaagaggctcgacaccacccacgctaaagagcgtgatgggcccatatttaattgggccattaagtgacttgtggttctgggccttttagaacccagcccaacacggcagtgtagaaacaagggattcatacgggccgggctcaacagtcaatacgcatgcaaaagatcgtgatgggcctatttttcattgggccgcgcgtcatgataatttgctttgttgttctattattgaaaaagtacacccaaggtctctcaatttgtcatcgaattataaaatcatccctcaactgtaaaaccggatacaacgcatccggtttgggtctccgctcggtcggctacgttgctatcatcacattcttgtagccaagctggaatcagcatcacattatgtaactagtatacagctaaacagtttaaactggtaaaagaaaaatctaggcctcttttgaaagacaggattgcacctaggagaagatgcctaagtttctagtgtgcgatcgattcgaccaacggtgtacttgtagaatgccaccaactccacggcagcaaatgtagagagcacacatagcaagaagatattgagttttcttgcatagtaatacttgcacctgcaggtcaaatcaaatcggatacatcaaataataattaattagagattgtgtaagttaattcgtgaagagttaactaattaattaccagaggaggtcatctgggttgggcttgacgtggccgatgagtttgcagaggagctctgcatcaatctgtgcctccttgctacgtttcttgtattgccaattcaacgtagcaagcttgtagaacagctcttccttcttctgcttgacctccagcttaagggcctccacctcagctgtctcaagagcattcggaggaggctctacatgacaccgccatgaatgctgtcgttgcacacacaaattaattagtaattagtagtacttgaatgaaattaagcttgtttatgagcatggaattacctatccacttgtttcttgtgggcacagatgtgcttgtcttgatgcaaatgattatgcaccaaataataagattgaaattgacagaacaactaaagtctgtaataatttagacgaggagggtatttgaatgtaataattttcagatgagaaaattaagtaggggaagcatgcaatcgagggggatttggacgatgcgaacctttggtgttgatggtgggtgatcggcagcagcatcggagctcatcaaccgccgaaaagtagttccatacgaggacgacgacgacgacacaggcgagccgccgccgccgccgccgtagataaggccttgcaacagccgccgccgctgcccctccgcctcagcagccaccaccggtgagccgcctccaatattcatcgaagcgcggcgtccaccaccgccggcgatcttcctcgccgcaagccgaagcgccgccatcgccgccgccagcttagctagctctccctacgtacgtatatggtataaagacttctccttataaatataccagtaggtatcggtatcgtattagtcaccgcttactcaaattttagattccaaagctatatatactccaaataaatatgaatttggtaaaattcgtcaatttggattctcaatagcgtttagtatggatttgatttttttcgttaatttgtctgtctgtacagcagcagcagcattacattacatgcatgcaactaatttggtagcctatctagctaattgaagaagatggccggctccagccgtggctccgtcaagtccaccaccgtctcctcctccatctccggcgatcgccaactctctccgacgctgcacttcacggctaacctagtgctgtgcatcgtgtcgccggcgctgctgcttctcccgatgcgggtgaccaaggtggcggcggcggcgtgcttgcgggaggaaggagcgatggtggcgaggatctggacgacctcgctcatggtgggacgcgactcgggctcccactgcaggcactcccgcgccaggtgcgccatgatctgcatctcctcctgcgggaaccgcccctgcagcgccgggtccggcagctccgccaccaccagccggctgtcgcgcagccgcggcgccgcccacaggaccaggctctcccccgccgccgccggcgggcggtggtggtggatcggctgccgccccgtgatgagctccaggatgaccacgccgaagctgaacacgtccgacttgagcgacgccttccccacgatggcgtactccggcgcgaagtacccgaacgtgcccagcatccgcgccggcgagctcgagcagctcgtcacgccgtcgttcatcaggcacttggccatgccaaggtcggtgatcttcgccctgaacttgtcgtcgagcaggatgttggtggacttgatgtcgcggtggaggatccgcggcgccgccgcctcgtgcaggtactccacccccctcgccgcgccgagcgccacgccgacgcgcgtcgcccagtccatggccttcctcccctgcttgaggtcgaggcagtcgcgcaggttgccattgcccatgcactcgaacaccagcagccgctccagctgccggccctggctctccatgcagtaacccagcaatggcacgacatggcagtggttcagccgagacagcagctcaacctgttcgaccaaatgcaaatcgaacttcagattgccgccactgcaaatgcaagcaaattggatgttcttgggatttgtcaatgagatggtactacctcggataggaactcgaagtcttcgtctgcgcctccgaggggcctgagcttcttcacggcaatgaccttggcgtcgctaagctgtccacggtacaccttgcttgttcctccaactccgatcagatgttcatctgaaaatttcccggttgcttgctccaattccgagtaggagaacctgacgatgacaccgggaagcggaccaccttcattgccacatattggattgcagctgcacagaaactctgcgacagagaattgaaaaacaagcaaggatcagtgtgctgctctgagtctgaatacactgtcctgaatcaaacaggctctgaatattggagcagattcagacaggcacaacatctaagaaagaaaattcagagatacatgctttgccttgacttacctttaagtacactgatccttggttttggctttggttggggaagaggagaagatcgatgactgacgaggtttgatctgctgctccagctggtgtacttatcaaaggagtatgcatgcgaatgtggagagagcgcatccttgcgacgcaggtagtacgccgtggtgccaaggaatgcaatagtggtgaggatcacacatactagcagtgtaactatcactgttttgttagagacgtgcttctttccttcctgagaaattcctggacagcatatgcacataaacattcagacattcagtaagcacagagttcatctgaacactcagtccacaatataatttatgtatctgaattgtaataccggatgtgcagttacaggaagtgaagcagcccctatcatgtactgcagtgtgttcttttttaagggctttgtcagaagcacatgtgcagttccatgatcctgtgccaccatcatcatctgctgcagagatatccgactaaggcgcaatgcaattgtggactgttcatagagtacatgatcaattgttcataccttgtagacaatggcaggaagaagaacaattcgacgacaagctgctatttgagtttggttcacctagtggatgagctgtgcatacacatgtccagcttgttgttccaactccctctgcagtgccatctgtgcaataacaagtgtacacatcttatatctcataactaccccttccagttcataagcatcagcatgcaacaaattaaaaagataaataaattttgttccatgagaaagtggtgcttaccactcgatgctacttggatcagaagtacacagctgagggaggccaggagaagtttcttgtgtacatccatcagctggagaatggggaaaaaccatcagattgaacccatctgattgctatgctctgaaaaatgacaaaggcatgtttgaatacatcatttgtttgactgaaatcgaagacaaaattgcctcgatacatgcaaagcactaagaacaattccagatgcatattaatattgttagatggtacatggttgactggctattactatcaaattataccactacacatccagaggaacatataaaacacaaaagaattaatatgaacaaaaataaggtttacttcttataaagtaatgcattactagacagaggtgcaaaccattattaccaattaaaaatacctattaaatgccaagctatgattaacaagtagcaacttgaaggaaaatggaggcctcagaggtttacttacaactgacttgacttgttaacgctaatcaaatccagacgaagcgtacgacacagacatgatctctctaaaggttcacaagaaaggctgtgtttagtttacaccaaaattggaagtttggttgaaattggaatgatgtgacggaaaagttagaagtttgtgtgtgtagataagttttgatgtgacggaaaatttggaagtttgaagaaaaactttggaactaaacacggccaaagaaaccagccaaatgtacaagaaaggactaatttgagtttcttcaaactgtgtcctggtccaggagtagaacacgagagagcaaacagggaaggcagggagagagcgagagatgaagttctaacttgagagttcagactaaagtctggactaacaaagaaggctgcttatatgcaggcaaggcattccaagaaagagacagaatctatcaacaatagtttttcaaatgtgtgcttccaaaaaaatggaatttttcaatcatagcattattataacacattcactgcagcaccttccaagacaggagacatctcaacctacagcaccactatgcacagtaggaaaaagaagtaacaggcctggaacgagcaaaacagcagccatctttttccatgctacaaagactcgagattgcctgaacttaggtgtggtgtttgaatagagagattcatttcaaactatggattaaaacttgaaatgacatctgacctaagatctcgaatgtgatggagggcaagtctggcggtgatcggtgatcaggagcctgaaagccacctgggcaaagaagattgttgggcattcagcacaaaaaacacaaagccataggtttctgtcggccaaggacaacgtggagacttcttgaagagattaattgttcattcaaagtgtttcttaatctgatggttacatcttaactctacctgcactcttatggatgtgtcttctgcaactaccactagagtctgatgcttaaaatatgttttcatcttggaagtgcgtaggagctagcttccatttcctagttctcttggttgcgtgattcatccaaataatcattagaaggctaaattggttgcaagatacacatcgatagcattatacctaggcatataataatatctatcatggacaaaataaaattattcggttggtaacttgactaactaccaatagtggcaagaataggattaaatactacaaggaaagaattgggaagtaataatataatatgctcattttttcccttttgagagacattttttcaagcagcatgaagacctgttcttcagatgccacaaaccagttacttttttcttgacaccgacactaaattaacaaacttaaatttgcttctaattgattacattttctcttaattgcagcagtgacagttaagctcggtaggcaaagatccaacaatatggtaagtactaattaatccgtaacaccattgtgtttaaggtcattgaccaaatcaacatggttagctactagcctaccacgtatcctttaaccggacacagctccttagaggggcgtgggtccctgacaggtgggagccagggccaccatcatgggcccacaggtcagtggcgcacgtccctctgacgtagcctcacccccaacctttcagaattagtatatccataacacatgcaggtcgcttgctagtatctctttcctaagatcgcatcaaatcctgtgttaaattggaggaaaacatcatcttgctttcattggagtaactgctggtatagtagtactccattagagcaggtacaatagcagttataaacatattttaatgagataaaagataagagagaagagcggactacatatctgtagccagctgcagcacggactacaagacgcagtatgacaggtaaacaactattatatgaattgactattagattggctatagataaattgaagctagtagtgggctatactattaaacttgctcttagagtatactggtattagctagagctagcttggtcatggcagaattgcatcgcagagtgagaattcttcgatccagaaccactgaattcatcctaaaatacagtaaaaaaactagtactactgctatcttggatggggtaaaaaacatgtattcacctgagagtctgtgagactgtgaccacattggagacctaagggcaagttttatagtagatgtgactaccacatccaatttcatgcattacatagataattaaattaagaggtgatatgtataataggttacctctaccacacaatccccaatatctctagtactctcacatgtttattgaagtttgtgtaggggctgccccttgcatgagaggtgactatttctctctcatccttcttctctcctccacctcactatttagtcctatgtgacatcttggagcttatacttggatgtccatagtacttaccctaaattacccttctgtattctaactaatcttcttccttttctttatatgctggcacagtgccatttccactaaagaatggatcacagttcaacacttcaactctctaggtgaaaaaaaaaagttaccgcctttcctcgaagaaattaaactacttcacccttcaggacgaatgattcttcgacgaggaagaggcgaaggtagatcggcagcaggcagtggacggcatcattctgtcagggaggaacagaagaaacaaaaagggagagagagagagagagagagagagagagagtgagggaaaaggcatcccaatgttggttagtcttaatccaaccctcggttgagcagataaggagtcatctgatccgtccatttttaggaatctgtaagcgaaggttgaaccttgaaacacagcatgattggagaagacgggcggtttggaatttctcaaagtgaaattcgaactcttctttttaaaaaagatgtgacatatcgaactcgaagcaaaatactgtgcaatttcctcgatgatgaggcaaggtcagcggagtgggttctagaattggcggctaccagatggatcagggttgagaagtagaagaagaagggaagagagcggtatgcagcttgccttgtctgaagaacaaattcaaggacacaactcactagaactgttgtattgatttgctgcaagaacctgcatgttttgagtttctgcagggaattctggaggttcaattcctacaatgctgaaactcctcaagattcagttcaaatccaaagtggggaagaagcaaagcgattcaagaagagccgcaatgtgggtgttaaataaacaccaagatgagaaaaaaatttgaagaacagaagcagaaaccgaaattcaggccaaaaatcatcatcaacacagtgggaactctttccggcaagagaaagatttatgcgcattgactaatactagagattaacagggaaggggggagacgatggtagggacctaacctcagacgctgctggttccatggtgatggagctccatctccaaaaaggtccaaagtggagagcctctctctgttaaattgggagtttggagtgagcagagcagaggcaaggcaaagcaggtgcagccttgaatgcactgtggactcactctgcctgctgggaggggaggacaagttaatgtgacatgccttacattaagagagaattattactagtgtgggagagagtatgaggcaatgggggaaacaaagtcagccgctcctccgcccttaattttgtctgaattccagttcactccatttgcatttgcagcgcactacgtacaacgcctcgcctcacggctcacgcacgacaccgcctccgaatcaaacctcaatccatccatggcgccgcatgtgcctcaccagtcaccacctcatcatccacgtacccgtcactcgcatcgcacgtctcatccaaacgaaaccgcgcccagtccaagtgaagaagagaaacacgaactgccaagtcctatagacttgtactactactactctctctttgaaacagtcaggcagccatggtgtgtctctcttttctgtgtttagcagtggcaagccatctcgttcagggcttcttgtgatcatagggcaaatccccttgccttccttcaagaaaaagaggacattcctcctttcagtctcaacaactcaacaaggtgggggaaaaaagaaagaatgaaaaaaaatgaaagcactagcagaggcctcagtttccaagttccaacatccacaagtcttcaaaaatcaaaataaacgtcgtaacatgcaccagcatgtgccactaagattaagcaatatacaaaatgcacccacatttccaactaaaaaaacactcacatttctgtaacaacagggttgacagactggatccaatgctacaacaggtcaactcattgacagtaaagccccttactgtcaatgagatagcagagacaatacccacatgtcagaacaaaaaaaatatcagcagcccatcatattatcttcagcaggaaaaggggtaacctcaacatttccagacccgtatcaacaaggtttgatatttgcaggaaaggtagactgattatacaagatggatattcaaattgatgttagcacccgtcatcccccaaaaaagaaaccccgacccactgtacttctattgatgtccgtctcttgctatcagaatactaaaggggttagatcgactataactcaaatcagttaactattgcactagtaacctacaatttgactgaaccttcctcactacgattcatcgtcagaaaggcacacaacctctgtgctggagaccgtccctctggcctcactagtcagcgcaagcctagctgttagccatgtattcagtgatgctgatgcagaagaacctgagggattgacacctgaaatttgagatccagcgtgctggcttccagcacctgcattcagtggacctgaggtcctgtgaacaaccgtgttcaatgacaggggtgccgtgaggctaggatttgaactagatgggagcacaaatggcagtagggatgctaggatagatggtcgttggtgctgatttccatgactcgtggcataaggtgacggcatcctaagctgctggagatgaggagagggagcatgcggttgtgccccagcagctctgtaggtgccatgtggcataggcattggtgtactactaaaaggtgatgatgacattgctctatacatattgccaggtaagattgactgcggttgggtagcctgtgatgatggttgaaccaccagtgaaggttgcacatatggtcctgatgaatgaagcacctgtggtcgaactgctgatgacaaggtaactggtgatgctgtgacttgctctgctacaatccttgcagatggttcctgagaagactgaaccagctgcccaattgtgggtctcgtggatccccctgcaataatcaaggaagaaatgaagtgttacaagcatggtcagaggattgcagaataaatatctgagccagcaacatatccttaattaaattgcctcagcttgcagatcgatgtaatgctaccagctaaggcagaaggcacatagcggtgttccagaacaagaagccacatgtatcagcaattgacattcaaaacaacgaagtatacagcatgcaaggtacatgaacgaggtaagaagaacatgcccaatacttttggataaagtggaacacagatactatgataaaaaactatcaaaccataaacttgatcttagggtttcaagctgaaagactagttatgaccaggacaatattatggaatacaatgggatataatggtaatatattgttggataccttgagctgcagataatggtaggaatttccttcgaaaattctcagccagtgattggtttataaagactttcctgtagatagtatcaagttctgcctccttctgagcgtaaaaagaatcttccttttgaagtaatgagtcatatttctgttttagcttctccatttcttggttatactccactaggagttgttttctctatacataagaagatgtgtggcagataagaaaattcacacaaataacacaaataatttaaagaaaaacagagggtgtagataaaaaggtgcaaaccttttgttcatgaactttactaagaacattgctggtatgttttaatctttccagctcatttttgagaggttcgtcactaaatctttgataattaaacactaatggtgccactggaagaggctgggtgggctgttcagaacttagtgcagagttggactgaacacctatctgattcatgtcttcagagcgtattccttcaagttggacagtctgtattgtggatgatagatccagttggggctgcaaatcacaagtttctgtcgtgcaagatcgctgcactaagtttgctcttgtttctgcagatcgctcttgcattgaacctgatggtagttcagactgcctttcatgtgttgtttccatgcacaaagcacccgttggttctactcctgtctgcagatcccatgaaggcactacactttgatgggcagtagtaatacttcgtggcacaggaataccagacagatcagtcctttcaaatggagcatcctgtgttgaggttaatctctgtgtctcacattgcaaattctgagctgctgcagcactcaacataccttcttgatttgcctctgcaagttgatttggcactggggttgatgattgcattaaaggctgcaaatcttcagctgcagcaatgcacaatactgctcctggatactgaccctgcactgagtttggaggttgcatttctggctgtaaatcctgaattgctgagctcgacataccttcttgttccagctcttcagattgatcctgacctgaggttgatggctgcatttcaggctgaaattcctgagttgcctctaaacctacaggacttgcaattgaatgtcgtgaagtttctggactttgttgggcagggtggcttgtattttgttgtataggtatatttgattgacaagtctgagtttcaacttctgtcgaaactaccaaggcagctgtttcgtgaatgatgtaagttggagattctgagtgtgaaggctcttcggcaacaatgtcatcaactacaactccggtatcaagtaaatgttgttgagttgttgcaccttcctgcaagaaaacaactgctcgatctgattgacaatctgtttgacttatgttgttactttcaagtgaagcatcaaacaatgaggttgatggttgcaattcaggttggaaattctgagctggctgtgtggtaagcaaacctgttcgttctgcttctgcaggtggaagtggtgaaggtgctagattttgttgggcagacagatctgtgctctgttgggaagacatatttgatatatttccctgacttccaacctcactcaaaccttgacatataaccaggctttgtggagtagcaaagattggagattccaaatgggctcgaacatcacaaacagtgttactatcattagcatcaactatctctcgagcatctcctaaatggccacaggtttcacctctctgtgacagaactgtttccagctgatgttttgtttgactgtcgtcatcagggtgcatcctttggagtgaagtctccagcactgaggctgattgttgcctttcaggctgcacatctcgggctgtctccctgctcagggtacttgctggttctgcttctgcaggtggattttgtgaagatagtgaactttgtacgagtggtacacttatactctgccgttcaagcatacttgattgatcagtctgggtttcaacttccgtagacaccagcaaggcagctggtttgtgtgcagcagtataagattgtgtctctgagtcaagtggatctgcagcagcagtgtcatcaacttttgctgtaactccagcagtagcatcaactgaggttaaatgacaggaagtagaaccttcctgcaatgggctagttgatgtatctggttgatgaactgtttgattattattatctgggcacatccttgcagatggagaatccaatgttgaggtcgttgtttgcatttcaggttgcacatcccaagctgttactcccaaattttcagtcagttttgcttctgcaggtggctgctgtgaagtctcaacagtctgtgagccaggcaaggttgataaattagattgagtagccacttccttagaagctgggaaaatcgtgaggttttgtgtagaagcaaccattgttgactccaagttggcataaattccaatggcaggagaagttgcaactcccggcaatgtactaggattggcattgtccctctcaacattctcagtacttgtatattcactggccgaagattcctgagacatttaagggtgatcattatcatatgtctaacattagtaaagaacatacaactacaatgaacaccataataagtccagtacccaatggtacacgaaacaacagagcaaagcatgaagcactgatgaagcatgggcaactaaaaaatggccaatatgttaccaagtgttgaaagctgcaatgaattatacaagctgcatcaactggtacaagatggatgtgctttcaacaaacaaacagtcagtctatcctgcatagacagcaaataagccccactcttaatgcctcgtgcaccatgcaggacaggtaggaagcatggtgattgttaacatgtaacatcaatatgaactgaatgagcaaaataggtgtataatcatttagtcaagtgtcatattagctataggagattaggagataaccaaaactgagcaatcttgctgcagcacccagctcaagcaagtcatctgagttgtggcagccccagttcagtacttccacaaggaagaccaaaacagttgcatgttcccaagtgtgaggtagaactgtagcatatttgaaaacaggggcatatggggcattaaattagtaaccataaagactatggctcctaactataggatttattgcactgcagttaaattgttaatattacagaatcatcactaccaatgataagatatgcacaccacataccacacaaatgtcacatttgatagttccagaatcagaaaacgttccagagacagcaagaatataagaaacaaaatcttgatgtataaattggaaatgaccaatgcaatacctgattaattgaatcatcatttgaaggcctaatactcggtgatttagctttttgtaagccaatgccatcaggactatagcaggtgttgttttctggaaaatcaactacttctggtgctggttggccagcgaccatgaccacttcaacagaaccatttctcactgtctgtgcagaaatgggttctgatggaactacattccttaccagtgtatttaccattttcaatctatcatgacaaagctgctgacaatctgaaacagcgcttccactgacatgggaattgctactttgttccttcaaatggatgaattcttgcataacaaagtttgaatctggtagagcaatctgctgatcaaaggtgtgatctaattggcctgattttgcttccaaacaaagtttttccttcagctgtcgctcttcagcccatgtattagattgcagtgactcaagtttgctgtgctggagtctcatgtgctccagaaatgcatacatcagcatagtgaaccactgaacagtttgttttattgtgtcatttcgggtctctacatcagcatgacttctacaaatatgttccagaactaaattgcacactgttttcagtctggcagttttattttgtgtgtatttctctaactctgaaatctgagactgttgtttatcaaagatacggtattctcttacagagaaaacattgtcaattaagttgattcttttctccacaatgtcaggaagttcatcagttgaaaaatggcattccatgtgagttcctggaacagctatcagttcctgctcttctgaaaccatttgtgcagcaacaaatgagccttcttgaagtgcaccattcatgaaattatcatgaagatccattctctgcttagggaaaatgtggtcatttctcaagatattagaggtctcctgctgtgaaggtttggtcttttctactgatgttgattgacaattgctgccagttgcacctgctttctttggaaattttctctttaggctgtcatagaccaaccttgccagctcctcattgcactcgtattttaaccttttttcagcaagggcaagtgactctttatgatccaccttaaagttatgaatagaggcaactcgccaacactgaaggaaagtatttacgagcattagcatttttggtcaatatgaatctgaaaattaaaagaacgacgatattgggggtggttattcgtaccaaagctatgttcaacgcatgaaatatgtactttggctcctgaacaactacatgattattcaaaagatattcaaagaactgctcaaccagcaacgtaacattgtcctgcaatagtaattaatgcgaaagcattaggtggtgatgacaagccaaagcaacagaaaaattacaaataatgagatcagcgttaacaaaggtaagagttatatgataaaaccaaaaaaaagacttaacaagaattattttttcccattaagagcaagtgtgactgaactgcggacagctggagtgtcagacacagccagcttttctacttcaggttttttcccctaatgtctcatgattcaaggtgttaatagttagagctcctttacagtggacttttgcctccgtaatctcttgactgagttttgagggctttttgttcacttatagcataagtgagctaagtccatgaataactgcacctctacaaatttttcatggttgaatatcttaaggatttagttgtggagaatcgctgcttttaatctaggttgatagcgctactctttatatgattgatgctactcttaagcttggatgagtgtaccgtcaccatcatgaacttcaaatttttagtaaagatcaaagaaagattccacaactcattattttcccacctttggggaaaatgatagtttagtaggaaacaacaacatccactcactacttcaatgagaacttgtcctgctattttcgctccattaaactgtattgtattcttcaaatatatttgatatagtcattacaccatgtaataggataatgtatgttattttctgtttatttgaaacccgtaggccatagcaatgcataagcacctaactagtacacatcatgcttgcaaaagatatgataggatagatatgacttcagcgcatgatgctaaagtgtatcataaggaaaaaaaattgacagagcttaggatatccgtaccggtagttgtaacaccttaattaatttcgacaactcttgcttcatttgggcatgaagattcttgggtgtactcatcaggctttccgacccttcagattgaactgtgttagaaaagtgcaatgtgcagccgcaaaagaaaaggaaacaaaaaatgctataggcatattcacagcacatgaaaatattattattattattaaatagtgatacctgatttttgctgcgtgacatcaactggttgaagagcagggccagatgtagtacaaatatcaggcaatgcatcatcgttacttttgtcagatacaacttttgaagatgaacccataatctcaccaacctttctatgcttctttctggcttcattgatttcttcagccggagcattgacctcatccatggtctgggactttgtaactcttgattgcagtggctcagatatacagctcacatgaggggatcttccatccaataaatttaaccagaactcagctggattatcctcaagcacagagattccctccttttcacccatcagagtaatatttcttgaatatagttccccactcatattagctttgcttatggacttcctgtgtacttcagtgctgtcttcaacagttgtggataactttgttaagaactcaacgattacttcatcaataaagtgtctctccatttcagaacttttacttgcatggtcatcttgctggacctcatcaagtctactgaagagaaatgcagcaccccatctgagtaaggaatgttttaaactagtccttagatcttgtatgttgttatcaataacaatgccctgcctcgcaagaacaagactcttctcctcaactgtaaaaggagtgtacaagcgaaaaatgctcacacgctcaaattgtgactctatcttgatcttttgaagagccttcaagtcgtttagtgggttgttgtcagaaccatatatgatgatggcatcaatagatgaaagcttaatgcttgggaggcacgcacgattttcaatcagaaagacaaatctaccattagtcttgttgttgaacttatcaattgctgcctgtttccttgacaatactgcacgatattcaacacgttcatatgattctgggccaaatctgtgatgcataagatcttccaaaatatttcccattttgtttccacctgctctatcagactgccatagtgcaaaaaaagaaggttcaagatatgctgaagtaagaaaataggaaatgctatcaaagtcacaggctccaaagaaaatcaagggaaaattggaaaagtataagagaaggggacactaactgacacttgaggaaacaagtttgaaccaagatgaaattatcacatattgttccttttttgctagtacttgttatgtgaaaaacaattcagcatgccatagcaacaccatatgctgccatgacttgttgactctgtagatactacttatatagccaagagcccaagacctgatggatacaccgtaagtccatagctaatgagtatgcagagaggttcactacaagggactatttatggtgttcatagttcaaaagctaatttcaacaacccaacttctaactggtaagaagtgttgttaaatatcatcagttcatctaacagataactagacatcttcttcgatgataaatcattcataacatagattaactaaggagtagaatactaaattgtttttgcaaagctaatttctagctagtaaaacttatcattgcataaggcagaagtaaaaaaaagggggaaggacatcagtattgacctggaaaagaagaatgacccttaaactcttcttcttgatctcgttaagcattttgtcgagaaccagtagcttgccacttgcatgcaccaccgtatctatattttcagttacattgctattgttgctaagtgagcttcgcagaaattcattaacgatgtaagggtgatcgcagcactattaaatgatgacaaggatcaaagtcagaaaacaatgtcgacaacttttcaggaaaaaaaggtaaatatacatgcagattgtatgtagattgactacttattatcatgtggccatattttttttttaaagtagacctttttgagagacagataaatatcatgaagagctccaacgctatcagtttccatctctgaccggaggacggatgactttgaaagcaatatggaacagtacatctctaactgcggttgtgaaatgcaagatggaacccagtactccaaaaattttgaagaatctgttttacgctcatatgcaatatgatgtgtgaatcttgcttttgacatcacaagcgcatcatcagcattgacatagtcactataacctttatcttctgaattaagaaaagctagcaggttcatgtactcaggaacattatcctgcaaaatagcaaagagattacatggcttattcgtggtatacaagcaatcttacaggccagagttgataagaaccttgattggggagcccaaaagcaccattctaaaatcagtagaaattttcttgagttgttcaaaatatttgaatgcagagttttcataataatcaactataacagcttcccagcgaatgcgctctatagtttcaatatcctgtgtcatggaagagagatcatgattagatggaaaaaaggaacatcattgtgatacagaggtggttgttatgcactcttgataggcaagcagcattttcttgtcatgaccagcagaaaaccttgttaacaattacctctaggatagcatcaggatgggataagagaacttgtaacatcatgcagcgtctgttgtcatagaactccaggtcttgaattaatttgagagtatctttctgcccatcatacacaacaacattgataaatggtgccaagtgattgaactgaatctcccatgcagaaagagaagcaggagtcgtgacgatcagtaaaggttggcagacatcaggtaatacagtcaacgtgaacaagatggtttttgttacgtattcctgcatgacacacgagttaaatgatatttcttttatgtagaaagaagcattgagttcaaaatatatcaggcaatcactagataattttcctatacgtagaaactactctctctagtgaaaaaaataaagtagtggcaggattctgtgcagtcaaacttttttaactttggttattatcttcctattgacaatcgattagaggtgtgaaaatgggtatgtacaggtttgtcttgaaaaatactttcataacattgtaatttcactaggttctataaatgggtgagtattttgctgaaaccaaattaggtttaacctccatgggtatcaggtgtagaaatgtacagaaaaatctcaaaagttgtagatgtagggaaggcggtattctctgttgagtaaatatacttggcaagaagtgggatttattactacttgcatattaagcagccatgttgaacaagtttggtgagtgggtgcacaagaactttcgaactgagcactctacaggatcatgtgaggctgctgtaattgctgagggtttgggattgcaaatttctgcaatggtggatcatgcacaccccatgtgccccctcacccaggtggacactcactcgtcaaggtatggaaaaaaaacacccagattactcttctatatttctatagaaatgcaaaatcccaacataaactgaaacacatttctaagatatgaaaaaagaacagatgaattttaactggtttgcacagaatttatactccattaaggttcaggaaaatacagtagaaatcagcaatcctcattcctcaattgagttttggggacagtggcaatgcccacattgcttgttttgttggatggagaaacaaaccagaatatgtggggtgaaaatagaacaagaagctgcttttcagcccaaaatattaaatatatcactttaggtatagtagtgtaatgctggtaataacttgcataattcctagctcctaccttatcatcaacaaggacagcaccatgagatttgcaccagaactcaagaagttgattgatagaaaacaaatgatcgttgtcaaaaccaggaggccactcgtctggtaatctctggagtttctgaaatgtcttatgcttaacctgcaagggtgatcactattacagtctgtgtttgcaaagagaaggttcataaaaatatacccgtgtttataaagaacaggtataacctagatagtattactaaaatgaaacaaagaaaaacgaggtcataaatgcccagtgttggataggtgaacagtaagcaaaagcaagcaatgaatggtgcatgatgcatcaaatctatatgaaaaatatttcattcgagaaataccaggaatagaacagggggctggggttcaccaaatagttttttttttacctaaaaaataagagtgtgggtggaacaattcatatgtgaacgtaacagtgatcccaattttaagttttcaatgttttgatagcttagcatcaagaatccaagattgatcatctcaaatagaacaggaatctaaatatcacatgacataacctaggtaatatataacttagagaacgtacaatacatttttgtgatgtttgtcgtattcatacagtggactataagactaaaatgtatatggcacgaatatcaaaacggttatgctatattgcatttatttaagatgttatcaacaattatatttactctagacaatactaagagtacaacatataaaactaaaattagtttcagccacacctttgtttctacgggaatagatgattgcttagcagctttacggcggttctcatacttccttttaagttcatcagcctgaggagtacgcaaaaagcatgcagtttccagttcccatgttgcatgttcatagccaagatccctccatttcactaaccattcaacattacaatgctcaatgttagcacgacttgaacaaaaaaaatcatcagcttcttttgggggcataagtggccttttcctcaacaggtggtgtggctcagtccattccttcttccaatttgtctgtggaattatgtaattgaacataagcatagatcttttggccaaaaaaaaagtgtcattccttaaaaaatataaagaaatcatattcaacacactagtagccaccttttctttatgatccctcttattaaacaaggacagaagatcacaacctccaggggtgtcattgataacaccttccggaacccagcgattatggacatgtgccagattcttatacttcacaaggtactgcttgccattctgcattcctacaaatatggcagaaatagtagtaaagttaggatataaatcactataaaagattatctttaatgccattgttttttcttcttaccctccttgacattccacagagactcaattccatcagcaacagagtgtattccaaacagcaacctcttttccgtacagacagtacagaaccacataccaggagacaaatattccagccaatgatccagacaagaaacatggtagcttcttttgcagccttctccatcacaggacctataatcaattgatggtatgcattatcatgtatggtgatattgtgtatcagaaaccaaaagtatatctggaagaccaaaatcatattccctctgtcacagagtagcctctagcatttgccccaaactaagttcatttctgtccccttaactaccttacctacccacccaccaatactacttttctattaataagggacactttgatctttttcccaccatactaatttgaaccccaattgctagaaatgaacttattttgggacagagggagtagtgcacaggaggagatttaaaactttaacaaacagtgttccttttagtgaagggtatttcttgtattcccactttaatacaaggttttgtgggtatctcatgtgtgatgtatatatagccccttgaggcttagcaatacaacaagatagcagagccaatggtttagttcctgccgtcatcttccactacggaggagtgaactccactaacctgaatcacaaacccgactaaaggacaaataccataaacaactaacagttttatcatgctacacaagtagacagtatagaagaaaggagatatacatgtacacttgagatgtcacgaagaaaacaagatgcctatcagactattgtaaatgtctatgaacaagcaaacatttcatagatattcatgaatttatgattgcacaatttttataaaatctcaaataaatggggaacttggatactggttgaagccaccagatttaggaatcagcgtgagaagaactttggcgatttgtattaatacgatgtcatgccaaacagcattgttcactctcttgtacatatatatatgacgcataataagttataactaactctatattctttcagttcagaaataaaatagcacactaaattaaaacttatcagcaccacattttagcatctcaatgaaattatcagataatttaaaaggcaaattcttcaagatgaaaaattagtagatttagtaatgtagttgccaaaacagaatatggtactctctccggtcataaaattttgacgtttggacaaaatttggtcgaacatttgaaaactttgaccattaataatttttcaaatgcttagtttaaaaaaaatgtcgtgtatatttgccttaaaaattactatcattgtaccatatacttattaaaatttataagttattctaatataaaattgttagttaaagaagttcaaccgaatcttgacttaaatgtcaaatatttatgaccggacagagtattaggatgagaaatttacaacaggaatacagagtattaggatgtgaaatttacagcaggaaatgcaacctcgagcatagtacagaaacatattcctatcagcaaattatagatgaacacaggcacacataacatgtacagccagattgcatagtcgaatgtcagaaacagaaatagattgacccacacctagaagtctagaacccatggggaactgtaagaaagggaatgaacattgtatcttccatttcaagggagaaaaggaagcaacatttctacttattgttttgggcatcaacatggtctccagttcatgtgttttgcagcttttgctattttacttatttcatgctccgaaaaggtactacaaatacagtgatatccaaatacttaggaacctattaagatcagttttacgtgacaaatgacaaatccatatagttttgaatatatcagtactcaaagttctaaaacagtgaacatgcatgctctagggttctaggatattaaacagatgtagtaacataaaagcagtttgaatgttttattttaaaattcgcagttctgctttctatcctaaaggcataagtccattttcccaaactgattgtcgtacagaagagtaataacaactgatgtaaatcaagtgtgaatcaacttacttaagatctcctggggtaccacaagcaacgcatatgttggaattgccctccatttcatcagatgcggtcaccttgaactgacttgaagctacttctttttgaatgctaaggggttcaccatctccatgtccactctcgggctagcacaacaccaaaatattataagagaacaatgtataaccctaattccactgatttgtaaaaatgcgaaagcacatatattccagctatagcttgagagtacctcctcgtaatgaataggagggattggggcactttgcaatgacgatatagaattttgcctgcaaaatggaaatattatagcaggaccaacattaatttgaagtgcatgcccagtataaaagaagtatccatgactaagaaataaagcaccttgaatgcccagtaggccgatctctaccttcaacttcaagtctactctcagcaactttgttttgtgggcatgtttcgatagatatatgttgatgtacctgccatattgattgacgagaaaaggttagccctttccaaagtggatgggaacttcatccatgggtccatccacatggttggaatgtgatattgggacatccaagagaaccataagtggataagttgtccagctaagatgattaaagaaaagtaatagatgataaaaatgaactattgcattgggtaattagagtatccagcttaagtgggtagcttgtccagctacgatgatcacagaaaattacaaatggctttatcaaattctagacagaacatacaaatatcatcagaaaactcccattcagcagacagtcaaaaaattagcatcaatattgattgcggtgaactaggaaagcgaaaggcaaacctccgaaagcggtccggcagatttgccaactcttggttgagaagtttcatgtaaaccagaaatagaacttctggaaactttagtatcgtttgagtgcttcttgtcttttccaatcaatccgccaaattcacataacataccagtgttgctctctgccacattcccattggaagtattttccttgcccgctctgtcagaagcaacaacaactacatcggaaaagttggaaaatagctcagatatgcgtgtttgggtgaaacaaatgcaggttaaatggccaatagcatatccaacggaatgtctaataaactagtagaatacaactgtatgtttcactggaacttgataggaaacttgcatgttgatttcatgctagataaagtggtttggtgtgattgtacgatggtttgctttagaaattccacctgataggcttactttaagaacctaaaacgtcaactggtttgtaggttgtagcataaagttttggtaaaatatcccatccatcttgcaacgtaagaagcaccatgcaaaaaattacacttgcattgcgtgtcgacccgttaatttgttcacgttaaaaccttcagctattcctaaccatctgctgccacttggcgaaaaaaataccgaactctgaataatcagataaagcatgagctgcaagaagtacctgtggagcttgcttttttggatcgcttgaaaagtgatctgtaggattttgcggtcattcttttccgcttctttgataaactgctagtgcttccaaccccgctgctatgctcttctgcaacatccttagaactagcggtggtggtgctagaagatctggtgggagctcttgatgttgaagaatttgaagcattgttactagccctttttaacattccgacgcgtgctacctcggctacttcgtcttgttgtgtgccggaaagccttggggaacatctcctggaggtcggcatgtctggccctccacgcagaggagagcggagagaggccatagccctctggttcgcgccgtttgtgggtgcagagaattgtggatttccagaagtacgcgaacgggttgggtacccggtgcctgcgtttgccctggccgtactgcctccaccccttccatctctggatgttcctccgggctgagtcttccacatgtcacctgtttagcaccattcgttgaaccaactcttggtcaatcacagtttgcacagccccgcaaagtcaaaacccgacgacgaactgacgaacaagccaaaggaagaaggagaagaaaaacaaaaattggtataaaaaaaacaagcggtggcgccgataaatgcaagcacggaggagacgcgcgcacccaaaatccggcgcggaggggtcccccgcgatccaggccaaaaagcacaaaccctaactcctcatcagcattccatttcaggaaaagtgcaaggcgggcgggagaaagacaagggggggatggaggggtcgggaagggggggcgggagaaagctgtacctctggggagcgggcgggcggcgaccgcgaccggattgcggcggcgggggacggtgcgggcaggggtttgcgcgatcgaagtcgaaggtagccgtgggccgtgggttttttttggttttggagctcccccaacctcccaagtctcaactcccgcaacttcctcccaaaggagaagaagaagaagaagacgcctgcgggccctcctttccactctcggcaatcccctccgtctgcggctatactaccgcgccagttgggataaacacggagtagcttcttctgtaagcagcgtctctccccctatatactactctacctcatactccttataaaggcgaaaatttaatactcatttaaatcgcaggattaaaaaatatataaataaaaaacataagatttttgataggaatgttccttttgaattgaaggaaaaaacataaaaattctaggattttattctatagaaaataatcctacagagtcctttgaaataaaggattgtttcctatcaacttctttgaaatttctatggaatgaaccttcctagagcaattttggaagaaaataggcatgaggtctcacctcatgttttcctctttatattttttcctgtgtactaatcaaacgatggagactttcatgtgtttcaaaattccataggaatccaataagtgcagcattctattcctacgtttttcctattcctctgttttctcaattctacgattcaaagaggctaagtgtaaaatagaggattacaagatgttggaaaaacacaggaatgatcattttattgaaccgcaggaattggatgagagagatagacttagggcccctttgaattgcaagattgaaaaaaacgtaggaataggaaaaacataggattttgatatgaatgtaagtgtaaaatagaggattgcaaaacgcaagaaaaacacaggaatgacagtttgattgaaccgcgggaattggataagagagatagactcaaaggaaggttaccaagaggttgaagctcttgctaaatttcctctaaaatctctataggattgtacatttcataggaatttcaaagaattggatatgattcaatcctttgtttcaaatggcttcataggaaattttcttatagaattgaaattctccaaaattcctatattttttctccaatttaaaggggccctaaaggaaagttaccaagaggttgaagttcttggtaaattttctccaaaatctctataggattgtccattccataggaattgtctatccaatcatttgttttaaagggcttcataggaaattttcttataggattgaaatcctccaaaattcctatatatttcctccaaatcaaaggggcccttacaatgtgagaactgcaaaatatctgaaatccaaagtaaagatcttcatgctccaccttggctggggtgtttgagaggagaggaaaaaagaagattgagaagatacgcaaaacgaggtgatccattaacgcatgattaattgagtattaactattttaaatttaaaaatggattaatatgatttttaagcacctttcgtatagaacttttttgcaaaaaaacacaccgtttagtagtttggaaaacatgcgcgcggaaaacgagagaaatctctctctttcacctttttttgacgcaaaaggtatacaggctctaccttatagggcaaggccaatgcttatgattccatcagccatatatgtgggacccgctttagtaagcattagctatgtccatatccacaatggacgtgcctatgggagaaaataagctgggtcccaatgggtcccaccgaagaaaaaaaatatcacttcttatcctcctgtgaaactctttgcacaatgaaaattccccaaaagtactagtatgaacaacacatcacaaaagtattatattctatagtcttgttgccgcaccataaggctaatgctcacttttgatgtcagatttttatggtccactttcacaatgattaaggtgatgtactgtggaattatttattgcttaaggtcaattttagcacacattgtggttgccctaaccattgtattaatggtgagtcaaaatggaacaatgtcaagaaacacacgttgttgtgtatgaaagaaaaattacaatacgtacaaatacacttaggggttgtttagattgatgtcatttcaaccatattattttttttaagttatcaaagatgtgcatagatttagttttttaccgaactttggtaaatatataaggaatttggcaactacatgatagtggcacaatagtggctatcatgccaaaacttggcaatattgtcaactaccaaaatttggcattgtcaaatttggtaatgtttattttggctataatctgaacaaccccttaggctacgttttggaggtggagtttgtccattggtgcacaattagttaagtattattggagcagaaactaccagcatcgagtctggacaagaagattgagagttggtgtctaccgccggaaggagttgctaaactaagggtgcgctcttttcagcttataggattagattctcctcattttccattagcacgtttttcaaactgctaaacgatatatttcgtgcgaaaactttctatagagaagttgtttaaaaaaatccaacaaatttattcataaaaaaatatattaatacttaattaattatatgctaatcttatttctcgttttacgtgcggctaatcagcccaccgcacctgctgaaacaagcgcaccctaaatgttgacgctggaagaaacaggggaagccagcgccggtttattttcagagactgcaggggtttggtgctactggccagccacaaaaccttgcactgttgtgggtctgctgctcaagctgaagcattagcatgtttagagggtctccaggcagcggttgaatggatccacatgccaattctgatggagatggatgatgtagaaattgtcatagatttacaacaatccgggccattaaaatcgtcttggtcgatgacgatagctgagattaaaggtgtgatgcagtgtcttcagaatgtgcaagtgcacaaaataaagagataagcaaataggatagcgcatatactagcctaaatggcaatgagtactgtatcttttgcagagtggaggcttagagcatcaccaacagtctatctattccatccccaatcctgattttttaggattttggttaaaaaaaattggtccaacagatttccaaaagagctccggacgttttagagttcccatctccagttttctcggtatgtgtatttgagggtgagagaccgactccaaatcctctttcccgcgcgtttctcctctccttaccccgctccttctgcgcacgggaaataaaaaaactagaatttctgttggtagtttaacagaagggcccacttttagtttttggggaattgaatttaggctatctcttggagggagaggttttttcaccacctattttcagtttaggaaacccaaaaatcaaattttggggatagattattggtggactgttggtgatgctcttagatttattagaccaggaatgtaatcccttgttctgacaataataaagtttctctctttagactcaaagaaaaacttgaaaaatcgattaatatgatttttttaaagaaaaatatgttagaatttttttgaaaaaaaaaattaccatttagtagtttgaaaagcatgcgagagggataagttaggaaagtgaacaaaagaactcagccttataagatactctcttcattctataatattatatgttataagatatgtttagatggcatccacacttcgtcacactttacaaactgtaccacaatggataatgtttggctatgaaatggatttatgatatggttaatatgtggggtaaaagtgtagcatgaaccaaaatgcttacttaaaaactgtggcgtgactaacgtttggcattatagagtgcggcactaaaccaaatagacccttagcctttttcacggatattatggcctggtttagttcccaaattttttttctaaaaacatcatatcgaatctttggacacatgtatggagcattaaatatagattaaaaaactaattgcacagttagagggggaatcgtgagacgaatcttttgagtctaattagtccatgattagccataagtgctacagtaacccacatgtgctaatgacagattaattaggctcaaaagattcgtcttgcggtttccaggcgagttatgaaattagtttttttatccatgtccaaaaaccctttccgacatctagtcaaatatccgatgtgacaccagaaaattctcttttagcgaactaaacaggccctatgaagaaaagggaaaaaagactaggctgcctactcgggataggtgaagggttcgctagacttgttgggtgctataataaagctcatgggtagtttcaaaagttaatctaaactttataagttgtgattatattttgagatggagaaagtaaaggttatggttgaaaaaaatgagttggagggttgataattgaatatatcggtgagatagaaactccaaaaataaaatagtgtttaggtccttcctccaaaatttcaataggttttataagagactccatccctgaaaaacaacttgaatgacagatattccagtttatttgctccctcagcttaattacctttattttttccatgttcaaagcatatgtgtgtgtagtactcctagtagttttcttaaccagtgacaaataatctgacctcaaagctcaattaacgggtagttttcttaaggaaaaaatacgaattaccccccgaactatcgcggtcgtccgaattaccccccgaaccataaaacaggacattcttcacccccaactatgaatactggacgaattacccccctcgacccaatccgcggtggtttttggtctacatggcgtacacgtggcaatccagtcagcattttatttataaaaaattgtgggacccacctgtcatatactactctcttctctctctcacacactctctctctctcactcttcctctctctctctcaccatttcacagggtcagcggcggcggggcacacggagcgggcagcggccgcggcgcgtgacgcagaggcggcagcggcttccccctccctctcgtcggcggcggcgatggcaggggacatggagcggcggcgtgtgacgtggaggcagcggcgacgggggatgaggagctcgacgcggcttcccccctccctctcggtggcgtgcgcgcaggcaggacgaggacgcgagacgagaaggcggtggaggaggcgaggcgaggtagcagcggcggcgacggcggatgaggcgagcggtggcgggagctcgcgctgctcgaggcggggcgaggcggcggcggaggaggaggcgagcggcggcggggtgtggtggaggaggcgagcgcggtggcagaggaggcgagcgcggcggcggaggaagtgaggcagcggcggcggcgaggcggttggcggggcgacgacggcagaggaggcgagcgcggttgacggcagaggcgacgtggcgagcgcggcggcggaggaagcgaggaggcagcggcggcgaggcggttggcggggggaccacgttggcggtgggtggggcttcggcaacctatgagacgcgctccacggcggccgctgcctcctcgtcgtggcctccgtccgtccgtcccgcaatgctgccgcctccacgtccggctgtcccatgcgtcacccgccgccgccgcctccgtgtccccgccaccgccgcttcctcgttcggtcgccgccgcgtcacccgtcgccgccacctccgcgtccctcgccaccgccacctcctcgtccggttgtcccgcggtgctgaccaccgtcgtttacagtgagggagagagagggagagagaggaagagtaagagagagaagtgagagagaaagagagtgagagagagaagagagagtagtgtatgacaggtgggtcccacatttttttaaaaatagaatgctgacttgactgtcacgtgtacgccacgtagaccaaaaccactacggattaggtcaagggggattcatagttgggggtgaagaatgtccggttttatggttcggggggtaattcgtactttttccttttcttaaccaacactgacttctagtagaaataaaaaataaaataaaaaacttcttttttcctcggaggtagaaatatatatatttaaaaaaaatctcctcttagtagagaagaaaagatacaattattctaatttacccttatcatattaaatctttagtttttgtgacccactaccaacagtgaatcgacgattctcagcccagaaagcctgctacagtactacaggacctcacccttcatgcaccgtccgggacgatgtccacgggttcatcgatccatccgtctacgcctcatagccgcatcaccccgatcccctccgtcatcgctcctaaccaatcagcgcacccatcgtcccaaaatccccaaatcttcatcgcctcctcgtgaggttcgtcggcgccgacaccgccttcttgcggagcctgcggccagcgtcgccgctttcttgtcgagccagcgagggaaatcgcggcgccatcttcgccgccctcgccggaccagcgtcgccacggagctagccggcggcatctgcctgctcacggagccatcgggcaagcgccgcagccgaccgccgccctcgtctcttcggcgatccagcagctgccgccgcctttcgtctggtacgcactccttctcctcacggacagggaatgcatgcaggttactgctgtctccaaatccacatactctacttaattttcttactgaaccggccaatttcactcagctagctgctaacggttgtccaactagctcgatccctgtccgtgctgctccgtatcctctttcattcgtcagtttcaggtatatatccatatcacttgtcacgctcagaaattcacggactagaatttctaagctgaatgtgcattaaacccctgtccaggaccagccagggtacacaaacgacaattgttgacatacagatccacgtcttacaaaaatataaaagattacaaatgcggcggaaaaagataaaagcgagctaagcctgaagacttgactcctgcagcgagcgactccattccacaggcatccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggataaaggttcttttgcataaagccggcatttcaaagcagtagttgaaaacagtaaaacagttgtagtaattaatccatattaaccaatcactgtccaacgttacaccacgttgcaacaggcccaaaccaccacctgaactaatcagttccaaaagctaactagggtgaaactaatcacggtgaatctggtcgaccgcccataaccgcgggcacggctattcgaatagttttactctgatcagaggtgtacaactgtacccacaagacacagccccacgacacgttcctgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctaggtacgtcggctagagaaaagctacactacaagcccagccgttgcccacgctggcttgtggtaagtacgataaattctttcagggcatcccgcgaaccggtccttaaatgccatgggtgcgactagcaagaccatgcacccacagcccaccatgacgtgtattttaattaaccaacaccattacggtggcactaaatcaaagctatgccaataatcaagtctatgctttaatgtgatccccctttgtgcactagttgaactaagcatggctaagcatctcctaaaccaacatctagtcattttaatacccacgttatcaatggcataaggtaaacaatatatggctgagtaataggacccatcccacatgatattgtaaaacaatgcaatatttaatagaaatgcgggatatttgtaaattgggtacaatatgatcaattgtattgcatgacttgccttgctctcgcactgatgagaccacagcaacgtcttcgagaaaccacggattgacgaaccgaccgaaatctacgcgacaaacaaagcacacaagcaaaacatgctataagactactgaaacagagaacaaagccatttttaatggattctacacatttttatgaatttactgagacttgaatggatttaatcggagctcggatgaattagatatgatttttagaagattctctgtgtttttactattaaagaaaagccttaatcaatttattgcgcaatagtgccccagggctgacgtcagcaaggggtggggcggcgccgacatgcgggcctcactggacagaggcacaagagagagggagagggggcggctggcaggcgggacccaccgggcagcgtcacaaggggggggaagcggcgaggcgcccggtcggtccggctcggcttcaagccggccggccggttatggcgagggcggcggcggcaagcggccaccgacggcggcggccggcgatgcaggcgacggcacttcacggcgaagcgcatgcggggagcggcagcgcgcgcgagaggaagagaaggggagggagttctcaccggggttcggccggcgtgggagggtacgacggcaaacggtgacggtgagcgaccggagggcgacggtgaacggcggccgagctccaggacaccctaagagaggaagtgagagaggttagatggagagaaggtgtccacggcgagtgagagctatggccgacggcggcagctatggtggaagctcaccggagtgcgaggagatgcgagctccggcgatggaattggacgggagaacggcggacgaggtggacctcgggatggcggacgcggcggcgccgatggcggggtgcggcggcgaccctagcggctgctagaggcggccggagcggtggagatggcggcggcgggtgggtgcacggtgctagggcgatagggagctcgggggcggacggcgaaagagggaaaaaggtggagagaggcgcggtggtcggttatatagaggtggggaggccggacgtggccgggagcggcggttccgcggcgacgacgtggagaggtggaggaggagagagagggggagaggattcaaatcgaatcccgtccgtgcggacgcgcgcgcggacgggagagggcagggcgtggggcggcgacgtggggacgtgtgggcgcggagtagggcgcggatgcggaggaagcggcggcgtgggcggcggtttcggcggcggatggtggcggctgccggaggttagggacgaccgacaggtgggccccacctgtcggcacccgggaggagaggggaggtgggatggacttcggggaggggaggtgaagcgggccggcgctggagggaatgggccgggcccaaaaaaaaggaaaaaggagggaaaagaaaagataaaaaggaaaaaggattttcccagggatttatatgttgcacatgctcatttttaattggttaaaattatttccaatgctctgaaaattccgctaaaaatcctgttagcgtattttgacatgtagaatccaagaaaaattccacatgccgattccgattattatttgcatttattaattagggattcatctctaggttaaattaaacaatttcttcggacgatttattttatgaatttagagcaagggaggggaacttcagggcgagacaaacctaccccccttaaacggaatctcgaccccgagattcggaagagttggcaaagaggtgcggatgagcggctctttcccaggtggcctcttcttccgagtggtggctccactgaactttgcaaaacctgatcaccttgtttctggtccttctctcactggtctcgaggatacgaatcggcttctccacataagtcagatcttcctggatgtcaatgtgctctgagctagcttgttccttaggtaccctcaaacacttcttcaattgagatacatgaaacacatcgtggataccaaccatattagatggaagctctagctggtaagcgacttcacctctgcgttccaaaatcctgtatggtcccacaaagcgtggtgccaatttgcctttcgtctggaaccggtgtactccccggagcggagtgacacgaaggtacacataatcccctgcttcgaaagtaagctctcttcggcggttatcagcataactcttctgccgagactgggcgattcgcagtctttccctgacggtcctgactttctcctctgcttcggttaacacttctgtcccaaacagttggcgctcacctgtttgatcccagaaaagtggtgtgcagcactttcgtccgtacaatgcttcaaacggtgccatttgcaaactggactgatagctgttgttgtaagagaattccgcatacggtagacttttatcccaggctccaccaaagtcaagtgcacaagctctcaacatatcttccaagatttgatttactcgctcggtctgaccatctgtttgcggatgataagccgtgctgaaattcaaacgagtccccaattcttcttgcagtttctgccagaactttgaagtgaattgacttcctcgatcagatacaatcttcttaggtaccccatgcaaacacatgattcttgaaagataaagctctgccaacctttttccagtataggtagtgtgtactggaatgaaatgagcaactttggtgagtcgatccacgaccacccagattgaatcgtgccccgacgatgtcctgggcaaacctgttatgaaatccattccgatttcttcccatttccattccgggatctgaaggggttgtagcagtcctgcgggcctctgatgttctgctttgactcgctgacaaacatcgcaaagtgcgacgaattcggctatctctcttctcatgctgacccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccatgctcatcctcatggaaatctcgagcttttccaaccctcatattctttttcagctcagctatttcaggatcatttacttgagctgctctgacttgatccacgagcgtaggccgtgcctctagggcagctacgtacccgtgttccacgatgcccaaatttaggtgctcaagatcttgctgcaatttgccacacatgtcttcagtgcataaggcattgcaatagcttttcctgctcaaagcatctgctaccacatttgctttgcctggatgataatgtatccccatgtcataatctttaattaactccagccatcttcgctgtcggagattcaagtcaggctgagtgaagatgtacttcagactcttgtgatcagtgtatacttcacagcggttgccaataagatagtgccgccagattttcagagcatgaaccactgctgccaactcaaggtcatgagtggggtaattggtctcttgtggacgcaactgtcgcgaagcgtatgcgaccactctgccttcttgcatcaacacacatcccaacccttggcgagatgcatcacagtagacttggaagtcttttgtctgatctggcaaaattagaactggtgcagagactaacctcttcttgagttcttcaaaactttggttgcactcagctgaccacttgaatttttcatctttctttagcaactgtgtcatgggcctggcaatcttggagaaattttcgatgaaccgacggtaatagcccgcaagtccaagaaaactccggatttgagaaactgtctttggtggggtccactttgtaactgattccacatttgatggatccactgccacgccttgagcagaaatgacgtgacccagaaatttgacctccgataaccagaagtcacacttgctaaacttggcatataactggtgctccttcaatttctcgagtaccagacgaagatgatgctcatgttcctcttctgattttgaatacacaagtatgtcgtcaatgaataccacgacaaacttgtcaagaaactccataaacactttgttcatcaagttcatgaagaaagccggtgcattggtgagtccaaatgacataaccgtgcactcaaacaacccataccgagtgatgaaggctgtcttgggaatatcctcttcccgaattctcaactgatgatagcctaatcgcaggtctatcttggaaaacaccttagctccttttagctgatcaaacaggtcatcaattcttggcaacggatatttgttcttgattgtgacctcattaagggcccgataatcaacgcacatcctcttagtcttgtctttcttctccacaaagataaccggagcaccccaaggtgaagtactcggtcgaatgtaccctttctgcagctgttcatcaacttgctttttgacctctgctagctcattagctgccattctgtacggcctcttgtaaattggagcagttccgggtgccagatcaattcggaactcgatttctctcttcggtggcattgtagtgaggtcttcaggaaatacctcaggatattcttgtactataggaatatcctccaacttcctgggacttttctccactgtttctgtctgaccctcaatagcagcctgattcagactcgctacggacttctgtgacactggagaacggaaggtgatcttctcccctttgtcgttggttagggtgatggtgcggcctgcgcagtcaatcacccccttgtgtctggtcaaccaatccattccgagaatgacatccaggtctttggattcgagaaggatgaggttggatagaaattgtgacctcttgatctctatagtcactgaggggcaatagtgtgatgtcttcatgtcatttccagaggtatgaacctgcatcggtattttaagttccattaccgataatccatgtgtcccagcaaatctcttggaaatgaaagaatgcgaggcacccgaatcaaaaagaactgttgctggatatgagttcactggaaacgtgcccagcacgacatctgatgctgcctgtgcttcctctgcagacacatgattggcgcgggcctggatgaacctgggtctagtgcgattcagcttcgaacacttgctagcaaagtggccgtgcttgccacagttgaagcagggtcctggctttcctacagcccccttcttgggttgttctgactgagctgacacagctggcggatctgactgagctggtgccattagtgggggtggagtcgagttgtggttgtgctgcttactgttgttgtgactgccaccgttgtaatcgttgttgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcttcctggtggatagccttgtccacaagcttctcaaagtcctcatagactccggagattagctggttggtcaattcatcgtcgagcccaaacaaaaacttctcctgcttctcagcatcggtgcgcacgtcctcaggagcgtagtgcgcgaggcggttgaactcgtgcaggtactctgtaaccgttctggttccttgttgcaatgcacggaactccctcttctgttgtgccataatcccttcaggaatctgtgccttcctaaagttttgacaaaactctacccaagtaaccttcgttgcatctggacgggtcaccacgtagttatcccaccaggcagaagcaggaccttgcaattgatgtgtagcaaaagcaaccttctctcggtcgttgcattgcaaaaggttcagcttcttctcaacaacacggagccagtcgttggcctccattgggttggtggtgcttgagaaagtgggtggctggatacgaagaaagtctaacagtttggacaggtgtgatggtggaggagcaaaccgctggttctgctgcacctgttgcaacacctgatggtgatgttgctgcatctgttgcatcatcattgtcatcatttgagtgaccgttgggttcccgagcggtggagatgaactgctgtcagatgcaccactgacatgagctccatcggtctgctcttcgctgcccctggcgtcgctggagtcacggggatcattccttgtcttcaccatctggacgaggataggtagaaataagagaaaggaagaaaacagatggctcggaagctaatctttgttataagtttaagggcaattatcttaatcttgattaaaacactgaaaaagaggcacgcaactcctaataaaggcagccataccactgacacatgatatcgactgctgactaacccacaagcaacaaacctaagcacggaaactagcaagcaaacaaaactaagaagacgataaagctaagggcggcgactctgaagcttggagcagcgcttgcgatcggagaataggtctgacatctaaagagtacagagggataggaaccaacacatgctcaaaaccaaattaaataaagcaacaaatgactcaagtaactcgccgagcatgatgatttttatgcatagaacatttttcatgaacccggataaagacactaatgcgactgactaaaccatagcttaatgcataaactagttgcatggaaaatgatgcgcataaaattgccccatcgaacatagacacgacctaatgcatatcacccgataaattcccaactgactgtcaaataaactccaaataaaatttttctaaaaccctagaccgagctaattttaaggatccgatccgaacgaacgaccaagatttttcccacaaaccaaagaggcaaaaccccaaatttttcccgaaacaaatccaagtgcaaaaagcatatgcagatgaaaaggtttaagagagctcttagggtttccatttggcttgtcctacggtcaaggtcggctctgataccaacttgtcacgcccagaaattcacggaccagaatttctaagctgaatgtgcattaaacccctgtccaggaccagccagggtacacaaacgacaattgttgacatacagatccacgtcttacaaaaatataaaagattacaaatgcggcggaaaaagataaaagcgagctaagcctgaagacttgactcctgcagtgggcgactccattccacaggcatccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggataaaggttcttttgcataaagtcggcatttcaaagcagtagttgaaaacagtaaaacagttgtagtaattaatccatattaaccaatcactgtccaacgttacaccacgttgcaacaggcccaaaccaccacctgaactaatcagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggtcgtgacaggacccttcgcataaccccctctaaccgatcgcaccacaccttagggttcgcccccgtccccagcaggcaacgggcagcccccctttcatgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaaatgccatgggtgcgactagcaagaccatgcacccacagcccaccatgacgtgtattttaattaaccaacaccattacggtggcactaaatcaaagctatgccaataatcaagtctatgctttaatgtgatccccctttgtgcactagttgaactaagcatggctaagcatctcctaaaccaacatctagtcattttaatactcacgttatcaatggcataaggtaaacaatatatggctgagtaataggacccatcccacatgatattgtaaaacaatgcaatatttaatagaaatgcgggatatttgtaaattgggtacaatatgatcaattgtattgcatgacttgccttgctctcgcactgatgagaccacagcaacgtcttcgagaaaccacggatcgacgaaccgaccgaaatctacgcgacaaacaaagcacacaagcaaaacatgctataagactactgaaacagagaacaaagccatttttaatggattctacacatttttatgaatttactgagacttgaatggatttaatcggagctcggatgaattagatatgatttttagaagattctctatgtttttactattaaagaaaagccttaatcaatttattgcgcaatattgccccagggctgacgtcagcaaggggtggggcggcgccgacatgcgggccccactggacagaggcacaagagagagggagagggggcggctggcaggcgggacccaccgggcagcgtcacaagggggggggaaagcggcgaggcgcccggtcggtccggctcggcttcaagccggccggccggttatggtgagggcggcggcggcaagcggccaccgacggcggcggccggcgatgcaggcgacggcgcttcacggcgaagcgcatgcggggagcggcggcgcgcgcgagaggaagagaaggggagggagttctcaccggggttcggccggcgcgggaggatacgacggcaaacggcgacggtgagcgaccggagggcgacggtgaacggcggccgagctccgggacaccctaagagaggaagtgagagaggttagatggagagaaggtgtccacggcgagcgagagccatggccgacggcggcagctatggtggaagctcaccggagtgcgaggagatgcgagctccggcgatggaattggacgggagaacggcggacgaggtggacctcgggatggcggacgcggcggcgccgatggcggggtgcggcggcgaccctagcggctgctagaggcggccggagcggtggagatggcggcggcgggtgggtgcacggtgctagggcgatagggagctcgggggcggacggcgaaagagggaaaaaggtggagagaggcgcggtggtcggttatatagaggtggggaggccggacgtggccgggagcggcggttccgcggcgacgacgtggagaggtggaggaggagagagagggggagaggattcaaatcgaatcccgtccgtgcggacgcgcgcgcggacgggagagggcagggcgtggggcggcgacgtggggacgtgtgggcgcggagtggggcgcggatgcggaggaagcggcggcgtgggcggcggtttcggcggcggatggtggcggctgccggaggttagggacgaccgacaggtgggccccacctgtcggcgcccgggaggagaggggaggtgggatggacttcggggaggggaggtgaagcgggccggcgctggagggaatgggccgggccaaaaaaaaggaaaaaggagggaaaagaaaagataaaaaggaaaaaggattttcccagggatttatatgttgcacatgctcatttttaattggttaaaattatttccaatgctctgaaaattccgctaaaaatcctgttagcgtattttgacatgtagaatccaagaaaaattccacatgccgattccgattattatttgcatttattaattagggattcatctctaggttaaattaaacaatttcttcggacgatttattttatgaatttagagcaagggaggggaacttcagggcgagatatccatatcactccttgcatttttaacaaaaaagtaatcttgacgaaagataatctcataaagagaaattggagggaaaataatcaatgttgttttttaatacacaagagaccatccaacatcttttctttgactgtcatgttgcacgttttgcttggcgatgtgtctttttgccttcaacattcccccttcccacaatataaaagatatttttgttactggctaaggggagtgcttagacaaaaaaaaatgattttgtttggagctagtgctttatgttggtcaatttggtgttgccgtaatgatatagtttttaaccataaaaaaatgcctaacatcatgcaggttatcttcatatgtttcaattggctccactcttggtgtatgatgctttcacaagaacaacaggatactatgcgcaatggtgctacacgcttggaattagcagtcaagtaacttttattccagtttggatggcgtagtacctatagaatttcgtgataaaatctacgtgattttgaaaaaaatattattttagtagatcatatcatcggcagaagttgggggtttgtcccatctcgctttttttaacttttctgtgcacgtctgaattttttggctgtgtgcctacgggcagaggccggagatgtaacccatttccattatctaaaaaattgttactttcattaatcatttactaggcagtgccgattgtttggatgatatgatgctttgggtttattattgctcttattatatttaccactatctacagttaaacaaaaaaaggtgctctattttagtttgccactctacaggctctatgtttcttacatattgattttctgctctcctttttttttaaaaaaaaagaattattcagtgtggtagttttatctgtcattttacacaaagaagtgataaattctacctgttatttcagtcttctatgaaatgttgtgctgaagatatttctgtttacccaaaacaccaatctctctaggaacacgaaggtgtttgccttttgctaatgtcttattacctccgttttttaaatagatgacgccgttgactttttctcacatgtttgactattcgtcttattaaaaaaaattatgtaattataatttattttattatgagttgttttattatttatagtactttaagtgtgatttatatgtatacagtgtgatttatatcttatacatttgtataaaatttttgaataagacaaatagtcaaacatgtaagaaaaagtcaacggcatcatctattaaaaaacatagagagtattacagtgcgtagtgacagtcaatattacctatgtttacatgacctctaactgctgccctgtttttaaccttttacccctatcatgctgcaattccaggagttgtgccggtgttagctatgctttctctattatatacatcaggctaatttatcatgtcattctactcagaagaatgtacataacaaatagcaaatagactcgaaaataatatatcatgaaaagaatggtcatgtttgtgtgcattgcaaaaggaccaaggcaaaataatagtgtactgtactcagtttcttccagttatataataatcctgaccgtgttacattttgaatttttacccaactttcaattatcatataagcttcagtgtctaccgtcactgtttgagtatagaacaaaatgactgacatctaaaaccaccataccatgttcatctgtgtcacaactttggtttgtttttcgggaatcagctacttcacctttgaatcttgcaaacttacgtaccaagtcctttaatttgtacaccatgaacaaaagttccagatcatataaattcgactaacacagtggcacttcatccgcggcaacgcgcggggtcctagctagttcttttggggttttaaggtagagaggacaaaagatatgatgtcttctaattttattttttctatgtgaattgacatgtgggtccgacacgcagacgctatcgtggcatgccatgttagtgcacggagcgggttagagcccgtttggatctgtatgacatccaaacaggttcaaagactcgaaaataaattttgagagttcatgtacctaaatgacacacatacacgcatgtattagataatattcaacggtatatatagccacacatacacgcatgtatatacctaaacatttaaaaaagtttcatacacatttgaattgggtatatactcaatttcaatcgtggtgcccgggcaccatggagcaccaaacaaacttggtatgacaacaatactttgactcaacatatacatcctcacaatctatagcataggttaaatttttattggcgcttgctccagacatcgacggcggcgcgccatggaggccgccaccgctgctcctccatatccatcaaagtccgagctcgccgctgcggaggtcgcgtcgtgcgcatgggggcggagtggcggccggatccgccaccgccttgcctcctgcccgcagttgcccatcacggccgcgcccgccgtcacccgtgcaagatccacgccagattcgtgcgcgtggggcgcggagcggcggccgcatgcgccacctcctcgcctcccacccgtagtcgcccgtcgccgcagcgctcgcagtcgtgccgcgccagatccgccgacgtcgtgcccaccgtcacgccagatcagcgatagaggtcgagccgctgcgtctccagcccgcagtcgtccgtcgtcgcctcggccgcaaccgtgctgtgccgaatccgccaacgttgcgcccgccgccgctcggctgtagaggtggagccgccgcacctcccgcccgccaacgccacgcccgcagccatgccgtgccgtgccggatccgcctcacgcccgccgatgccgcacccaccatggatgtgacaccatcaggcctggcgtgccaccgccgctcctccttgatgccggttctcctcgtccccgaaccgccgccgccgctgctcctcctcgtcgccaagccgtcaccggaaccgcctcgccgccacttctcatcccctaaccgccgtcgccgttcctcttctctccacgaggaaccacaatccgtcgctgattcgtaaaacgtggagagggagaggaaagagtgggtggacggtttctacaatgggaatccgtaatatatataccagataaactcagtacgtcgagttaaaaaataactcaatgtgcaaaacactgttggatcacaagacacacattgactatctcgctaacagttaaaaaataactcaatgtgtagcttgcaccagatcagttcgcgtggggtgtgcgtggggtggtgggtcgctgagttaaaaattaactatgtggtttgtttaaattgagtgtgcatgggtgtagtttgtgtgtgtcaggtgccatatagtacgtagcaccaagagcgccatatagtagctctctctctctctctaatatatatatatatatatatatatatatatatatatatatatatatatatatatatatatatatatatatatatatatatatatatatataaaagataaattaaagactgacacttgttgcgaatccaattattatagtgtgctatatatgttgtttaaatgagttgtgactttcactatttgcacatgcattataatgagatctagatatagaaatatgatttagtttgtttttatactaatttttagtgtgtgttatatttttttttacattttagagaggttttctagtgatagtctttcagagggggtcaatttttcatgaagaaatagaacaaatttactattgattttttttttttcctttttctcaaggggaagagttttttttcaaaaggggaagggagtatagtttagataaatacaaatatcttagagaaaattccatatatacccttaaaaactaactcaatcccttttacacccatgaaatttacccaatcctttatataacccatcaaattttaggggcatctaaggaagtaagcaaaattcaggggcatagaagggattagttaaaattgtaggggtataaaagggattttctcaatgtcttatattatgttgtagtgcttagatctaacgataacggtgttagtgttatatatttttttaatttataacaataaataaataattttatacaaaattagtttatatataatataaataataagaaaagaaatatgtagttaagttttatgtatatataaaagtaatacaataactaataatattatatttttttacaatattatataataataagataatttgttgttttataaatatattagttcatcgaacatcaattataaaatcctaaatatgctactgtactgtaccacatcgaccctcgcttatctcacctcaccggcgtcggcgtttgcagtgcgtcatatattatgtgatcattagggtctcatatccacccatgcatgatttatagagttactcattattcagttttatctcgagttgccacgactgcttgttcgcactctacctcagcacctactgtcaccggaccctttagttcgtcgaggtgttatttactgttcagcagcacgtaagctaactcgatcgccattattgcaaacgagatggagctgtacgcggacctggtccccctcaccgcggagaacttccgcgccctctacaccaagaagccgctccactacaaagggctttgtctttcacagcattatcccaggatacatgtggaagggcggcgacttcgtcaaggaccatggcaccggcggcgagttcatttgcggcgacaccttcccaatgagaatttcctacttccacacgaccgcccgtggttacccaacggctccgccgaaaacaacatctcacagttctttacccgcgtgccctggttcgatggcaactacgtcgtcttcggctgtatcatctccggcttccacaacctcaaggccatcgaagcggaggtggaggtcaagattgccaaccgtggcgaggtcgtcattgtcccgccgccgtcgttaactactaattaatctccgggtccacataccagtaattttgaagaatgtttttcagtatggatcgagtagctacttattggtactagttagtaatgtcttgtattgtggatggatgattcatcattgtctctcgctatacaagactaatacatcttttcttacttaatactactataatggatggaattactcactactcctctggtaatgtggagacggtgatgttttacttctttaatgatgatattattgtttatctttggcggtttgtatttgttgatgattataaatgtcaatatatattaatacatcatgatgattctcttcattttaattggcacctacttctaaaccggtgttattattttaatcattcatatattcgtgtagtgtatactagcaaagtagccgtgtgttgtatagattcaatcctatagtaagtctcatgttactacaaataacgctaatcacaaacatgtataatagtgggtgaagctgtaatatcgataaggtctatctccatcctaaaagcaaagtggacgatccaattgaattgcaaatgagtgaaatttctaacctaccaactttagcatggacaatcggctatcgtatggaccgagggattccatgatccgtgagtgattttggatgtcaaattacacatttacactgtcgatgttaccaacattcatagagtttttcaaatattaagtgtacataatttgtaaaaggtttctatttccattgctcaaccaaaaagcacaatttgcacccaaaacaaaagactcataatggcttccatatgaggtgaggtcagtggctgctctaccagcaggccaccggcaatcaaatgtcggattgagtgaaagtcattcgtgaccaatggctaagaacttcttatcaaaatcatctggtggaaataaacatgtttcagagaaaattatagtgggatgttattgcgagcccaaaaactctgctccagacaactcagatcaatggcaacacagggttccaactgccaaaccaagtcagctatttggaaacaatcaacgtgatctgattttgcaattaattctaaatgaagacctagaaagttaaaagccaaatcagatgaaaaggttgacgctctaccaattaatttaaactttcccctcagtcacaatttagacctccactttacaaagatcacacaagcctcaaaatctgaaagtttggtacaagttagccaatttcaggagtgataagcactaaaaaaaatccatagaacttgatgcaatttgcacgtttcactttaattgagactagtaatcgtgcacgtacaatgcatattttggaaaaacaaaattttggcacaaaatctactataatatgagcttacacaaaatatgaactctgtggtgattcaaataattagcattgttattatctcaaacatctatgcagattggataatctcggcatatctatcagccctccactaaaagcaagtttattaagcagaccctattttaccaacaaagaaaatatatatataattcacatgtactgctgaaatccatagttataagtgactaggaactatcgggaagaaatatattgtacatcatgaaagaacatgcactaaaatcgtgcaatattagccaaaacgtcatgaaagtactgctgtatttgtgttgaacatgcagtaaactgttggtaagaaggtagtaaggtagaatgtttttctgccagctaaggattttcgtttttttggtataaagacaacaaactatttaccagaggtgactcccttagtaaattgtccttcaaattcttaagggccctttaaatcacaggattgagaaaacgtaggaataggaaaaacgtaggattttgatagaaatgtaagtgtaaaatggaggattatacacttaattttggagagtcataattaagtaacgagaaaaaccaaaagcgcatgggataaaaaactggtgaaaaaaaattgacgaaaaaaccaaaagctctgggaggtgcgcggtgaaagatcggatttaaaaatctggaaaaaaaaccaatagcacgtgcgtagaaaaaaactctttcgcgtgaaaaaaaacaaactgacttttttttccttttttaccggagtcggacgatttttttttcacgacaagcttttttttatcgttttctgagtcggactttatttttcctttttttctacctttttagtcgatttttttactgacgacagaagcttttttaaatcctttttagtcggactttttttttcttttttaccgactatggaaatttcttgttcttttttaagtagagatagagattaaaactaaaaacataaaattaaaaccgattcaaatacggatgacgtaacaaagtaccggtaaaaacatttttaatttttataataatagagatagagatataaacccctgtaactttgcatattacaactatatccatagcagtgatctctcaccgtagatccgtgatcgtacggctgccggaggggggagaaagctggaactgcatggtgccacgtggtggggtttttttttttggacccgaatccttccagcactagatgataccccgcgcgttgctgcgggatatgtatgtataaaatatagttgcaaatatatcaacggaatcataatataataacaacaaaatgcatgattaatatattttaggaatgttatatgatagtatgaagcattgatatatcattctaggatgcgaacaaacagtgacactatggttgtaagtatagcagatataggttgtgttcggcagccctatttcagctgtgacacagccatattacacagtaatttgtgtcactgcaagcagctgtgtggctgcgttgcagcggctgcaacatgcagccgaacacaccaatagatggttttgttacagtagattgtaaatacatttttagtctagaataatagaattcctcgtcagcttgtttgctctctaaaagacactcatttctgatcatcttcttaaatccgatctatctgagtggattaattacccgattaaactgcatgcctcttttgagctctagccagtctctagagcaactgtacagaggacgtgacaagctcacagagtaaacaccatggcaagatgtcccaagaaatatgtgtctgcaaccgtagagaatagaggcaaccaatattttgacaaaataaagtaagattcaatgaaaatatttgaagggttcagttttatctcataccgcagaaccatacttgcacttttgttcaccaacacatagttgatttttcccctaacacgtatacatatttacttttagagcgaactaaacaaaaatgtgatgtttgatggatacttttagaaaaaaaaaggaagaatccaatttgtagcataattaaacagaagttaaggagaacaatatcaataaacttaccagatgatggttaatttggaaatctgatcataagaaggtgagtagatcgaattccaggcataactgcaaatggcaagcggtagaccaaatcagttgatatgctatttcatcctaaaatcacttggtggtattacggcgaggaaaatgagaaaacaattataggccagaaattatcagaaaccaccttcttaatagggatagggaatggagactggattcttttttttcttagatattgaaccgaatcctcataggataaatcgaatgaaatttggaacttgaagataaaaaacaggatataaaataatcttgtcattagggaggagaagcggacatgtagttagatcactcgagccagatatctgttttcaaaatcaacaacaggaagaatgagaaaaaaataaaagagaggaaagaactgcccgcttgcgagaggataacggtgacaggcgagagaccccaaacggtggcaccgactcacctgcatcttccgattttcgagagatgaatcagctatttgaagctctccaacacatgcaacatccattgtttgaggtgacgaggaggtgctggttaaaatagatttggttggattgaacgatcacgaagaactccaaacaagagaagctctgaataggattcccagcgcatataaggccctatttggcacagctccagctccagctccacccctcctggagctggagctcagccaaacagtttcagctccaccaaaactgggagtagagttgggtggagctctctcacaaaatgtactagagttgtggagctgggtttaggcagcttcacaactccactccagactcaactcctggagttatatttaggagttggagttgtaccaaacaggccctaagtgaataaagcccgggataagagattcagaggctcttcaatagagcccgggataagagattcagaggctcttcaatagcatgcgtcggtttctacttttgcatgcattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttacatgaagcaggtgatcagtcatgcatgtcaacgtgggtggggacagggaactcaatggatgggatatgtgtgggacgcagtcaatagtgcgtggtgaagccgagaaggcacatctgatcatccgttgattggccttgtgctggtaagaatccaacggactcaactgaagggatgaatcgatctaatctccgttcaactctgatctaacgctctaagataattcagatgacgtggcttcaccacaagacaggaaaatatgatagtggggatgattcgtatagttatataggattcggtattagagattatggcccaaccgacgtatcttcttttgctcttagttctctcccggtcccacatgtcagtttcccatggcccttctcctgaccttccccctcggaggcctttgtttgtctggaccggatccgggcccatgaggtggttgttccattgcaggccgaaaacgcagtttaaggcccctttgattcaaagaaaattcatagaaatttttagaggatttcattcctatagaatttttttctatatagcccttttaattaaaggaatagatcttatggaatcatatgaaattcctatggattgtctaatgccatgcaagttttggaggaattctaacatgaggtaaaacctcttggaaactttcctttgagtctttatctctcctctaattattgcgtttttcctgcggtccaatcaaacgaccatttctttatttttcctgtgttttgcaatcctctgttttacacttacattcctattaaaattctgcgttttttctattcctatgtttttacattcctgctattcaaaggggccctaaataggcctggagagaatttcccagcccaaaagtcccaaaccataggaagaacatatgcctcctcggctcctccttcgcgactccggcgacggcgacggcgacggcgacggcggcgcgcctcctcctcctcctcctcctttgtcaagatccggggccaaacttcccagaatcctgcacgatttcagagatttttggggctaagtagctacctatcagggatccctaccggaaaaacaggaagaacaagataattctgaagaaaattgcaagagaaagtagaggtcgccgcaagacacaggaaagctagggtttagatactttttctcttgatgattctcataactggatcgagacggcttataaggagttcgccgccgcgaggatacatgccagctcactaaccaaggctttaagccgacaaagacaatacaattagcaaaaaaaaacagtaattactggaagccacccgcatcgttggattttcattagcgaaacggtatcggctcatcagcgccgttcatttccgcaactcccctgtttctgttctgttgtcaccacacattcagaatgttcagcaatttcagagtagcaggatctgacaagactcccccctgaaagacccatgccctcatggggtgaaattaggaaacactttagtgatgaaggatgcatcttcccaggtggcagcctcagatggaagattttcccattgaattttccactgaacaacaggggcgttgttgcgaggaatcaatcgtcgttccaacacagcaacaggggcagtgagtatattaccataagaatcaattaggggcagtccaggttcagggatagctttgcgtcctgcatggcgcttcaattggctgacatgaaacacgggatggatttgagaatgttatggcaatagtaatttgtaagcgactgacccaattttttcaatcacacggaatggcccataatagcgagagtgtaatttgagagaggaatgtagacccaaagaattgtggcgatatggttgcatcttgaggtatgccatattacccacttctagagttcgttcagtgcggttagcatcagcatagtgcttcatccgagcttgtgccttgtctaggctagctttgactgtgtctaataaggcatcttttgcttgctggcgatttctgaaaccttctaacaaagtggatggtagtagggcttcccctatcattggaggtttctggccatagagagcctgatatggtgtcatattgagcgaagtgtggaaattggtgttgtaccaccattcagcttgatcaagtaatgagctccactttctgggtttggtgaaggtaagacagcgcaagtaagtctccaagcattggtttactcgctccgattggccatcagtttgagggtggtatgcactgctaaagtttaacttgactccagcagcattgaagacttgtttccaagtgttggaagtaaagaggcgatctctatcactaataataacagttggtaatccatgtaatctgtaaaagtgtgtcttgaagagatcaacaatatgttcagaagtgaaggggtgacttaaggcaatgaaatgggcatattttgtcaatctatcgacaatgacccagattacatccttgttgtcagattttggtaagccctctatgaaatccatagtaatatgtgtccatgctagctcaggaataggcaagggttgaaggagacctgggatgtgaacatgttcagtcttgttcttttgacacacaggacattctttaatgaagttaatcacagctgatttcattcctggccaatagaaaatcaatttcaaacggtgataagtgcctctttcaccagaatggccacccaaaggagaagcatgaaaggtctccattaactgatgctgcagaacaagatctttgccaatgtataatctgtccttataacgaagtaagcctccttgtaatgaaaaagggggttgagcttgggcattcacactgagtttggtaaggagaagtttacacttgtcatcgaggttgtagctggccagtacttgtgttatccattcaggaacaacaacattgagtgcctgaatgttgtgaggtggggccattcgagagagagcatctgctgccttgttttccttaccttttctgtattctattttgtaatcaaaactcattaatttaatgagtaatttgtgctgaatgccatctgtgatacgttgttcattgatatatttgaggcttgcttgatcagttcgaattaagagagaagaacccaaaaagtaatgtttccatttcttcaatgcttctaatatggctaaagcttctttgtcatatgtggaaaaggcagcagctttgattcccagagacttgctgaagtaggctaaaggctgacctccttgcataagaacagctccaatgccatacccacttgcatcagtttccaacacaaagggttgagtaaaatctgggagagctaaaactggggcctgcgaaagtttaagtttgagagcttcaaaggcttgttgctgatcaggcccccattggaactcattcttcttcaggacattaaacatgggtcgacaaataatgccaaagtgtttgataaaacggcgataatagccagccagacccagaaaacccctcaactgtgtaaccgtagtaggaataggccagttttgaactgctgctattttttcaggatctgtagccaccccttgtgcagagataatatagcccaggtattccacatgttgttgtccaaaaacacacttggatggtttggcaaacaagttgttgtctcgaagtaactgcagcacgagttgcaaatggagagcatggtcgtccaacgttcgactgaatattagaatgtcatcaaaaaatactaggacaaatttgcgcaagtatttggccaagattttgttcataagagcttggaaggtggctggtgcatttgttaatccgaagggcatgacgatgtactcaaaatgaccaagatgagtgctaaaagcagttttataaatatctgaaggatgcatgcgaatttgatggtatcctgaccttaagtcaatcttggaaaaataggcagcaccatgtagttcatcaagcaagtcctcaatcacaggaatagggtatttgttcttaattgtttgagcattcagttgacgatagtcaatacataagcgccaagaaccatccttctttttgacaagtattgctggggaagaaaaaggactcacactgggtctaatggtgttagaagaaagcaactgttggaccagatcttcaagtgcattcttcttatgatgtggtaaccgataaggtcgcacattgacaggtttagcatcagaaagcaatggaatagtatggtcacagtctctggatgggggtaaatcttgaggctcagcaaagacatctgcaaaatctgccaagaccttggaaattacaggagagtgagtggaactaagttctgcagcagcacatgtgagtggctgaaccatgaaaagtgctccaacagccccttgtgatattaacttggataattggtgagtgtcaaccaagagtttgccatgagagagagagacatctgacagggtaacttcttgggtaccattaagaagtagagatagctgcctgtttttcaaatcaagggagagggggctgtgttggagaatccagtcacaaccaaagattacatcataacctttaatgtccagtactttgaaagtagatacaaactgaacaccttggatctcatatggctgatcaacacattgagcttcagtaaataaggtacccccattagctatggtgactggaattggttcatgattagaaatgtccaggtgtgctttgtggaccactttaggagacaagaaggtggttgtgctgccactgtctatgagccttgtgctaagcaagcctggaaggggctggctgcctcgccgtcgccgccgcgatgagccaccggaggcgatctaatgccaccggcccgccgcctcctgagggcgtcggcgactcatccaccgcacaagcctcgtcgacggagaaggagaggccggatccgccgtccgtgttgggatcggagcgaagggtgcttgcgctggcgctggccttccgcgcggcgaacgcgctgctggtgcgcacctacttcaaccccgacgagcactggcagtgcctcgaggtcgcccaccgcatcgtcttcgggtaaaactcgccgccgccgccgccgccgccgccgctggctgttgtgcgccggcttttagtctgcttgtaagtcgcttgaaatcgaaatagaatccagctgacactctcaaagggagtgggatacttgaactgccgcattttctgttcactgcaggtatgaccaccttacttgggagtggaagaggggtctccgaagttacctccatccgttggtctttgctgcgctttacaagattctggccctgctccacttggataccccatggtttatggtaattactctagcaaatcatgccaaaaactcattaggtatttctctgggcgaagattgcaagtgataattctggtcaatgtcatgtggtgcttcaactttctattaacacaagttcagttatatgaaaggggatcacaagtgctcagtatcaacaatttctcctgtagctagattctttgttgggatagcttacaaatgggttcttaattctaaccatgcagaatgtgtaccctgttctatgttcagtctcaattctaagcaaataaacctatatgttaatcagatatcactccactctgcatggccttattttttccacgcactgagaagcaacattttcttattatttctttgttttcccccacaggttatggctccacgtcttctacaagcagtctttgcatcttttgggcatctctacttatataaactttcgaaactcattttcaataatcatgttgcccagtgggccgtatccttgagctcatttctgtatatacgattttctttttcatgaataaaggaagtccattttcctggtgaatggtgaccttaacaactcatttccagttattttcgcagctggttaactggttcatgctcttctgtatcacgtgtactctctcaaacagcatggagacagttttgactattactggactttactattggtttgttgcaatagagtcttcgaaaggaactttggttgttccaaggcagaagcctgctagcaagcaaagccctccatcaagaaaaatggctctactcatagctgccttagcttgtgctattcggccaacaagtgccataacatggctatatgttggtcttttggattttattcagacgaaatcgaaatcccggtttctctttctcgaggttattccactagggtaagaaattattttaaaatttgcatcgaacttatggtttcagtatatttctttcttggatttgtgcactggatgtgtataaattggatgaatttaggatgttgtttatggtaaattttcataatgtcttttctctgttatttcttgaatttttgcatcataatgctgatggattttgtcttttatttcttaattttttttgtatcgcatatatattatgctgatgtatatataggatgtttcccatgggaagaatgctcgctggtcggtcttctgaaaaaaacaaactgaacatatggaagtcattcacattgttcaggagggatcggcattactgtccaccatgctaaatggtagcaaaacaaaggttgcatggtcgattactatatagttgtgggtaagataagttatgcacaaacaccagctttagggcatgtgggctagattgttacaatcctatgtgcgatatgcaattgtctgtcgtgtcatcagcattatgtatatcatttctgagatcagatctcttgaccccttcagtttcttttgttaaaattgcgatcgccttattgtccaaaaaaatgatgatttaaggattgcttttcttgtaaggtcatttgttctctttgtcaaaattgaggaatacctctataaaccttatgccttttaatttttctgcagggtctttgtccttgctgtgacaacatttcttgattgttggatgtatggttcccaggtcatagtgccgccacttaattttttgaaatttaatctcttctcttcgggaggcgactactatggaacacatgtgttccattggtacttcagccaaggttttccatcgatgatttggactttcttaccgttttcaatttctggaattatgaagtctcgagaatggaggcttgcaggtcttattgtctgggtattagcagtttatagcatacttggacataaagaattcaggtacttatctcttctcacaagtttgtaatgttcaatctcttctcactacacaagtgcacatgccctgatataaatggatcgaatacaacaggtttgttctcccggtgcttcctttgatgtttatgttctcaggatacaacttagctgcaatggcacaattcaagggaaaaggtcgcagtgagaaaggccacctttcaaggtttcagctttctgtcattctgcttatcttaacaaatgttccaatggctttatatatgtccttgtaccatcaggtaagttctacttttaagtaaacatattctttatctatgttgttccttaggtaaattttgttgttttctatttgcgcctagttagcttttcttttcaaaattccttaactgctcttatgtgtacattttcactttgtcagagaggaactgaagatgttatgttttacctgtcacgagaagcccaagatggaagagtaaagagtgtcctcttccttatgccttgccattcaacaccttattactctacattacattacaacctgcctatgcgctttttggactgtactcctaggtgattatgccttcacttttttctagtgcagtagatatagcatttcattttactatgttgtacctgatttagccaattatcctgacttagcgtgcttgttaccagcgaaaaacaaagggaccttggatgagtcagatcgtttcctcatgaacccatcagattttgtgggcaaggtttttggaaatttatcttctttcagtcacattgtattatttgagtctgaagaaaggcatctcaagttgcttctgcacaattcttttagagaggtaaaaccatgttgaatcttaaaatctcttcttccctcagtttaataggcatatgcatataccttttttctgtttggtagtttagatttcccttttgtaagaccttgtcagtttgttttaggctttctttcgaaagccgggtaatgaagtttacctgcagtctaaaaaaaatgcatatacttagtagtctttatttatatgatgttttagaaacttgtgcttaaacttttcttactcaatgccttgtaaattggtcatgttgaaatttttatcattagatttgcaatataattttgcactagcatatgcatataaattgatattgaagtcagacattgcagctgatgtccaaatggaactgattacttctaaaaagaaaaaaaaatcaaaggtattgttcaagttggttcataaagaaatgtctaaaacacaaaggatgggccacatttttaagtttgtgccccccccccttctctctctcgcgtggatgcacgcctcctctcatgttgtagtattggctatgcacgatcagatgactatgataatgacatattttgcggtaacattgtgggtgtaccaaccctagtgtcctaatatcaagaactacgtgtcctagaaaccagtataattaaattcccttttgtgagtagtcctcctagcaagaattgccatcagtttgtaaggtgagcatctgacacaagctctgcattgcttgcaatcgatggcaaaataaaatcaggttattgtttgttgcactcaggtagttaatagttttattgtagttacaatttgtgaactagctgtcttaaaacatgatggataggttgcattacattgcatgattggctgtgtatgacgtgataattaatatattatctcttgtattcttaatctttcctgtccattaacatcatgacatgtgtcctggttggcaggctaggagattttttcactcccacttcaaggttgatagagaccttcagtcatcagttgtagtttattcacggatgaatgtattgtgattgctgtggcagaaaaggcctgttacttcgttagtctactatcttgtctaacaatttctaatcatgttttggccttctttaatttgtcattcaataaatgatctgtaacttgggcctttattttgagagagagaatttttcccatcctttatgatgcgattctatgtcgatgtattggcggcaacttccatggtgaaagtaggacaaaccacctggtaaaaaacaaagaaggtaggacagaccattccatggcacattgttgttgctgacatactgaacctcataaaatcatgtcacatataagttttcattgatttcctgcagtttttattcttgaacacaaatatttttacaagatatttatgtcaggagatgctaatcgaaactctgctaaaaccatttattgatacttgcatactcatcatctaccagtttctatatctagcgccatcaagcttccgtgtcgtccagtggtagaagggtcatactgtgatgaattttcaagcaaacatacagtttcttcattagcaccctcaatcaattgctcacgccaggtgcttcttattgcttttaacctttcagctacttctgtcattaatggccgttcttccccctttgtactcaagcagcattttgccagttgagcaacatcttggaacagctctgttccaacacctaatatgttcctgtccaagatggactcaagtctgttctctttcagtgccagaaggaaggatgatgcaaggcttttcttttcttcagtattttcagaataaattgcagtctttcctgttattagttctagaagcacaactccaaagctataaacatcacttttctgtgttagctggcgctcttgtaagtattctgggtctaggtagcctagagtcccctgtaccattgtcataaactgtatttcatcttttggaagcatccttgatgctccaaagtcagtcacttttgttatgtagttgtcacctaggagaatgttgggagatttgacatcaccatgaactattggaggggatgctgatgaatgtagatatgctagtgcttctgcagattcctgagcaatccgtagacgagcatccagtgaaatggaggttgttctgtatttaccatgtatatgctcgaacaaagtgccatttgggatgaattcatagaccagcattggaacttccacttctaagcaacaacctagaagccttaccacattcctgtggttgatctgtgaaagtataatcatctcttgcacaaattcatctttctgaaccatattcataatctttgagcgctttatggctactattctgttgtctttgaggatccccttgtatacagtgccatgaccgcctcttcctagttctttgcttgagtcaaaattgtctgttgcattctctagttcttcttttgtgaatattctcacagtatcaacttgctttgaccggatttgctcatacagcagcatacccccattttgttgaaagaacctttctttttctttcatcagctttcttttctggcattcgatcagtagtgcaaaagtgcaactaagcagtataatagcgcataccgaaatgcctgtgaagaaaaacctttttttagttaccagaagtcgaggagaaattttctgtgggtatttattgctgaattagcattataatactgtatccttgtgtaagattgctatataattgaacctatggctggagataattctcctataatatttctcaagttagttacagatagtgaaacattttgcaatagaatgcttactgtaatatatgtattttgcctatctgtctggcttctagctaaggggaatgaagtagacaattctaccaagcgggaaatgtcaggagtctactgcacagtaccttttatatgttattccttcatgaaatattaggactttggagtattgggaattacctataaacgtttttgttagtctagctctttctgaagctgttattggattgcagggctctctctttggatctgtactttgagtcccaggcccgcagtagcaatggtagcccccaattgtgttgtcgcagattccatggcagtactgacccggagattcgcactcgttgatatctgttgacgccatggaaaagtagcaaaacaactgaagatcaatgcacagatggacataaggtgaacttgaaaaatagaagtgaattgcagtgagttggttaccttggcaccctccttccaggtacgggttgcctgcaaacccattgttgcaggcacagagatacccggtagcatttggtgagttgatgcagctgctgttcgtgctaacacaggcatatgatgtcctgttcttgggcgcttgggcacatgattctcttccagcaacccaatcaagcacagtgggaacccctttgtacttgtctgtgaacttgtgaccttctaggtaatcaggctcaaacctgaaccagtcttgctcggcaacgaaggcataactgcatgggttgaagctgttcacctcagaattgttgaacctgctgtcgaatgtcacgtttaaggaggtgagatttggtgcaatagatgtctggcaacagcccatgccggagcactggccgctactgtccacactctgcttgtcggggcacatcgagaagcacccagccccaacgttctgttcttcctcgttgtagccccccaggaatgcaagggtattgcatccaaccaccgttaacttgttagccctgctggataatgtgaaaaaaggagcagtagatgttgatacccaaccatctgttgaagtgccatctgtgttgttggagcacttgtcggcgatgaaggtgctgacttgagcctgccctccaatcagattgaggctgtagatctccatgttgctgcttgagttatgcatgtaggtgcggttctcctcgcatgaaacgtcgaacccatcagtgtagaagcaaccagcaccgatgccgaaggggtagggaatggtgaggttgccgcatgttcctctgcatctaggcttagccatcctggatgctgcactgaagctgatggttgctagcagtagggtggttgcaaggatcatccatggtactactccagtcatctctctgtatgtcttgtattatgattctcctataggttctagttctcttctaactgagctatgcttatataatgaagcaagcctctggaggtccagtccttagaccctatttagatgggactaaaagttttaaatccctatcacatcagatgtttagacactaattataaatattaaacgtaggctattaataaaaatccatccataatcttggactaattcgcgagacgaatctattgagcctaattaatccatgattagcctatgtgatgctacaataaacatactctaattataaattaattaggcttaaaaaatttatctcgcaaattagctttcatttatgtaattagttttgtaagtagtttatatttaatactctaaattagtgtctaaatattaagactaaaattaagttcatggatccaaacaccaccctactggtgcttttaatatggacgtatggtgctattgcttgattgcatccattcagagcagactcggtcagaacaactagtggtttccaggtacattaattattaatatctcaaattatttcctggcaaaaagagaagaagagaaaagctaaaattattgtgggccgacctattcacttcattgccacattgatattactaaattttggtcggaaaacaaattaaatataatattaccaattccatcatacaaaaatttggtagttcttgatttttgctcttagaaaaacactaccaaattttggataggcatcaaactaaatacatttaacgctaccaaaatttagaaatgtcaaaacttatccaaattttgaattgccaaaattttgtaagattgaaattggcaacacatgattttccctgtctgtcacgtaccattggtcaatttgcatgttttgccccgtcggctacaaggacggcttctatagtatcgtttacttcgtcaactttaatcggttaacccgttccgtttggtctatctatagtatcgtttacttcatcaactttagttggtcaacccgttccatttagtctatcgttagcatatttttcgaactgctaaagagtattgtgaaaaaaatagtgtaggagtttgttaaaaaatcaaataaatctatttttcaaatttataacaattaatagtattcaattaattgtgctaatgactccactctaacctcaaggctcaagccttaaatttgtgacttgccatgtctactccctgagaatcacatttacagaactgaatgttatgaaatgaagatcatgcgaagccaatacgccgcatcgatgttatgaaatgatcacacacaatactagtactggcaaatctcaaacagaaaagccaccgagatacagcagtactgcagtatatcagtgtgcctccctaacgcttgggccctttttcagtttctgaaacaccgaaactattttactaccagttttctacagaaaaatatagagagagctgtttaccgtaaaaatcacgtgttgggtcaagccattgagcttgagctgcgggtgcgaaacaggatggtgagacgagcagtcttatgttttcacttatccttattggtcaaaatttaaattttcaaccttaaacttagagttgattataagattttcaccataatttatttttcaacatttgtatttagctcgttaagaaaagtatataaaaattttattcataaattatttttaatttgcaaatatatcgttccgttctttcgtccaatatgctaaacagggccggagagatttgccggacccaatggtatccatgttgccttcgattgggtcaagtcatgggaagaagaatccaaaagagggagactgatgaccattggcatcgatgattaaagagagggctcgtactaagtgctagtgatagacattgacgccaattgatagagcaacttttgaccacaagttgatcccgcttgccgattgtaaagaaattgagcatagtgtgctctctctgtcctataagtacaacctaatataaatgtgatcacatctatattatattgtatttatattagagcggaaggagtactccctccattccattttaaacataaccatgagtttccgtgtcctagcgatcaaggtgctaactcgagcctacccttcaagcagactgatgttgtagatctccactcggcttgtggagttatgcataaaagtgcggttatactcacatgaaacgtcgaaaccttctttgtagaagcaaccagtatcaatgccgaacgggtagggacgagctaacaataatgctgaactggtcttgagattcatgctatttccacgcgttgcgtgatgctatttggcatctacgcggatacaaacaaactgaattttggaagactcgtagacttgcgttttgccgtgaagtacttgaaggcggatcgctattgaaggacgacggcaagacgcgcttcgcgaaggttacgagtcaattttcaggactttagtactgtaggtctaattgggtcaagtcgttgcctttgtgtgatatctttcgtccgaaagagcgtcgttgttttacttatgtttataggtaggatttaaattttaaaatttaattttaaagttgacttagggagtttttttctaatttattttacaccatttgcttttgaatatccgaaaacatatatatagaagttttatatacaaattaagttttagttgctaataagataaacataagagaatgctatgaatgtaacatctcctatcaggctatcactccaaaaataatgaacaacaaattgtagatagcttgtttgtgcataatccttttgttttgtttacggtgaatctggatttaaaattactaaaacaatgtgatcatcatatgcaggcttcggccattcggagcgacccaactttcgttgacgggccgacgtcgctggctgaaggtgaatggaacagcccatgttccattatattggcccagaacggaatcgtaactattggttcctaatatcggcccaatcaattgcgttggttatgaatggcccatggaagcccactattgctgctcccgtgctccctataaatagctagggttttacgccacttcccccatctccgccgccgccgccccactctccaaccctagccgagaggagcagaccaagcaatggtaaccttcgcgccgccgccgcctcattgcttcttcctcgtctactcctagctctaacatggtgatcttcttgtggctcgcaggggaagggtacgggcagcttcggcaagcgccggaacaagacgcacacgctctgcgtccgctgcggccgccgcagcttccacctccagaagagcacctgctcctcctgcggctaccccgccgcccgcatccgcaagtgtaagcctcctctagatttgtacatgtgcttctcggtttcatgtagatttgatgattatattgcgcctagattaaccaagtaatgtttagaaactggggtgttagtggttcatcttttcttgattagctgagatgcgttgtcctgcacgaaccttctctttgtagaacctgatgttttgatggaaatgatgaagaaaacattggtccgtgtttctgataacccgtgactgatagccatgttttctaaactgatccctgtcatgtttattgtctcggacattatccaatctcgttctatctgtggtcctgagaactgatttacctgctcagctgcgttgatcttaaccgaataaaaattaatgtgttgtttgtacatatgttttttttccacaaatgattataagctaaaatgctttcttggaaaacataaggatgaccagtttcatatgaaaacttaattctgtttgtgaggttcaagcgatgaggttttaactgcaacaatatgatgggagctttgctcctgtgattcctatgtatttaagtctctgatgatccttccaacatattttccctttgaaaggctaatgaaaactgtcagtattaacgtacaaaattcaagcactgatagttctcatgtcgtgattgatcacaaatatatttttttctttgcatttgattttccaaatggttttgctgtcctacaaaaaaaagcaattaggaatcatgaaaacgttcgcatgtcagacttcagagatgccatggcattaatgagaagatgttttcattttctgagcttatattttattctggctatcacatttgattagatgatttgtgcagtgattatttagatttttgaacatttgtaacactttgaagttttgtaccttcattgtgtttattatatatttctgtgttgcctgcttctgttgtgaggcaggctcaagtgatgagtgaaaaactgcaacaatatgatgggagctatactcctgtgattcctaagtatttaagtctctgatgtacccaatgcacacagttttttctataagtactcaattttcccttgtcttatgttttctttcgactgatcctctaacctgagattttatttattctgtttcttttcttttctcagatcaggcaattttattatatttgctctttttcaaccttcagttcaaacatatggcaattctatttgtcactctgttcaccgttatgtctacctgctcctgctgctgccttgtttaatgtatggtagcagtacttagttgagttgtttggtttgtaataatgtaaccatttaaattcgtatcattgcacatctgtttcctcgcattgttcatttaatgccaaatacacattaaatgaaaacatacctgatttgagttatattgtttgtggttagcctttaaatctctagttagattctgtggttgaatttctttttttttggatttgcttagttttaatttctgcgatgtcatttcagacaactggagcgtgaaggccattaggcgcaagaccacaggaactggaaggatgaggtacatgcgacatgtgcctaggaggttcaagagcaacttcagagaaggtgcctggaacttttcttatgttttaaatctcatgggaaatgttaattgcgttcaaaatagtaaagctgtttggattcattatgttccttttgctctatcgattcaggtactgaggctaccccaaggaagagagctgccgcagccaactagatcctgttttgctgtcaaagcagctatgaaactagaatttaagaacttttgcctggattgagccatctttcctatagtatgatgtacttatcttgttttatttgttatgatgctttaaaacttgacctctgaaatttcagtcagttgaacctctcgtatttttgtttcatacaatgttcatgattctcttagcgtccatggtaacggtggtgttttattttgttccgtggtgtctccgcttgtttcgtgctgccattcaaccagttttgggaaatgcttctgtttggtcgaaatgagctgccaccggggttcacaattgcgatcagtttgaaagtcatttatttatttatttttgttaaaagccgacgtttactggttttcatctcgaaacggtatgtaaaacctggctaccatcctcaatttgcacttgaactggacccaattgtactagttttataatgtaatttacctaataaagttgctttggtaagtgtcgggttcattagttgaatgtgtattcggaagtacttagaacttacctaaggactcaactacatctagcatgtgaaatacagttatcagctaaaactgacttggagtaaaatacagtttggctgaagctaaaaaagtcatacgataaactgttttcacatatgtggaaggttgttcagcgtgacaacatttcggaatcttcgagcaaacaaatgcatatgtttgttacaatcaagttagtcgaaggaaacatgaaacagaggtcgaaggcgcataaaatgcaagcaatttggttaggcacgcagcttcagccaggctttgcttcactgctcagtcgagtgatatattcagatggatggatgcctgtctggacggcggatccatcactggctaccggtggtggtagtgccggcaccggccaccgcgttctgtcttctcacaagaaaagattaggcactcccctgattgatggttactactagcacttagcacacggcccacgggcctagcctgtcactgccaagaaattcggtctataaaccaatgggccgtgttgtagtgtactaggcggcgcggtgctgctgctgctagtagtgtagatccagatgaaaaacaatcttcttgccgcgcgctgttatatcctgattcgatttgtcaggatttgggtggcgatctagctagctattcatggccatcaagctgcttaagttagatggcccagaaataggagctgcaatattggataggagaatgcatattcacatggaaagcttgattttaatcttgttcatctttctcattctgattatttctactcggataaataacaagagtaattaaccgagtgggtttataattattcacctgctttcaattgcttacattaagctacatgatctatgtctaatccttacagaaaatggttgttggtttgttacaagctcaaaattcttacaatttttttagaataatctacatacatgaacaaatcattaacatgcaccgaagaaaaaaaaaaggaagaaagaaaatggacacagctaagcgtagtcggagtccggcgtcgtggtgaacaccggcttgtccttgtccaccaccgccgccaccgccggcggcgccggagtgggggctttggcgctggcgctgccggtggagctgccgctcttgcggcgcggcttggcctcgccgagcatggtgatgacgtcgcgcatggacggcctgtcgcgcggcaacctggcggtgcagagcacggcgatgcggagcaccagcagcatctcctccctgacgtgcgggcagccggcgccgacgagctggccgtcgaggtggtcctccaccgtgttgctccggatcttgttgcgcacccagccgacgatgtcctgcccctcgccgaacgccgcctccaccgccctcctcccggtgatgagctccatcagcaccacgccgtagctgtacgtgtcgctcttctggtccaccttcatcgtgtacccgtactccggcgcgatgtacccgtacgacccggccaccaccgacaccgactcgccggcgcgccccagcgcacgcgccagcccgaagtcggcgatgcgcgcctccatgttggcgtcgaggaggatgttgttggacttgatgtcgcggtggatcaccggagggtggcagtcgtggtggaggtaggcgagcccctgcgccacgccggcggccacgtcgtagcgcgacacccagtccaccagcgtgcgccgctccggcggcccgtgcagcgcctcccataggctgccattgggcatgaactcgtacagcatcatggcgtcggcctcgttgtgcatgtagccgaggaggcgcacgatgttccggtgccggagccggccgaggaggcccacctccttcagcacctccgccgtcagctccggcgcggcggcggcggcctcggcggcggcggctggtcgccatagcttcttcacggcgatcacggcgcgcgcgcgggggagctcggccttgtagacgacgccggtggcgcccatgcccaccacgttcgcctccttcacgcacgcgagcacctcggcgcacgtgaaccccagccgctggaacgccgtcagtcgccacggccacgcccccgactcgccgccgaggttctcgtcgtcgcagcaacccgcgccgtccacgtaccaccgccggtacgcgtagtgcccgccgaacagcgccgcgaacgcggccacgacggcgaccatgccgaccagccaccccaccgcgatgtgcctgagccgggcgctgccgcgagagcgcggcccggcggcggtggaacggctgccggagcacggcgggagcacgccgccgcacagcccggcattgccggccagctcgtcggggttgatcgagcgcagcacgccgttgcccggcacgggcccggttaggttgttgtacgccaggttgagcgtctcgagcgccggcgagctcccgaaattctccggtatgccgccggtgagaacgttgctcgatagatcaagaatggcgagcgccggcatgttggcgagcgagcgaggtatctcgccggcgagcttgttccgccgcaggttgagcttgaccagcctctggcacgaggccaggctggacgggatcgcgccggcgagccggttgttggacaggtccagcgcggcgagcgccgggcagtcctggaactggtcggggagctcgccggagatcatgttgtccgacgcgaggaagctctgcaaggtcgggatggtgaagaggctcgaggggatggagtactggaggtggttgcgcgacacgtcgatgaacgacagcgacgccgacgacgcgaggtcgccggggatctcgccggataggtcgttgccggcgagctcgagccgctgcagcagcggcagcttcccgaacccgacggggatcgtgccgttgagccggttgccgtgcacgcgcacccgcaccagcgacgcgcacgacgcgagcccggccgggatgccgccggtgaagccgttgttgaacatgatcagcttgatgagcgccttgccgtcgcagatcccggccgggatgccgccggtgaatccgttcgacgacacgtccacccactgcagcggcgagctccggccgagcgacgccgggagcgaccccgtcaacgagttgttccacagctcgagcacctccagcttcggcatgtctccgatggccgccggcacgacgccgtcgaggtggttgcacatgaggttgagcagccggaggtggctcagctgcgccacctcgtcgggtatcgcgccggtgaacgcgttgtcggagaggtcgaggaagaccagcgtcgagatgttgccgagctccggtggtatcttgccctcgaggttgttcttgtagaggtagagggaggtgagcgccggaagcttccctagctccggcgggatgggcccgtcgaggttgccgacggcgaggtcgaggtactggagattggcgaggttaccgagctccggcgggatgccaccctcgagctcattgtacccaatgatgaggctctcgagggactccatctcgccgatctccggcgggatcttgccggtgatgttgttgccggagagtcccaagaacttgagcttggtgaggctccggtaagccgcggggatggcgccgccgaagaagctcccacgcatgtcgatggtctccagggacgtggcattggcgaggtcctcggggaggggaccggcgaagttgttgccggaggcgttgacggcgacgaggtcagcgcagccgccgaggccggcggggaagccgccctcgaaggagttctggctcacgtcgaacaccttgagactgggcagcgacggcagggacttgggcagcgtggtggcgaaggcgttgttggagatgttgagcaccgcgagcgccggcagccggaacacgtcgtcggcgaccttgccgctcaggttcttgccggagagctcgagccgatcgacgaggccggcggcgttgcacccgacgccggtccacttgcaatgcggcgacgccttgccgccgtcggtccagtcggcgagcgcgctcaccgtgtcgacgaagcccgccttcaaggcgagaagcgccgaccgctcgtcgccggcggcggcggcgccaatgccggagggcaagatcaaagacagcactgtcactagcagcagcactggcactgtagcttccattggaaattggaacaaaaatggaagcacctttgctgagcttggagagcactagctctgcttcctctgcttgctctgcctctgctgcttctagtgctgtgccatgtcagtgcagtgtctgctctgcttaatttagtttactgcactgattgcatctgcaggaagagcagaggctgcagcagctagcaagctagagatcacaacaaggcagaaaagtcatatatatgatggtgatgagaagattggttagagaaggagcatatactaatataaatcttcttggcattttttaacatgcaactttgatctagattagtactagctctactctacacctcaacatagtgagcaaatgtgaggtgttaatcaggattagattaagggtttaacaggctggggttggggagctggaggagaggaggaagaaacaaggagaagggggaggcatgagaacatggaacatggagggaatgtgttttaaagtcatggcttttctaatctgcttttgagcaatataccattctttattattttactttatcccacccaacgttagattggactaattaatacatgtttattttacattccctatctgtgcagagttgcagacagtagattagctctagcttttagacccccaaatactagtagtagtaccactatacagagacctactgtaattgggagttcgtacggtttattctttggaaccttctgctttcgtcagatttactcctaccatcttattttctacaaagagaactaatttactcatacagtttgtgtaggtgtgagtccaacaattgaattgatctgataataaactaagtactagaagctagctgaatttctccatgtaggaagctagaagagtagaaggatgtgaagagctgctcctaattttgagggaagaaatactgctaatatgttttttaagtgtctgtaaaacaggacataccttagcactttgcaggtgaaaatgaatataaattaacccaaagagagacaatagggtatgttcttgcctcttggtgttgtcctgatgcaactagcaccctaagatctgtacacatgtcctgcataaaaattaaagaaagtttaccctgagtgaggcatatgtacagtggttgcatgtgttgagccctgcctaagttgacctcgttaaaataaaatttgtgctaatcattcctgtgacagtgggcagtagctgctgctgttactgctctgttctgacaaggggattattggttctttgcttggcacatgtccccagtagaatgtcacagctagtaccacatcagattaagacaacaaaagcaagtaattaaatgggttaactagcagagctgacacaactaaggctgacaaaactatcaagagcagtaataaatttggactgctgggttgccccatgcattcttccatgcctgatcaaatgcttacaagctacaacaggtgcattagggaaagaagcacttcattctatattctagaattagactcaggcattagaagaatttcaaggaatgattccttgttctttttttacagagatgatccttgctcctaaaaagggaaaaatttgtacagcaaataagtggtagtaagggagtgcccagtagcaactaaagcttcttgacagtctgcagaaccttctaacagagtaggactatgaacatatagaggagatgtttagtggtgcatattatgaatgctgaaaagtgcagatggatatttcttacaataaactgtaggaataccaaaacaaatcaaattcttaatcctcacaaaattttctaccaagttgatgtattgtctttataccaataacgatattacaccatcctccttaatagttctttcctaatttgctgtacttcacattgccatctagcaacattcataatctctcattatagtaggtttacatatgtacatagggtataaaactctagaacatattgaagtatgttgcattctatagttttctgaaattgacggagactatacaaaatgattgacatattcagcggcaactaagttagacaaatcacgatgataaacacaagaaaataaccaaaatgtcaagataactcatagcatgcagccaaaatgtgaagcaaaagtttggtcaggaaatgggaaaatgagaacaatcaagagcactttcatgcaacaacaataatacatactggttcttgcatatatagttgcattgtactcactaacctcctgtttctcagtgaagaatgaattcaagacaaccaataacagaagttgcattttggacataactgagatgctcttgtaaaaggtcttaccctcaatcttaatacaaagctacgcgctttgcgtattccccaaaaaaaataacataagttgcatcaaagcatcaaatgatgttcatatgtgcttacagtccaatttgatgtatctggcacaaatcagaacggcaagctccaaatgtgccacaaacaacaaaatggatacaaacacatgcatctcaattaatacctgaaaattccatctatctagcctaatctagttcgtaggagcctaagcagagtttcgaaatttgtgcagagaaactttgcaggctgcgaactgacgtactcaagagatgatcaaatgttgggcgtgtggtgctatttaagcaaatgtttgcaccaaccaaacttaatcatgcaaccatgagtttggtgtaggaaatataaagatagagaaaaaagacacaaagttagctatgctagcctgtgacattctcttgatgattattagccttttcttcgcttccacaatcattctgttccagcttgttgtggaatcataaagcatcaagcttagcttgctgaactaatggcatgcagcatagcttcagtgttcagattacgataagttgccatgtcgtgttactacctatcctgctaaaagaacttcaggtaagctgcaccgttagggcaactacgtgcactgctatctacaactagatggaataattttgacagacacgtcaacttgttgtttaaccgacaagatgacaataaacaatgtctaccattgagatgtcactgtctttagcggtttatctcaacttgagtgacagagtcttctacagtacaaataaagctaacatgcacgacccctgtcctagcataggaaaaaaaatcacaaacaaagaacaagtagaagaattccttaaccttgcttactttctatcccctcttgtcgtctatctctcctatcataccattcataagctccaggccggcagatccaccggacctaacgtaacgaagataaagaaataaattccgatgaacaattggtgaggttacattgcgttgcatgttgcaaatgggtcaattgggtggcattttcccagccttgccttgccctgagaatcttcccatgttatgttttgttgctcaatactggagaagggaaggatggaacctaacatcccatccctggtgtctactttatcaggttcaggttacttcataccaaagttgaaattgggtacatgaagttgaataaataatagttgggtatatatcaaattattgttaaattggtattttaaaacttacaaataccttgaatagtgtatatatagtgcattttaagtgaaaaaaaagagagtaatgatgaataagtaaaagtaagataaaattacagcatacaggattacaggatcagatcataagcttgattttgaagaaacatttcctaaacatcaaggaaaataatttgtgagatttaggtttacttcttgccacctataaatcttaaagaaaatctaaaagaaactgagtggattagagggcagtataagtgtacagaccaattgaaaataattacggagtataggaaatcaagaaaatgatattttataacatataataaaagaatcatttaacatgcaaaactaatcatggagaaacatgcagattaatcatggataggggaatatgtttagttggctaaacagcctcaccaccctagctaagcaggcacatgcacacatgtggcccattgatagacggactccattaaactgaggctggccatgtgaagccctcttactaagcagcttccaaagtatatgttaacccttttgttatcagtattctttcacatgacattccagtgcctcttatgacacccacttccatgtgggaccaaacgggttggacccaggcgtcagtgaggggttcctagagtgtcagggtagacaggtagaggataatggagatgatttcaccattattgagcatgaactgcagagggtgagctcaactaataataatgcaaatgagggtactaatatataattttctctccaatgaatctaatctaatcttatgaagtaattttcttttgcatcctttttctcttcttctagtgatgcattcggtgagagcatgtgagggccattttgatgtaccttttggaagttggggatcgagttggaagctaatcattcatgagaggcaggtggcggctgcagcattttggttagttctgctgcggtggccggcaacatgcaaacacgcaatggtaaccataacggatggaagaataaaagtatatatggtctgtccatcaagtgttgttattcttctcaaatgatgtactcctttacaatgttaagcacactaccaaagggaaattagtagtctagaagctagctaggatcgatattagtgaatataattttttagaaaacaatgcagaatataagttttctggactactgagccatagatcctaagtccgaaaacagatgaaaaaaaaatttgacatgaaaaacaaaagaggaattaaatgactgagcccagtattctgaacaaatttcagaccgcaaactgaacttatgtacatagcctaagaacaaaaaagctaaacacacttttttttttcacattgaagcacatagaagaaaatcaaaacaattctggaattttctgtcagagtaaagcgcacaatccgttggaactaaaccaatattcacaggtgtgtgtagagaccagatattaatcgtagtgaagaaagaaattgcagtgggggcgtgctgaactcacgtacatgtacatcgacgtcctcgtagccacaggcagcgtcgttggcaagacaaggtaacgtacgaccgttgtcatcgtagacgcttcccggattggaaccgccacgtcgtggattgccggcgaggcgagctcctccggagacgagaatagatatcagtgtgcatcaagatgatgccgccgcttctggccactccggggcaaacccacgatcgaacaccttgagtgcagccgtcgttcgttgttggtggtggtggcgggcggaagatgcggttgcagggaaccaggcgcaggcggcgggttcctgagaatggcggcagtaggcactagcgtcgactcggtctcggtgggtgctctccctctcctgcggcggccggcgggctcctgagactggcggcgccccgcgcccccgccggacggggagacgacaacccgttctgggccgtagagctcacatggccgtttccttctcagtttggaccacatatgggccgacacttaccgtaatggcccaataacgggattgggtttttacgttcgcagcccatgttaggccgggacgagattctgacttttgtgcagcccacacaaattgggccaaattatacgtgcggcctatttatgcgtatgggcctttctctcgagcatgaaaacgggccaaaatttaccaggtttaccgtgcgggaataaattggaatgggcctcaaattctcaatctcatcgacgcagccggcgtggtaaagtcagcccaagccccatggaggagtgatgagtgcgcggcgccggctaaacggcggcagcacgccaccggcgatgtcggccacgttcaaacttcacagcatcggagttggtttctatgtggagtatcgcagcagatccgattccgatgcggcattgcgcgtaatttggctataaatccgccgcggatttccttcctccgcaacggcgacggcaatggcgcagccgagagtcatccgggtgcgcgcccacgacgggcgctccaccaccgtcacgatcgccgcctccgccaccgtcagcgacctcaggacggcgctccgttcctccttcgctcccgcgctggtttcccccgacttccacctcttcctcaagggcaccaagctcatcgccgacgccaaggtcggcaacctccccgtcggccccggcgagtccatctctttcatcccggtcaacgccaagtcagcgccgccgcaccctccgtcgtcgagcgcgccgaatccatggaggaaacgcaagttttcttggcacgacggcggcggcgaagacatctacgccaagaagccgacgaacccagcgccgccgaggccgctctcctgccatggcacccaacctctcgaccctacccaaatggtggagcatctcaggcaagggctcgggaaggccggacagatcacccatgtcgaggagatcccgggaagggaggcgacgttcgccgaactccccggccacctctcgtcctccatgagggacgcgctgagaagcatcggcgtcaccaagctgtacgcccaccaggcgcaggccgtgcaatccgccgtctccggcgagcacgtcgtggtgtccacctcgacgtcgagcggcaagtcgctgtgctacaacatccccgtcctcgagtccatctcccagagctccgcgccatgcgcgctctacatcttccccaccaaggctctggcccaagaccagctcaagacactgctcgagatgaagccggcgttccgctcagacttcgacgtcagcatctacgacggcgacaccgccatgaaagaccggacaaggatcaggaacaccgcgaggctgctgatcaccaaccctgacatgctccacatgtcgatcttgccatgccatgctcagttcaagagggtcctcttcaacctcaagtacattgtcatcgacgaggcgcattcctacaagggcgcatttggctgccacgctgcgttgattctgagaagattaaagcgcatctgttcatatgtttatggaagcaatccaacattcatattctgcaccgcgacattggccaatccgagggagcatgtcatggagctggcaaatcttgatcgagtcgtgctggttgataatgacacgagtccttgcggctcaaagaacttcctcctgtggaatccgccattgcaattggcgaaagcagaagacagaagaccaaacccagtactagaggtttcctatctgttcgccgagatggttcagcatgggcttcgtgccatcgccttctgcaagacgaggaagatgtgtgagcaggtgctaatgcagacgcgtcagattcttaaggagacagctgcagaattggtgaattctatctgtgtctaccgtggtggctatgttgcgagtgacaggaggaagatcgaggctgatctcttcggtggaattcttcgcggcgtcgcggctaccaatgctcttgagctggggatcgatgtcgggcacatcgatgcgacgctgcacctgggatttcctggaagcatggctagcttctggcagcaggcagggagatcagggagaagagcaaagcagtccatagctgtttatgtagcctttgagggtgctcttgaccagtacttcatgagatcaccacacaagctgtttggcaagcccattgagcactgccaggttgattcacaaaaccgcaaggttcttgaacagcatctcgcttgcgccgcttctgaatatccactgcgtcaggaacatgacgagagctactttggttttagcatgaacagtgttttgatgacactgaaagataagggctgtctcatgaacaatccatctggaggagattcaggcgtgtggaagtatattggacctgataaaaaaccttctcatagtgtaagcatacgggcaattgagcatcacaggtacaaggtgatcgacaggagaagcaatcgagttcttgaagagattgaggaaagcaaggctttctttcaggtgtatgatggtgctgtctacatgcaccaaggtgtcagctacttggttgataagcttgatctgacatcaaggatagcttactgcaaggtgtttgatctgaactactacaccaaagttcaggactacactgaaatcagtttcattggaggtgatgttgatgaacatcctgcgagtgagtgtaaacctgacatcaggaggacaacagctcaagcaaatgactgcagggtgacaaccaaatgggttggctttgatcggatattgaagtcaaacaaccagaaatccgacagcattaaccttgatcatctacctccatactcctttgaaactcaagccgtttgggtacagattcctgtgtcagtaaggacgactatggagcagatggaatatcagctctgtggtggtgtacacgctgcttctcatgcgcttctaagtataatacctctgcacatgatgtgcagtggttctgatctaggaacacaatgtgcagagcctcaagaaaattctgaaactgcagacagaattctgttgtacgacaaacatcccggtggcatcggcttagcatcacaggccaagctgctctttggtgagcttctggttgctgctttagagcttgtttcatcatgcagctgcaccaactctgatgggtgtccaaattgcatccaatcatttgcatgcagtgattacaatagggatttggacaaggaagcttcaatttttcttctcaagggcgtaattcagtatgaaaagttgtattttgaagccatagatggttgttaccagagctgaagtgcaaatgacctagtacaagatatatttggatgtagcaccaactaacgtgtttgttataggtgccaatagaacttgagtggaaaataatgttagcgaatatttggttgtagtgtaggacactgcaaaatgcaaatggtagtaccgaacaaaatttgcgtatccttttatcgctatgatgtattttagtatttttacactagtcgttaatatttttgcagtcagtctgatactccgatgctgcagtgatgcttatatttttatcttctgtttttagtagactcatcattatttttgggcctattattacttgaggcttctctaatcctactagtattacaaatttttttctttgataggagtattacaactatagtctattgctagtgcatacttgtagttgtggccttggtgagctcctgtttcagttaactcttgttcagtggccgcaaggccctcaagtagcagtggctgtgtgttctgtacgaattcagtgtactgctttacaaatttagatggagttgttttttgtgtacaataacaagaaatattttattggtcaggcctagtttctgtgatgtcctagaacagatagctagtgtgtctgaattctgaaactaatttccttgatcattcagctcgtcagaaaagtggcctgtttatgcctaatggctgataatttggtgaagaggggatggccacatgaggagagctgtgctctctgtcagtgagaacaggaggactgccagcacctatttgtctcatgtcagtttacagggcgagtttggaagctagacagcattttcggacgggctacagggagctcttcgacactgttttcatgctcacatgctggttcatctggaaagagcgtaacgggaggattttcgagcacagatcaagagcacctgaacagctagtgcatgacataaaggaggaactaatgatctggaagatggcgggagttttctcgcttgttagtagggaggctctacctcactgccgctgcgacagggttctgtcgttgtaagcaaacaattttcgtttattttactcctaatcttaatgaaattggtcgaccgaacctttcggcctacccggcacaaaagaagagtggcatgttctctttctttgcctgaaactgaaggctctctctctctgaagcgttaatttcaacgtatggggagaactggagaacatttggcaccaaaaatatcatctgggtttgccaatggaagagatgtaactgcagtgctaaactctcagacacacagacacacatgtacacagacaatgagacagctctgaagctcgcatgataacgttggcctcatctctgaatttctccgatgaacaggactttcagaattcagattactgggctgctttccttccatttcagcccacatctctgaccggtttccaccaaagaactcgcgccatctcaacttctacagctccaaaaccacaactgcaaaattgatccgttcatcagcaacctgaattaattgtcttatgcgtgaacgcgagatcgagatgatgagcaatcacttacagtcagaatccgtggtgatccactgacacagcctgctgctgccgccatagtcgtcgtcatccgggctgccactgcacgacatgctgctcatcctgtcatcgtcagctgctgaccccgagctgtctcgccggagcctcatgccgtgcttcgtcgccggcgacggtgagaactgacgcagcgccgccggccacagcggcgactgcgctggcgaggacgagcagctctctgctgtggcgatgtcccagctgaagctgtcgctcttgctggagaccggcgacgagctcatgccgccgtcgctctgccggctcgtcgtcgtcagttgctgctgctgctgctcctgcttcctcctgctgttctgcaggctcaccaccaccctctgacaacatcaattagcacaaaaacaagttaaatttcagaggttcaacacagaaatgcaactgaattcatatgcataaattagtcagagatcgaatggattttggcttaccttccatttcttggcactgacaagcacggtggaccggagcttggactgcgccgacgactgagcggccgctcgccggagcagctccctcatcctggacacgatggccttccggcggtcgtcgacgaccttcctctccggcgacccctcgtccatttccgactccgactcctcgtcgatgatgggtagcactctgcacgcagcctcaacgccaccactgtgccccatatcaactgcaattaatcactcctcacttaaggccttaattactatagctcgctcactcgatcactgaactgaaactagcaaacatatgctggatagctactcgttagctgaaatggttggtcatatatatacatgcaatgcatgatctgtccagtgctgccgatttgtttcagggatcggagaatctagctagctaagatggaatccatcagctgcatactaattgttgttaatttactcattttaattacgccagttgatccacatactggtatacatacatacgcatgtgaaggaggaggaggaataattatagattcacagatcgaccatgttcgatctgcaagctcagatgaatcttaagtttggtacgtggcagtgtccattcgagggcgaggaatcgaacacgtcacgcagttaagaaagaaaattgcaggcacatctggatggttttgtccgtgttagggcttggtgaaatatacggaggatttcggctaattgcagcttgtgtcgtttactgggtatacacctggaagagaggagtattaattaattaattaattaattaattaattagtgtaactaatccaagggggctggactgaccacgttgttgtttttactgatcacgatcgctgctcgtattagtaatgtacaatacaaagatgctcagcgatgacgattgacgacgacgacgaccaagatggtgattaacaaacgccaatgcaacacatgattagtgtagtgtatcagtattagattgattagcatcgcgccgctcgatgagttggccatgtgatcgatgtggcgatcttttcagataagaacaagatatcatcagagttcagttcaggactgcctagtgggccaaggcccaggagagaggattgaatgcgtgggccgtatgtctccaggcccatgatagagttcagcacgtgtcagccaggtcgaaagctttcggcccaacaaaaaatgaagcgtttggagattcatggcatgatgaacaatcggtattgattgatctgatgattaaagattacgaggaaaatagatcaattcagcatgattataaaagataaccttttggggggggggttaattaagaagagtctgtatagatcgtgggcccttgtacggctgctgtaccagctcctacaaagtcaaatgcctctgaaatttacaagcaattctttttttttccctcaagactcaatgatgcatcacttgatgtcacttaactggcttgatcataacttatcatgcatatagcacggcgcgcagccctgataagtccaaaaggccagatttcatgtgcacgtctctttgagcttttttcaattgagaaaaactgatgaaggtaatcaaacaacacattgaaaaggaaaagaaagccttacagaaacgggtggagattccctaattttacacattaaatgtattcttcttcattacattaaatgcacatatttatggatgaaaaatatcgagcggtcgatctcaagtaacatacaacgtagtaggacgcaagtgtaagtggagtacacaggtacacatatttgtactagaaccggccacatggcagctttcatgattgatttcccaatagttagattctacaaggcaggagaccatgtcaccgtaaccgagaaattgccctaaattgagaaatgagaatatatggatgacggtgtagaacaatgaactggatgctatttgtcccgccgagacgtcaatagctcatttcacttgtccccttcgatcagttgtagcattgattctagactgcctttctgtcccctgtcgtcacagtgttggagcaagcaagaattcagcaatcgaaatatcgaattagttaggcaagtgttaattgtaagttgtaacaaccgatttgcagagtcgcagcaataatatccaagtccaaagtcgtatttgcagaattaaatttggtggaaaaaaaatatgcctttggtacaagtgtaaaaggcagcaaagacctgaaggaagaacactagaggtcatttgtcccttgctgtcagtgtcagcggttgacaaaattacatgatttgcatagtcagagcaaatgatgcaatgcgatggccgttcgattgctgcaaaagatgcgatttactactaggacgaagccgtgttcatggttactactcgacgtcgctgttgtctgtcactactgatgtttactgctcgatctacttcagctggccgactcggggttttgatgatttgaaattaaagtcggcatcgaaatttgtatcgatcaggaaatgatttgaaagtcaaattggtgcatgtaacagatatgctgtaaatgattttctattggcatttctaggaaaagcatatattcacaaagatatcaaaatttcaggtagaaaaattagctgaagttgaaaatgctactagctgggcgcctaaaccgaatccaaaggctaatttttatttctttcgaatcatatgaaaaagaactgcaaagtgcacattaacacaaaataattttactcacctccctccaagaaaaagaactacaataggcctcaactatagaccagtggctgctcgatctggaccttcctccagccttaggctggacaacggagctggtcagccagctaatcaatgtctggagtgcggtacacaacgtacatttcacagaaaatgaggaggacaagatagtgtggaagctcactggccatggtgaatatacggtgacgtcggcctacaaagcgcagctcttaggtactacagccaccaacttcaacatcataatatggaagccgtgggcaccacgcaagtgcaagacctttgcctagttgattatccaaaatagagtttggacctccgacagactggcaaccagaggttggcagaacgattatttctgccccttatgtagacacacccaagaaactgctctccaccttcttgcagaatgcagatacaccaagaaaatctgggcggcgttatctgattggactgggtgtggtcaactaaatcccggtcaatggcaactagctcaatcggtgttagagtggtgggaggccaccgccaacttgaaggaagccccaaagaaagcacttcacacgttaacacttctggtcaactgggaaatctggaatgagagaaatcgtagaatttttcagcacaaagagttatctaccggaagtctgttggccaaaattaaaaaggaggccaaaacatggtctcgggcgggggcgaggcatcttggtagctggcttgcttcttatttttagctcagtaggaccgaaggtcctgggcctggtttttcttacttgtaaagtttactctttctctattcaatgaaattggcagcttaccgattcgttcaaaattttttttttactcacctctggctacgtctatgcatacttgcatttacagctatatctgttatttttttctgtgtgaaattgtgaagtggcaaccagctgaggaacaacagatgaacagatcgattctgcgcatgcatcaggtgggtcccatattggcgttgcatattctgatccttggaggattccatgggataaaggccactctgctccggagatgcggcgccgaggttatctccttaattaatctcacatgacttcctcttatatcatgctactagtagtactatattttcagagttcacagctgatattgtcaacgcttgctgcccccttatcgctcgtaacgtaataatcgtataatcacataattaaaaatccactcttgttaattcagcaataaacttcagagttcagagaacgtgtccaggtctgtcgatattatcaggtgagagaacggagacgatgaggccattttgcaccagcacgaatcttaaggcaaatgccataaggatggcgccaacgagagcgtgccaattcccgcgcacctgaagctctataaatagctgggcgatgcgtgatcccaactcccaagccaccagcaaagccagcaattgcatccgagctcacctagcttctctcttgcaaccagcgattcgatcgattccatctccaagaagcagcggctagcagcagctagtagttgccatggactcgtcgacggtgggcgctccggggagctcgctgcacggcgtgacggggcgcgagccggcgttcgcgttctcgacggaggtgggcggcgaggacgcggcggcggcgagcaagttcgacttgccggtggactcggagcacaaggcgaagacgatcaggttgctgtcgttcgcgaacccgcatatgaggacgttccacctatcatggatctccttcttctcctgcttcgtctccaccttcgccgccgcccctctcgtccccatcatccgcgacaacctcaacctcaccaaggccgacatcggcaacgccggcgtcgcctccgtctccggctccatcttctccaggctcgccatgggcgccatctgcgacatgctcggcccgcgctacggctgcgccttcctcatcatgctcgccgcgcccaccgtcttctgcatgtcgctcatcgactccgccgcggggtacatcgccgtgcgcttcctcatcggcttctccctcgccaccttcgtgtcatgccagtactggatgagcaccatgttcaacagcaagatcatcggcctcgtcaacggcctcgccgccgggtggggaaacatgggcggcggcgcgacgcagctcatcatgccgctcgtctacgacgtgatccgcaagtgcggcgcgacgccgttcacggcgtggaggctggcctacttcgtgccggggacgctgcacgtggtgatgggcgtgctggtgctgacgctggggcaggacctccccgacggcaacctgcgcagcctgcagaagaagggtgacgtcaacagggacagcttctccagggtgctctggtacgccgtcaccaactaccgcacctggatcttcgtcctcctctacggctactccatgggcgtcgagctcaccaccgacaacgtcatcgccgagtacttctacgatcgcttcgacctcgacctccgcgtcgccggcatcatcgccgcatccttcggcatggccaacatcgtcgcgcgccccaccggcggcctcctctcggacctcggcgcgcgctacttcggcatgcgcgcccgcctctggaacatttggatcctccagaccgccggcggcgcgttctgcctcctgctcggccgcgcatccaccctccccacctccgtcgtctgcatggtcctcttctccttctgcgcgcaggccgcctgcggcgccatcttcggcgtcatccccttcgtctcccgccgctcgctcggcatcatctccggcatgaccggcgccggcggcaacttcggcgccgggctcacgcagctgctcttcttcacgtcgtcgaggtactccacgggcacggggctggagtacatgggcatcatgatcatggcgtgcacgctgccggtggtgctcgtccatttcccgcagtggggctccatgttcctcccgcccaacgccggcgccgaggaggagcactactacggctccgagtggagcgaacaggagaagagcaagggcctccacggtgcaagtctcaagttcgccgagaactcccgctccgagcgtggccgccgcaacgtcatcaacgccgccgccgccgccgccacgccgcccaacaactcgccggagcacgcctaaggcgtaaacaattctgcgaccgagaccagcaatacgctggagttcgactcgatgataacacgccggagcacgtccttgttgcaaacggtgatgaaattaagagtgaaatatttccttaggaattgaatcctttgaaattaattcctttggaatttctccgatacaaacggaggtataataagggagaggcatttatacctatgtacatgttacacttttttgaatttacagtgtattccatattgatgttgtcatattgacactccagctgaaaataataggagtactgtcctgtggttgaactacgcaattattttgcatacaaatttcaaaaaagcggcgagcaatacatagttgagaaattcgttagttacatcttatgatcagggccggggttaaaatttgagccgctaggtgggtccagttagtcaccaggccagtaactttggtaaaaaaaaattaacctgtcctaagctcctttctatgctttcttcgtattaaaatccaataaaattcatgcgtttgaaaggagtactgacggcataaagtgtgcgacattggcactgctctcctttctattccttctatcccataatataagaagttttagagttatgtcggtgatataggcccgggggtatgtatcaggtttagagggaggaggctgccccccgatgccgcgtggccctcccccaaggggagtcaggcccgaggtggggtggcggccactctttccccaaagactagtcagaggaggctaccccccgatgccacgtgcccctcccccgaggggagtcaggctcgaggtgggacggcggccactccttcccagagactggatggaggaggctgccccccgatgccacgtggccctcccctgaggggggtcgggcccgaggtagggcggcggccactccttcccaaagactagtcggaggaggctgccccccgatgccacgtggtcctcccccgaggggagtcaagcccgaggtgtcacaccccaatctggcaccgtcgtacaacggcacctgataggagcgtgtcgtaggaaaaacggtgcaaaccgctccctacgaaaccgcgatctcagtaccagtcccaggacatagcgctggtacccacggtgacaaatatgaatcattgcaatccttaaaataaatagaggacttatttaccttaacttaggttgcagctcagacagcctaagaatgcaaccgacgacacggacgaggcaaacaccaacaacagcagcagcagcggaaccaacggtctaacacccaataccacaggcgacggctgggaaccaggacaaaacccttaatcttcactttacttcatcttcaacttcaggacggaggaactatatatatttatatagagcaagggtgagtactttcgtactcagcaagtcactggaatttaggtgtttaatgcaagcttggaagaggggcaaggttgttttgcaaatcctttgtttgaaatcactaagtgatttacttcttgttaagtttgggccgaaaagagacttgcgtctcaaatcgacttaagagatatttttcaacaactcaattggtaatgtatcgacctcccgggtcagatcattacctctcggctcccagagctatttcacttgattaatcggctcccagagcctttctcattttctcggactcccagagtccagctgcccagcagcacaacattccgcttccactcgggaagcctagtctatgatgcccgtagacatcccgaatcacacagattcgtttctgaccactcaggtcatccatctgccacataggctgattctggttacgattcccatcccacaacaacttttcacaaagcacaggcaaacaaatctacgcaacgggaaccacctcacatccgcccatgaccgtgggcacggctgttcaaacagttagttaacctctgcagaggggtacactttacccacaagatacgaacttattccgaacacccgtcggtgtcggaggttcgcaacaaggcctttcctaagccggcccagggttacctcatgccacatagaaggatcaaatcctcacataaatatatgccattttagttttcacaaatcaaactccaaccacctcgatcggtaattcagcaagctcctattccttgcttaccaggaacccggtttggctccaaccgaccccgccccagcgttccccaactattggcatgcgaggtttccctgaaccgactaattacttagccagggtgtcccattccaccttgtggttgcactttgattatgctcgatgagtttcccacaggaatcggtccttatatgcgaacacgggacagtgccacgcaggcacaacccccgcatcgcgagttttcacaattcattttatttttaaacacaccgacaccacatgtcgggttttcaaggcttctcaaacccatttcccaagttttcgacaatcaacgatgtatgtgagatatttggtatacgcgctcagagagcacgaataccgaagtaccacaagggtggagcgacaaggaatcatgatagtacagcctacaggaattagtgcgactactgggtaggtccgtcggtttggcacgcaaatcgaggccaagcaagttatgtgtgattctaataatgcaagttgcaaacaaaataataatgattttccaattataggggcaattgatcaaagggtgacttgccttgctcaaggtcttcacggagcttcacgaatcttcgagaaaacccgcgatcggcgaaaatccggtaaccacaactatacgcaaacaaacaaaaacctaaacaaaagaccaagaaaaaaaccctatttagactaaataatagtgccattaaatagatctcaattttacggaattactggaagttgaacggagtcaatcagaagagcggttgggaagatatgaattttggaagttcaattagaatttctggaagacgagaaatggtttatggaatttatagaaataatattctcaagaatattattgacagtcactgacgtgcggggccaagggtgtactgtacatgggggggattaagtggacttttgttcatgtgtgtgggcactgggcttggacagagggagtaaaagtagacttttcattttcccctaggccgagaaggggggatggttgatgggccaagcccacgagcggggagagggaggaggggggctgactgggcgccggcttgactcggtcaagcgggcccagggctgaggtggcgtccacgtggaagccacgtcggatggggaggtagaggaggccgggcaggctgatccgatggccggcgacgagcgacgcaaaccggcgaacggcggcgaggtggattggggggttagcaccggaagagagaggaggccaaggggaatcgattcaacggagcggattagccgggggaagaacgacggcggccgacggcggtggccaatctcgccgacacgctgatgtggccgcgcgtggaaagagcgaagggcgcgcggtctcgggctcagctgtcgcggaaagggggttgcgacgcgcacacggtgacgcgggacccgaaggtcaccggcgacgcacaggcggcggcgctaagcggtggcggaaggggcggcacggcgcgagagcgagaggggaggccggcggccatggggcaacaagggggagatcaaggggatccccgggagcgtggtggcgagagggattgacaagaggggagccgacggcggcggattttgacggcgatcgtcggcggcgagcaaagggggaaaacttcaccagggcaacgggggttcgattcgttggagctggagcatctacgcgaggtcgcgagctcattccatcggtcgagagggcacgggcgacgccgagagaggccggcgacggcgagcgacgcccgggacagagcaagggcgcgcggcgagatgtgacgaatggcggcgggcgcggcgcagcgtgcgacaggggaaaaggggttcagtggggagctcaccgacgagagaaacggtgtcggcggcgcggatggagtcgtggcgaggcggacgcgacggcggggcggcgcggccggggaagaagagatggagaggcgcgaggatgggggcggcgcggagctcctcgtcgactcctcgtgctcgctagctccccgacacgcacaacggcagaggagggcgagaacgacgacgaacggcgaggcggcagtggtgtgatggaggagaggaagtgagaggtatgggagggggggtgtgggttttataggtggcgatgtcggtttgggagaactgaccttggggcggtcaaggagatgaggcggatggcgcgagcggtcaagcggcgcagaggtggtgacgccggcggtggtcggggaaaaggaaaaagaagggggaaagggggttggtcctttgccatattgaggagagggggagcagctgcttctcctattcttggtagatgcggcgtggagtggcgggggccatggatgacgtcggcaatgacggtggcggtcggtttggcatggagcgggggcaaggcggcagcgcgtggcgtcagcggcgcaagggctgatggcggcggcgaccgggtggcgagcgcgcgcgcgggaagggcgaccggcgaattcaaacggcggcggcgggaatcggcgccggggagaggagttcgacgagagagagagagagagaggaaggagacaagagaggcgctgcttctctcgctcggcgcgtgcagcgcacgtgcggggaggaggaggagcggccgagaggagaagatgggctggaaaagggaaaaacggcccaacgaccaagagggaggtgaaacggctgagggagggaggtgggctaagggggaaaacggcccacaatacccgagggaggtaaaatagacttttgtagagaagactgatttggagtggattcgaattggggttttggatttgaattcaaatttgacattcgaactcgatggtttagggaggaatcaagggagactcgaggagaagtcaagaaagagattcaaaacggaaacttggatatttttttttgtagtcggagcgaatgttcggcaaggattcaaaggaagggattgactttcggaatttgatttcggagacttgaattttggataggaaatcttgaggtggaggatttttgatttcgatgagagggaacaacgggattgaattgagatccatggcacgacttaaactcgcacacaaagaacaaaattttcgcaattaggattttaccgaattagtttttaacgtctcacgagaagcggagcgttacacgaggtggggtggcggtcactccttccccaaagactagtcggagaaggctgccccccgatgccacgtggccctcccccgaggggagtcaggcccgaggtggggtggcggaaactccttccccaaagactagtcggaggaggctgtcctcccgatgccacgtggccctcccccgaggggggtcgggcccgaggtggggcggcggccactccttcccagagactggatggaggaggctgccccccgataccacgtggccctcccccgaggggggtcgggctcaaggtagggcggcggccactccttcccaaagactagtcggaggaggctgccccccgatgccacgtggccctcccccgaggggagtcaggcccgagttaggacggcggccactccttcccaaagactagtcggaggaggctgcccccgatgccacgtggccctccctcaaggggagttaggcccgaggtggggtggcggccactccttcccagagactggatggaggaggctgccctccaatgccacgtggccctcccccgaggggggtcgggcccgagaaagggcggcggccactccctggccgagactagagggagaaggccgccccaggcgccacgtggctccccccgaggggggatcgggcccgaggtcgggcggcggccgtcccctcccgtaactaggggtcgggctcccccaaccccctctctaggtcaccacgtacggtgggttaggtatccacctccaggtgcccacctacccgcatttatagcgacccgagcggtcgcgccacgccgcatttaatgtggtgtgcagtgcactcaaccggtctgtgaccggtcgaatgactgatgggacccaggatgtcaggcgcaccatcgcgtgtgtcaggcgacgtgcaacccgacatatcccatcaaataatgatggtgacaggttatcatcctcttatcccagccggagtcggtcctctcgctctggtcaaagcaaggctcccgtttcccggtgtaataggagcccagaagtcttcacccattaaatggtgactaacaggggcaccccccatgtcaggcggcaagatttgacaggccccatcatcaagatgacatgcgcttggcttcccaagtcaagagacaagacatgcatttaatgcaaagattataatacttctccaccggagctaggttaggttgttgggcccatgtggtaacctcttgaggtataaaaggaggtccaggcctagtggtggagaggggggggacttccgagcgaactggctcttgggtctcgcaaccccaaacactggtgttctctactcaatcaatcaagcacaagagtagggtattacgcttcttagcggcccgaacatgtataaaccccttttgtttcatcgtctttgggggattgaacctcctcaagattacacagcttcgctcaccaagccctcgaatctcacccgctgcccccggccgaactcacaaaggggggcctcacggttccctggtggaggagttcattctccgacaagttggatatggttattaagaaagtaggtacaagtgaatgttggaagattgtgattggacgagtagtggaggtaggtgggaaaagtgaatagtagagggttgtgattggttggaaagagaatgttggtagagaagttatattttgggacaaatcctaagggctaaaagttgttatattttgggatggagggagtattctgttaggttgaaaatgatacgatggctccttaagagcaagtttaatagtataaccaactagtagctccaaatcatctatagtcaacttaatagccaattcatataatagttacctataaacatatacttacatggtcccatctatcatacacacattgtgtcgtggagtccgtgctacagctggctacaaatctgtaccccactgctcttctctctcatattttatcttctcgatatgtgtttatagatggcttatagtctgctgttgtacctgctctaacatctcatggtgcaagggggcgatggcatctcgatttgcaaacaagcatgagagatggcggagggttgctggacacgtcatattccataattggttaaagctcatctcttaaaatttaggttagatttgcacattatttttttcaaatttaaaatttgatcaaatattttgtttgaaagttccaaccgaattttgaatttataaattttgctaaaagtccaaatttctccccttttctgtcagttcacacttggcacttgggagtttgcctaatctgactcttgccacctttttctttctttcttttttgagaggaaggacaccctttgcttccttctttgagcaaacctcaaaaaatcacaataccaattaagttcacacacacaactatacaggtgcatctaatatattgttttctaagttgacattggatcagtagaccatttccaaagatgtgcacatttcatgtcataatcttactcgattataaatttgaagatggtgagataagccatttgttgtggacattaataaggtccaacaagtacctgagctgtccttcatgtttgtctaatgcacttccatgaactttggacatgcacaaattgttgctaagttgccaagtatttagctgttttttttttcctttcaaataatattgcttcttctggttgacagttgacaccttttgatagttccactttcattagggcatctccaagagagggctaaaaaggttcctaaaaattaaattttaggattttcataaaaaacagccctccaacagattcctaatcaagatcccaaaatttacccacgcctaaaaccagtgccaaacccctagattttgggaacatatacgccctcccaatcaacatctcgcgccacttttttcacacccgcgtcttttttttcttccgccaggtgcccggttcttttctacccttctctcgcgccgtttctttctcgagctaggcgcacgccgccgcagttcacctccgagggtttccacaggccgcctccaatcctccatccacagcgccggcggccctcgtaccggtgggcggcggcccttcatccagcgcgccggcagcccctcttctggtgcgtggcgaccctgcatctagggcgtcgctggtcctccattgagggcagcgccggccaccgtcttccccttccaaggtgcctcctcttctacgtccaggtacacttcctcagtccaaatctctactatgttagatttttcaactggacatttcttccaagcctctctaacagcagcagttctacaagagtttacaaaatgagatcatcgctcgtcgcatgaacagttccggttgataggtttgtgtctcataacagtttacattcagttgagtgcccctgtccatgcatatacttgttcttgtctccatcttgttgaaatgctgcctttgcacagctgcactacaccatctgattcgatccactgatacatggggctgcatatatttttaaatatgctgcatgatgcactgccaaatcttggtctgaattttggtctttgaggccaaaagatttaacatactgcattgcattttcagctgtattaccttcgattgagttgatctggatgtagatttctagcatcaaagactactgtatttgttcagatttattttagaaacgttcagaatgttgtgctagctggcaattcagaaatgttcagaaatatttgtttagattatatcagaaatgttcatagatgtccagaattgttcagattattaattacaatatattggaaaaattggcagctgtataatctgtacatgtattctgattcattttaactccatctcattactatcaacagggaaaccaccagatcagagagtgggagggaaggagatggcaatatttggtggcaatcgtacttggagttcagattagtgaagattcgttagaaatttacctaggtttattaagtctgtgcaatgcaaactatttatattcagaattgtgtctgttgtgtctagattaggtggtttactacgtctgtgcaatacaaactatttatattcagaattgtgtctattcagtacttgggtaattccctcatcctgctgcagtaatcttctgtctttgttgcacgcatgcagcaacactacggagacgactcgatcaatcactggttgctgtaaaattagttgagaaggacccacaaatgattatgtggcaaattttaacattttgggacacctcttgaaggggggtgtattttaggccaaattcttttttggctatccccaatagaggatttttggggttcgaattttgtacatctgttggagatgctcttactgaaaagataaccctggctgaacagctaataatcctagacacctcctaaataaccattcggtatagtcaccccccaacagtgatctggccatgaggccatcatggttctttctcttggctttggttgttgccgatttatgttacaatggtcaatggtggatccagattataaatgggtagagattaattaaccactgaagatgtgtacaaatgtggttttatttataaaacacagagctaaaagatgcaccacgcttgcttttatgtcatgtacatagtacctatgtaccggatctgatacatacggggtgtcatatctgataccgaagataccataaatggtacatatggtaccatattgacggtaattattctgttgcaatggtatattgttacgtagtctccctcgtatgcaattctactttcaaataagatctgtaataactgaacgcaatggtatagtcaaagcaaagcttttgcctccatttttttttaagaaaaaaaatcaacgcaatggtgcaaactttgggggtagttttgttggtttatcacaaaaatttcttaacttttttcttttcatttaaacgcttttcgaagcaagtaatacaaaggcctttctccatgacgacatactctagatagtataaagaaaacggtaacaaaacgttcaacagtttatacatgcatgcataattaattaacttggcctcttaattaggcgtgctccggcgagttgttgggcggcgtggcggcggcggcggcggcgttgatgacgttgcggcggccacgctcggagcgggagttctcggcgaacttgagacttgcaccgtggaggcccttgctcttctcctgttcgctccactcggagccgtagtagtgctcctcctcggcgccggcgttgggcgggaggaacatggagccccactgcgggaaatggacgagcaccaccggcagcgtgcacgccatgatcatgatgcccatgtactccagccccgtgcccgtggagtacctcgacgacgtgaagaagagcagctgcgtgagcccggcgccgaagttgccgccggcgccggtcatgccggagatgatgccgagcgagcggcgggagacgaaggggatgacgccgaagatggcgccgcaggcggcctgcgcgcagaaggagaagaggaccatgcagacgacggaggtggggagggtggatgcgcggccgagcaggaggcagaacgcgccgccggcggtctggaggatccaaatgttccagaggcgggcgcgcatgccgaagtagcgcgcgccgaggtccgagaggaggccgccggtggggcgcgcgacgatgttggccatgccgaaggatgcggcgatgatgccggcgacgcggaggtcgaggtcgaagcgatcgtagaagtactcggcgatgacgttgtcggtggtgagctcgacgcccatggagtagccgtagaggaggacgaagatccaggtgcggtagttggtgacggcgtaccagagcaccctggagaagctgtccctgttgacgtcacccttcttctgcaggctgcgcaggttgccgtcggggaggtcctgccccagcgtcagcaccagcacgcccatcaccacgtgcagcgtccccggcacgaagtaggccagcctccacgccgtgaacggcgtcgcgccgcacttgcggatcacgtcgtagacgagcggcatgatgagctgcgtcgcgccgccgcccatgtttccccacccggcggcgaggccgttgacgaggccgatgatcttgctgttgaacatggtgctcatccagtactggcatgacacgaaggtggcgagggagaagccgatgaggaagcgcacggcgatgtaccccgcggcggagtcgatgagcgacatgcagaagacggtgggcgcggcgagcatgatgaggaaggcgcagccgtagcgcgggccgagcatgtcgcagatggcgcccatggcgagcctggagaagatggagccggagacggaggcgacgccggcgttgccgatgtcggccttggtgaggttgaggttgtcgcggatgatggggacgagaggggcggcggcgaaggtggagacgaagcaggagaagaaggagatccatgataggtggaacgtcctcatatgcgggttcgcgaacgacagcaacctgatcgtcttcgccttgtgctccgagtccaccggcaagtcgaacttgctcgccgccgccgcgtcctcgccgcccacctccgtcgagaacgcgaacgccggctcgcgccccgtcacgccgtgcagcgagctccccggagcgcccaccgtcgacgagtccatgccgccggtgacgatgatcttggccgctagctctagcctcttggattgattggaaatagaatgcaaaagtgcacttctgctgctgttgcttgctttggatcgcgcatcgctggggctatttatagagagctcaagttgtaatatctgcctcgtgattcgtgctggtgcaatggcctcaccaaaatcgaacggcctgaacacgctgtcagctctctgaagtctgaactctctgggcttaccgatttctttctgaattaacaatgggtgcattattggtctgaatttaaaacaacaaaattagaggcagctagctagcgttgacagtctcgactctgatctctgaaactacattgcatgtatattacaggaaagcaaagaaccgtttaaattaagctgaaatgaattgataaaggagataacctcggcgccgcatctccggagaagactgccctttatcccatgggatccaccaaggatcagaatatcccatcagatgcgtgcgcagaatcgatctgttgcttgccgattaattaatttctcttccttttctgttctgttctgttatgttatgttctgtatctgtccacagaatccttcagtgttcagagtaaaatgagattccaagaattgtggctcagcactgtttactctggcattgtaactttgttctattaaataacaagaaaaaaaaaactttgcttggattgatgggagcttcttcataaacttctgtattttctcttcatgtttgcagtttcagttcacaacctgcacttcttcttgccatgagatatgcactggttttttttcatgacggcctgaagcaaagcaacggcgtgtcaggatcaacaacaaaagttgttgttagctactagtatcatgttcacggcttcggttctatctaacctacatcttttgcagcgatccaacggccattgcatgcgttatcaatctgactttgcacaccggcttgcaaatatgccaaccctgacactgacagcaaggggacatatgaccctcttgtgttcatcaggtctttgctgtctcttactcatcagttcatctgtctccctgcaattcttcggccgactttaaccttgatagagatttcaggcaacttaccagttatttatcatgtttacaacatatcaggatgtcatgtataggacagaatgttcttttccggaatacgcgagaggcacattttttccattaaaagaaataaaagttatttacaagttgcagatatgtgtccagttgcatttgttttcagcatcccaattcccatacacatcatatgaaccgcgctcgcgtgctcggttatttgtcttgacaacttggagttggaggtcttcagattatagtttaatttgtgtggatatgtcaacacccccaacctttggtatgttccataagttatttcaccctttttctttccaattttgtacatttccctgtttcgttttcgatgttctggtcaaatatataccgttattctatcacggtttttgattttgtttatatatagcttcggttgaagtttgttagttgatgaatttatttgaaggactcagatattgctaaatctggcccttcagttgaactagagcacctgcaggtattttttaaagaaatttgctccaattcaacaaaaagtatctcgaggtaccggtacctcacggtaccaaatcgtttcttatcgttgaatctagctggacatgatgtgcattgttagatccaacgatcgaaaacgatttagcatcatgaggtatcggtacctcgagttactttttgtcgtaccagagcaaatctctctttttttaaaagtgtcaatacaatgaatgtatgatggattcagaagtgtgaattgcatggttacttggcactgatgctttccttccatcatgcatggtttggtatggaaattaacaagttggcatgttgctattgccccagatgccataatgaagtttgacttaacttaaaattaaagaagatgctagtactttggctcagtatttgcctaattggatcagcacacacaaggatccatgtaagcattgtcccaatctgagaagctagccataaaccaggccttatcaatcaaagcagtaatttgttgcaatttcaagctttcagcagagtccatataatgtgcatcaaagagttgaccgtgcaaatacattttctgaagagagctcgcagtgtctgacttccagctgtacaatgacacatcaagagtgacaggtgacttttttttgctttagatttattcttaaacgagttcaagttagccaaaatgctctgcgtagctgtaattaaagtgattaattagtgcaggagcaacatttgggcccgttgaaaggttggtgttggcttttccagggacacggggatggattctccaagctttttatataacacttgaattaatattgcataaggagagtgagtgttacatcctcggtagcaggaggagactcaaagagtcgcaatctcatttttatatgaaaacgattttgctatccatctccgtgtgatttttttctggcatttgacactttgttttggcctccatgcagcttgcgatgcgagcggcaatttgcaagatcgatgttccatgcagctcgccggccggctggcacgtcggcctgtgttacctagctacccccgcgcgcgtgatgatggagaagcacggtgccaaggtggcctctgattgagctggccgccggcagtacggccactctcgtcgtcgtcgtgaaatataaagttacagtcatacataactaaaattacatttgtaaattcagttgatatggcatgtaagtgcactgtaattttaataaaaataatatgtaagtaaatatatatttgttattttctttaaaatataaaattactgtcctatatacctaaaattacatttgtaaattcagttgatatggcatataagtgcactgtaattttgataaaaataatgtgtaagtaaatatgtatttgtatattcttttgtagtccgttagatgtaaatctaagagtaaaaaaaatctgggtaatttttggttagaaatcacccgacaaatggatagacagtcccgtaggccgcggtgcagggccctgttgacgccaaattaggaaaaagtgcaccgaaggtccctcaacttgtcatcgagttacaaaatcgtcccccaaccgtaaaatcaggtatccagcatccctcaactatcaaaaccggtcacaatagatccttaggtagttttgatcctggttttgtcttacgtgacggctaagtcagagtgggacccacatgtcatgctgtcatataacccacctcttctctctcttttcccctcttatctcccttctttatctctctcccttctctgacttagctggcgggaggaggagggtgtcggcgagaggcgacgcggcggcggtgggggagaagctgcgagtgggcggcggggaggggcggcgcgcgggcggcgacgagcccacgaggcccacgaggcagaggaggaggcggcaacgacacggcaaattactgaggatatcaccaacgtccatataaacaagataatcaccaggcaaattattgctgctgctacttcaccatttgtgcatttcctcttctactatcttagctgcagctcgcacgctttgagtacgtgcattgttcaactgccatttctctcctcaattccaaaaaaatatattcacctttttctcattcgagctaaaccatttcgatcaatggaattcggacgatctccagcccttctactccttgttggtaagtccgagaaactttcaggccggttaactttaggctgttagcacacatcttcttcattcttcttttttttttaacgactcgcacacgacggtgtgaagttctattgatagagcaggaaaaaaaataaagattacaaccctggaggatcgtaaccagggaaaaaaaagaataccaccactcacacaccgacatcgccaacacaagcgtccaagagaaggctagcaccggagcggccgccgctaagtgtgaccgaccgccgctaagcgtgaccgactgtcacgcccgaaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattaattattgcaagaatgagcatatgacatactcaacaagccacacagcaaatatgcaagtgcacaaggataccaaaggatggcataatataggctcatttgcaaaagcagcatttagcaaacatttaagagtaataaaacagtagagtactttaatcattaattttaatcaacactgaacaacacgcccatgctgctcaggcccaaccattctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacctccgtgggcttatctccgccacttctcagtctggtgctccgcaatgaatcatgttatacaaaaggtaaagccgttgcccacgctggcttgtggttggcacggttaatatttcacaacagtagctcgcgaaccggtccttaattgccatgagcacgattctcaaaaccatgtgctcacaacccaccattatcaagtttgagttggcaagtaattaattaaccaatcacgattgaccatcgtgaactatcattaagccatcattaaataatagtgagtcataagttatcccaatagtgtgctaatatttctaagcatggctaagcaatcatatctaatatctagctaaaccaatatataaagctcaactagtcaagttataataacccaaggtatcaagtaataaagtaatcaatgcaaacaggccataacaaaggaatagattcacaccacccagtgacattcgaaagtaaatgcacagttgaaataaatagagaatttaaatataggatcaacatgctcaaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacaatacatataaagtaaacaaacatgtagatcataattttagatgaattatgagacttgaacggcctcattctgacttcatatgaatttattatgaattttacaagattaaatctaattaaagcccatttaaaaagaattaaataaatttaattcaatttatggataattttaatatgtagatctttattttacacaacttttgtaacttgaactacattaaactgagttacaatgaattagttatgaatttttaaagattaaatcgggttaaaacacttatatggattttaattgaattatgacgcaataatgaattatttttgaaaagaaaaagggaattattgcgtcatcggctagggtttgcggtgaaccgggtgcacggcggcggctcacgggaacgaacggccgagatcgatcctatccaaaacggacggccgagatcgaacggtccacgaccgggccacgagagtcgatgacgacgacgtcagcggtgatgtcacctccggcggcggctcgggcgcacttgctcgccggcgaacgacggcactacggcacgaacggagggcaccagcacgtagagagcgacgcggcgaactcaccgatgaccaaagaagcggcggaagatgaacggacggcggcggcgtcgaggaaaaggcggcggagtccttcggcttgacgacgacggcgatgctccggcggtctacagcgacggcgaaggggcggacgaggacggcgacgcgacggcgaccacgatggcgaccttcccgagcgacggcgacgactgaaacgatggcgaagcacggctggagcggcggcaacgacggcggctcgaggttacacggcgctagggcgctaccgacggcgagagacgaaggcgagggtggcggcgggtagaggagagcttggggatccttatataggggttggaaggcggcggcgaaggcccacggcgaccggcgacgagaaggaaagtctagggttaggggagagagatgaatccgattcgagatcgaatccacaagtttccaaaccgaattaggcgatgattccaaaagaggaaaggaagaggagatctcaaggatcatttgccctcaatcaatttgaccggaaatagagaggggcggcggaatttggaagggaagcggcggcggcgcagctcggctagggttcggccaggcgacggctggaggaggaagacagccctaacaggtaggccccacctgtcagcggcaccgagagagaaggaagcgacgacgggctgggccgactgggccggggagggagagagaaagagagaggttttgggccggctttcggcccaaagccaaaagagactttttaaaaacctttttcaatttaaattattcatgaaatgcaattccatttattaaaaatactttcttggctcaaataaatccagaaaaatctaggaactaaagattcaagagaagtatttaacaaaattttatctcgcccaattttatattgagatttagcaaattaaaaaaaatcttctcttttaggcttttaagatcatttctaataattccttttaaacaacaatttataatttaaggatttttaaacaagaaaagctcttaacaattataattagatcattaatgatcaaataattactgaactgttctttgtatcatttaggaattgagcttcgaaaaattcgagaaaatttcagagagtatacttaatcatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacaccgaccgtcacctagaccaacaaagggacacagacgagatcgccccctaggggatgccaaaacaacgtcttcaagaagagaagcgacggaaaaaccaccgcccgtccgtcgggactcaaaagagccaagactgggctttcgcccggctatcacccttgaggggtgagacagcacaacaacaccctcaggaggatcgttgtcggttcggccaaggccgcactgggttttcacccgccgctcaccggctgcgaatccacggctgacgcaccgatgcgccaccaccacacaagctctgccgacatgtgggacccctgcaccgacgtcccccgccggccagccttcgtgcgccgaagaccacgccatatccaccggcagctcctcctctcacctaggtcgcctcctccactgccggccacgcctctcgcgccaagccggcctccatctccgccgcccgcgcctctcgcgccgagccggcctccgctgccatcggctacgcctctctgtgccaagccagtctccgaccccttcatcgaacgatgccgtgccggccagaagcagctgtttcccacgccctcggctagccgtccgaggccgtcatgcctccggtgaccgcagtcgtggtcaccaccaccacagccgctgctgtcgaacgcccagccacttgcacccgactcattcttcaacaatgttgtgtctcaatgtagggttcctatggtcacagctgcagttcggcgctgagtcagctggcacgacggtcttcacgctgcgcaacaactgcacctacaccgtctggccgaccaccttgtccggaaacaccgcggtggccatcgggggtggcggcttcgagctgtcgctcggtgccaatgtctcgttcccagccccggatggttggtccggccgcttgtgggcgcgcacggactgtgcaccctccggcaccgcgtccctcgcctgtgccacgggggacttcggcggcgttgtgagctgctccctcggtggcgcgccgcccgtcaccctcgccgagttcacgctgggcagtgccgacgggaaggacttgtacgacgtgagcctcgtgggcaggggcagacgggggagcccgcgcgccactcctccccccgccgcccgcgcgctgctcctcgccgcccacccgcagcttctccccccaccaccgctgcgtcgcccgccgccgccatcaccgccgccgcgtcgcccctcaccggccgctgacgccctcctcctcccgctggctgagtcagagaagggagagagagagatgaggaagggagagaagagggggaaagagagggagagagaagctgatgtggcagcctgacatgtggggcccacgtaggataaaaccggggtcaaaaccaccgaagaacctattgtggcctgttttgatagttgagggatgctagatacttggttttacggttgggggatgattttgtaactcgatgacaagttgagggaacttcggtgtactttttcccgccaaattatgatgcaaacaggcccatcattgatctcgccggagcactcgttgtttgagggcattttgctatcttgttcaaatagagaatatggatgttggccaaaacaagcaaaatgacagccacatgtattaatatgtgaaactagctagtttgttggcttacgtgtgatgcatgaggcatgcaaatatgtgtgtgcccagctatatacacatgcatgtttggttaatatatatatgcgtatgcatgtatgagggcaaaccaaggaggaactgggagatcagtacgtactgcatgcatgcagtgtaccgtgtaagtgagaccgtcaaatctatctattaacttattagagtaatagaaaaatgagtctccacattcgctctcggcatataaaaattttcatattaatcggagaaaaagaaaaacatagtccatataaaagtacaatttagaaatagctgaaatttgaattaaaaaataaggaatatcggctatgctatgaatatatataatctttgttctaaagtacttttaatcataagtgatttatactgtctcggcgtactgtccgatctatcccaatcacttggtttaaacatatttcgaagcatagattgtatattattgatatctttagccgatcaagtagatctaattatttctttgttatatacttcactgccgatctgatgcatgatacatcgtcttaatattaaacgatacgtcattggcaatccgtccgatcggctatcgtttatagatttaactttgttttctttgtttttttgttggttgtaagatcaaatcaactggcacaccctgaacccgaaagcaaattaatctttgaacctgcactagagtaaagtaaatctctcagatcagtgtgtgtttttttatcaacaggtgcactctctccatcatgccggagtcgccgtgccaaccaatctgttggcaccactcgcaagtctttgtcgagatcgattccagccgccagtgaggccttctcttcgtcaccccggagtagccataccatcagtccatggtgcactctctcttcgtcatgccaagattggtgccgtccatccgtgacgtctcctctctgtcacgctgagatagatgccgtccgtctgtgacacccattttcgctacaccaacatgatgagatgctatccgtctgtgatgccttctccccgctacaccaacggtgatgtgatgctgtccatccgtgatgtttcctctccgccgtgccaagatgacaatatgtcgttcatccgtggtgccctctctcttgtctctttgtcgagattaacgccactcgtttatgtattggagcgtcgctaatctacatcaacatgaagcaagaacagtgccgtttatgataccaggctatctcccgggtgattgttccgcgcgcgcgccgggagggggggatgtgcctcccctgcatcggcgcgtctccgggtgccgctgcgggttacacataatgtacttaaggtgtggcagtacgatttcgtactatcagaaagaacaagtactccgagatttagtggaaagctaataattgtcttttaacacaacatcagtaatatttcaacaaattatcgaacaacaagcaccagtggaatttattcggtgcagggaccacatcattgccttcaacctttgccgccattgccatagatgacatatgttgactaattcttcttggattttagctctgccactctttcctctgttgccttcagagcttctccatatatgctcaccagctgaaaagcaatagagtactatgagtcatgacataacagcgttgctttcatctacaaccagaaaagagggagaaaggttatgctgtgatttgttcttaattactttatcaatttcttcacgggttattatcagtggtggggacatcgctatcaagtttccaagaaccttaaccatcatgccacgtttcttacactcctgtccaaatatttcaccaacacctgaaaaacgccataaaaaatcattagaacttttactttgtcagcacataccttaacccacccaatgcaattctagcaaggctcattggtacatcacggccttaataattgacttccattcacgtattcagatgaacaaaatgcagcatctagtgctacccatacaaatatttttttttgagggaatacccctacaaatatagggactaaatctgactatgttataaatctcatgtatattggaaattaggactatataagccaccattccattcggtaacaccaacaccaatagccccaaaaccggctaacactatcggttcgtggggcctatcactgccggattccctgccagcagtgggctggcgacagtgttggctgcgagtaacactgtcggttttttcacatgcagtgataatgtagagttttgtttcggtccaataaaaagtacctcggtatcggtacctcacggtaccatccaacgatcagaaatgatttggtaccgtgaggtaccggtacctcgaggtactttttgttggactgaaacaaatctcaaatggatatcattgttagttcggaattgatagtcctacccggcaccgtttggacactgcttatcactgttgataggtgtcaagaaccgacactgaaagcccgcctacaaattaaaaaaaaaatacagtcgggcggtcaaggcacgggacggacggctcgtggcatgaaccagcagtgatacttacttccgaaatcaccgcatcaccgtggccccaaactaataattgaggtccccatatcactgccggttcgtggcatgaagccgcagtgatacctactatcactgccggttcgtgccacgaatcggcactgttgtatcattgcaggatcggatcgtgacacgagctggtagtgatattgttctttggattttggacgggattgggcgcaagaaagtgtagaaccgacagcgatactttatcactatcaatgctcgctgaatcggcagtgatagaccattatatggaagtgaatatgctattgatcatatacatgtgcacataccaaaagataaagggttaattagattcatgccattataatttttatggctttgaaatatgccaatattactcaactatttgaaatcataccattgtaatttaacagttattcgatatatgccaccgcttaccccttcaaaccattttctatttttttccaaccaaattacccttatctctttctttcatccctattctcctttttcatcttctccatgccattacgttgttttttgtttgcaaaacacagaacacagttaggttttaacacagaacacaattatttgattattatgcgtgtggcgatggctgcaaccttcagtggctctccctcctctggggcttctttcccccaaagggcgttggcgggcactgatccaagttgcaacaagtcaatgtttgattcatgacggcttgatgcgggtggtcttgacttccacagtcttttggtcattataactccaacccagcatgctcgtggcaaaaaggcccattggtgtggagtcatggtgtttccaagtctgcatgaggaattggttgttgacgagctagggtgttagctttaggttgttttggtttggctgggtcttttatagatgataaacgtcaattgttatcttcagagggtcgcctctcttttgtattctcttctttgtactccccgtgtatcttctgctactatctttcagggctcctgcgcttgcgcaggtaaagcctgccctgtgtacttttgtttgacgcaatatattcaggaggtggggaaactccccccaggtgacttagtaaaaaaaattattatttaggtaacacacataacatatttcctaccctaatcttaggccctatttgaaagattagcccagggctaattttgagagctaatgtttagtcatgaatcggtaggctaaacattagcctagggtggtatgtttggatccatgggctaattcaaggctaaaaggtggagagagagtaaaaagagaggagagagatagctgctttttgatggtccccacacaaaattagccccattaataccccttggaggggctaatattttgagaggggctaattcacgttagcctcaaattagcccacatgtttggatatatacttgagggctaattcaggcctaaaaggtgggagctaataattagcccatggaactaaacagggccctagttgttcctagttttttgtcgtgctaattaaagcgtagtgggtaacattggtgtaatgctgataattaaattacttaattataagtgcttgtagtcactagtgttacttaccccactcaaaagggaataactcatatggtgatttgttatcggtgaactcagttgctatcagcaatcctacaccacgtgtctgcatacaagagcacacataagctatgctgtttatgtgttcaaataagagaccaaaatcgtgcctgtggtaccagagcaccaggagaaacatggaaatatttcaaaaatctaaacagattaatacctccccaacaattggacttccagctgcaaaggccttgattccctcctggaacctttgagcaacatgtgtgacatgaccaggaatatctctttccctggtaccagtaattttgtgaaacattcatcagaaacaaataaaacctatgtacctacaattaatggctatgtttcgggaatagaaaagtgagtgtaccgataaattttcagcgcctctaaagcaacagcacaggaaacaggatggccagaatatgtaaagccatgagcaaatgtacctgtgacaaaagacaacaacttcatcatgtctttgtttttggactacaaacaatgagagagtagctgtgggtaccaaaatttttacccacaaacaataggatcggttcgtatagtagcatttaacttaccgagcttgttactatgagaatgaatcacatctgatatttccgggctaacaagtatcgctccaatgggagcataggcagaagaaagagcctatatcatggtaaattaagatgatcagtcatcttgtatcatgtaacaaatgttaagtagtacttgtaatttggtactagatagcacaccttggccaaggagacaagatctggtttgatgttatacaaatcagatccgaacatggttcccaaccttccaaatccagtaataacctagaatggaccgtaagttcaaaacttttgccctaaaaagttaattgttgtttccccattttatgtttgtctcgggagtaattttatcatctttgagaaggtaccacattttttatgtaaaacttgctaccttcagataatagataaatttacctacatgtactttttcaaggacagcaaaatttcttgtcttggtaagatataatgtaaacatacctcataaaaaataataatgaaagcatacctcatctacaataaaaaggatgtcatacttcttaaccactgcttgaatctgttgacagacaacaaaatagcacacaatgaacatgcataactacaattttgttgttcagcgaatagtaatacatgaacactagcaactcagtaaaccactacagttttgtggaactgctagagtgtaatgaagtacaaaaatttcagagtgatcgagcaactatcaaaagttccacatatgggtaatatatcttagctcaatattactgtattccagaatgcatgaagtaaatgaatacagttagtccctgtttagttccccaaaaacttttcaaaaaacatcacatcgaatctttggacacatgtatggagcattaaatatagataaaaagaaaaattaattgcacagtttgcatgtaaatcgcgagacgaatcttttaagcctaattagtccatgattagctataagtgctacagtaacccacacgtgctaatgatggcttaattaggctcaaaagattcgtctcgtggtttccaggcgagttatgaaattagttttttcattcgtgtccgaaaaccccttccgacatccggtcaaatgttcgatgtgacactcaaaaatttttatttcaccaactaaacagtcccttaggttttctaaatggaaatgcaactttaatttatagtatgccaatccatccaccttctcaaaatatgtctttggaggaaggataacaccaccagcaccaatcacaggttcagcaatgaaggcagcgatctaaggggaaaaggaaatagattaggtcggtaaactccggtatattataagttttgaggtgtgtcaagagaggtataccgtttctggtccttgtttgaggataagattctctaaattatcggcaagtctagttgcaaattcttcttctgtctcacctgtctcccacaaaaatcattaatttcatcgaaaaatgcactctgttaatcataaataaaaaaataagtataccagggagatggaagcgccagtagtgagggcagtctgtgtgcagaacaaaacgtcctggcagatcaaaatcctgatgcaaggtaggaagactaaagatgcagaagggattagcaaatgtgacttcaaatatgaactagtcatttcagtagttaaatttccagtggataaatttgctggctgatttttcaataggactatactcaccctgatagactagctgatatgaatgttgttccatgatatctgcagtaagaattaagcatgccattaaaagtgattttgtagagataaattttacagtccgtgagaggtataccaaaattttagtacctcctaataccataggtacaagtatcgtaaaatcactcttttatagaagttagctgggatggatttattcagtgacggatctagaaaaaaatagtagtggaggctgaataaactacatcagcataaatcgaacctccagtccccacatcctatggatctatagaaaaaaaaaatttagcgggggcttagggggtctccactgtcctgggggcggtagtggggtctcgagacccctccgcccccattgtgaatccgcccctggatttatttggtgtctatgaacattgctatctagagagagttaattgaaagtagctagccatggatttgtaacatggagaaagtaaacgggaaaaaacatgccaatagatctagaatatatagggtgaaactagctaggcatttcttgttttaaggaacacgagtatatatgtagcttacgattgtgtccgtgaaatgatatttttcttctttggcctccccaatgcattgttataataccatactatcttaacctgcaaaagaattcgaaataagcattatattctacgtgtggaaaacaatggcagaagagtaacaaatcaagaaaaagaacaaaatatatcagtcaagattaatctatgtgtttattgtgactcttcaatccaacacaactatacaaagggcataaacatgatgaaggaaagaaattagatatgcactgacatcccataaaaaagttcaaccaacaaattaaccaagcagtaataatatagtagatactcttctgatatactacctccagccggatttagtcgatgttttggacaaccaaattgacctacgacaattagttttatataccgagcaattagaaacatcacttcgttatgagccgagggaaacattaccatcatgtaaacatgatgatgttcgaactatgtgcaacacaatgtaaaatttacttaatttacaatcttccctatctactgttatgtattccaatccttgagatcacaaaggtcatgcatcattccctctttcattgtatggaacattaataaaactttcaaggatttaatttgtactttatgtatacgggtatcaataagagagacatactatcagtagtacttttggaagaaacaattcacaccatcaataatgtaacgtaaaatctcaatcgagagcctctcgttttagttgtaactagcgatgacatcacataactggaagagtcatacttaagcataatactagtacatcaagccagtaaaaaaaaattcctaccacctatgcgttaaatagaattttcttttaagttactcattcgatgtacgatccgattatattattgtgttcgtaacaattaaatctttacaacatgatctcacttgattatatttgttgatgaaaaattacaaattacttttttaatatatctaaataatttttagatttcatcaaattacttcttagacatataaaagtgaattcaataaagcttaaaagtaatttacatatattatagaagtaacttaaaataaaagaaagtaacttgtcatgacattaaaagtaaatctattgtgggggtaaaaacataagtctatctagaaattaaatttaatcaatatattatagaactaaccaataaataattgttcactgaatgtctaaaaactaatttaatcatatctaaaagtagtttatatatatatatatgataaaattaacttacatatataatttacaacctaattattttttatcataatataattatgtaagattgctagaaagatttaattgtaacgaacacaatggtgtaaatagatcatatgtgtaatcagatcatagatcagataaataatttaagagaaaattttatttaaaatttcaaattttccctagaaagtatgtggggtctgtaaagtaacagatgaaattgaaaaagtgagaggtctcgatttaagactaacacgctactgcactctacctagacgcgtcctggttgggcccactgcatattaatgttcattttaaaatttgtgcaagcacatatcccacattttaactactaattcacatatatttaacaacctacataatttctaccatatatacttgacactaatatggattatatttttcacaaaaattcgaatttgaaccgcaaaagtatcagactttaacccttgcattctgatctttcttttaactgatataatttttcacggtgcaaactgcaggaaatggctggtactttaacaataatattacctgagagtcatttgcttctgaaccactgttcgtaaagaacactttgcccatttccctggcagtaaacatgctaataagttctttcgcaagatcctgcaagtagcagcaaacctccaatcatcagtatttacaagttttttttttgtttgcagaatgactaagtcagtcactataacattttctcatgtagtattaatatctgaaaaaaaagaaacaatacaaataaaacaacgattgatgaattaaagatgcagaatacatatgtaccaaagaaggcctggttgtatggttccaaaaggagtggtagaagggtaacttgtttaattgctccgtagcagctttgactaaacgaggctcactaccacctgaaaatagcatgcatgagtggttaatgcatcagcgtttataatcagttattgatcacttcactgctccctctacccttgatcaataattagttcaatatcattttttaacaatggaattagttcaatatcaatacgtcgattacaagataaaatggtactacattggattcatatttaaaacttcggctggatttactacctggaacaattcaatttatccacttagcaagcctcctgacaaaacttcgtctgaatttactccactaaaacatttcaaccggtttaatctactgtaacgccccgcttttcgcgagacgttaaaagctaatttactgaaaatcctaattgcgaaaatttcgttctttgagtgttgaagtctaagttgtgccaaagatctcaatttacatccctcctttggtccatctttgtgctatcaaagatcgtctcctcaaagtttccatcccaatatagtcccgaagctcgattccttctattcggaatcccctcatggaaccccatccgtgaactttgtcaaatgcccgaaccctaactccgtccaaggattcaccttcgcgtcataaactctctccttggttccttcaaaccgattctcaaattcgaattcaacctctcaggttttgtttcatctatatttctctctgtattggttcgtcaatctacccttgttttctttctcgaacttctgacccaagtctgaatatgcaaatcgagatcacttccacccttgaactctaaaccccaagattcaatccctttcgccttgagttctccccaaaatgatttccgttccgaaataatctcgaagtccgaacccttctatttagacttccctccaaaatccttacccacatatctcgttgagtagtcaaactcaaactcccaagttacactctctttctctaaattatccatctcactttgactcgtctctgaatattgttcccttccttgactccttcctattctcccgagaccgagtatcaacctcgaaactcgaatccagaccccaaccctaaaacctcccaattaaatctctctatgaaagtctatttaacctccctcataggttggattccttcttcctttttccggtccacctcttccttctcttccatcccatctctctgtgagtctcgatctatctatctttcgatcgatccatctatctatctactatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcgtgccgccaaatataaatctatcccaaaaatatcaaaattcccgcttttgaagcccttccttgacccctcccttggatccaccttgaaccctcgtgtacaaatatacaaattgaattcaaattcaatctccacatcaaatttctctccaaatcaaaccttccagtaaaagtctattttgcctccctccaactcgctcgggccgaaaccatcctcggcccatcctcttctttcgccagcctctccatcgcacgtgcgccgcacgtgactccctcagagagcgccctctctctctctctctctctctctctctctcggcgtcgcttcccgccgacgctgcccaaaattccggccgccgccttcgattcccgcgcgcccgtgcgcgtggctgaccgcctgggcgccgccatcgccaccctcggttgtcgcctgccccgatgaccaccgtgtccgcgcttgccttcaaaccgtccccgtccttttgcagtcgtcgccggcgtcatcctctcgggcccggcgccccatgccgcatgcatccaaaaccgtgaggcgcggctcgttctcatccctttcctcccaaaacggaaggagcaaagctccctttcctcctcctcctcctttcgctttttcccctcccgggtagcgagctccctgcctccactccttggcttcttgttcaaaaggcagagccgctgacgccgctgcagcgcctcgccgcccccaccttgaccgcacccgctcgccccgcgccaatcctcccgtgctcgcggttcgatttcccaccacacgatccaccgcctccaccaccctttgcatccttgccgtcgctcgttctcgcggcgcccatgaacaccagccgagcgccaagaaaaccgcggccacctcgaaccgaccttgccgctcccactctgtctctataaaacccaccccctgtgcttcctcccttccttgcttcgttccccccccaagcggcggagccctgccgccatgggaactcctcgccgtcgcgtcgagctccatgtccggcgacatctcgccgtcgcacggtccgtcctctgccgcctcctccctcaacctcggtcgccgtcgcgcggccaaccccggagcatcgccaccgccgcgaccaagggcgccaccgcacgcctccgttcccttccccggcacgcccaccgtgacacgatgccgcctcggcatcacgttcgtcgccgtgcgccgctgctcgtccatgcgccgccatcggccttcccatcctcaactcgccgccaacgccgttacctcccgtcggtgagctcctcacctcccttttccgctgtcccagcactcgcgtagctcgcgtcgcgcgtgctctgtttccgccgccatgcgcaatcgagagccgccgttggcctccctctcggcgactcctctagccaccgccgttcttgagttccctctctacctccccaagccgctgtttcagccgccggcctcccctctcgccctcgcgttgcgtcgcccgattcgctgctgccgcgctcggccacctccgctgtgcctcccctgccgtcggcctccctcctctccttgattcccggcgccgccaccttcctcgggccccccctcgacctccccaacccctccccctggccgccgaccttcctcctcgctcccgcgccgtgccgcccctcccgccgccgcaaggcgccgccgcgagccacagcccggcgaccatcgggtcccgcgtcaccgcgtgtgcgctgcaaccccataccgcgtccactaagcctgagcgcgcgagccgcatcccttcccatcgcgcatccacgtcggcatcccggcgagcttcgccgccgccgccggccgtcgtcgcgcgttgtcttcccaatccgagccgtggaatcggttcgccttgacctcctctagccaccggtgttcgtcgctcgcttcggctcgccgccgttcgccggattccaccgcgcaccgtgagccgtccgatgccattcccgccccccccccccccattttctctccccatccgacgtggctgcccacgtggcgttgaccgggcctgcccctgcccagtcagccggtcagccgtccccctccccctttctcccctggctcgtgggcttggcccattggccagccttcctcctcggcctaacaaaacaaaggaagtttacttttactccctcttccgagtccggtgcccacacaccgaagagctaaaagtccgcaattgctccctccaattgctcctctctctctcaccttcttattggccccactcgtcaatgagtcaaagataatcttgagaatgtcttttccaatattccacaaatatttctctcttctataaattcagtaaatcattttatcttatttcgtgagttaataaatcttttttcccttgatcccataaatcaattctctattccaaaatttcatgaatcatttccttataaatcatttcctttggtcccgcacgtcagagacggtcaataatattcttgagaatattatttctataaatttcatgaatcaatctccccttgttccacaaatatcttccttcgccagaaattccaattaaacttccaaaattcgtatctctcgatccaatcgtccgattgaccccgttccacttccagtatttccgtaaaatcgagatctatttaatggcactattatttagtctaaatagggtctttttcttggtctcttgtttaggtttttgtttgtttgcgcatagttgcggttaccggattttcgtcgatcgtggatttctcgaagattcgtgaagctcagtgaagaccttgagcaaggcaagccacctttgaacatattgagcctatatttgaacttaattatattgctcgcaaaatattatgcattgataggattgcacttaatctgtttgcaccgtctgcaaggcagaccggtgggcctacccaacttgttgcatctgatccttacattgttaattgttatatcatgttcccttgtaaccatctagctgcgcctcgatattcgtgcactctgtgcgagtatcgacggtcgccttcaaacttaaaatatgagtaacttcttgggtaaaacttggtttacaaaagcttcggaaaacccgacgcctgggtcggtgccttgtgaaagaaaatgagttttaaaaataaaactcgcgacacaaggccattcctaggcggaatacttgtgcggtcgcatctaaggaccgattcctttggaattacattcgagcatacaatagtgcgaccacacgggtggaatgggacgcccctagctgagtaaattgctaattgggggagccttgatgccgagagacatgtgaattcaacggggtggtgtcggggagaacccccgggcttcctagcacagtatggtctgggacctaacctgttgttggtctgggacccctctcgtcggcatatggcaaccctgtgtctgctctcgaaatgccttgtaatgaaagcccttaggtcaccagacgtggccgttctatacgggctgggtgattcgggttagtaatgtcgtgtgggtaaagtgtaccccctctgcagaggttaacaaactgttcgaacagccgtgcccacggtcatgggcggatgtgaggtgattccttagcgtagtttttgttttaccctgttttatgaaaagggtgttaaggtttgggaaacctaatgcttgggaagcaattagctgtccgggggacagcgggaccgggtgtccctggaagtaattggtcgtttggggaccactattatcgggaagtttggaaaattggtttggtttgggaaaaaccagatttgaagccaactctgggagttgtgcaaatcttgataaataaatttgttacttctcacctcccgaccgagctgagacttgtctcgctctggttgtggaaagcacacacttagattgttgaaaacttgaaaacaaaactgtttgcaaaataacagccttcccttgaagcctgcattaaccacctaagttcccctggcttgctgagtacgtaagtactcacccttgctctctatataaatatagttctgccagctccgaagatgaagttgaagtgaagtgaagattagggtttcgtcctagttccctgtcgttgcctgtggcgttgggtgttagtccgttggttggttccgctgccgctgctgttgttggtgtttgcctcgtctgtgtcgccggttgcattctggggctgtctaagctgcaacctaagttaaggtaaataagtcctctattaattataaggatttgtaatgattcatgtttgtcaccgtgggtaccagcgctatgtcctgggactggtactgagatcgcagtttcgtaggacgcggttcaagccgtttttctacgacacgctcctgtcaggtgccgttgtacggcggtaccagattggggtgtgacatctaccctgatgagatttgccttttttcccctccccgtacaaggtgaatttgaagttcagaattttcatggtagcaaagaacagcatatatatatataggccgtgtgaagttccaaaataattcttcaaactaccaacttttccatcacatcgaaactttcctacacacataaacttccaacttttccgtcacatcgttccaacttcaaccaaacttctaattttagtgaactaaacacaaccatagcatatgtttgaaaattgtattgaaggtttttttttcatgaatattttcataggttaggtaatctatatactagatgaaccctagctaggtatacacaattaaatgaaaataatggtgaagaacttttaaggtatttttctagcgctaggtgctaggcacgcggtgacgcttcgcctaatgccagcgtgcgtagacgacgcctagacaatttattttcttgatgggtagagttatgtcatgttaaatggaagaatttgacacgctgaaacaaagaatttaacattataggccatccatgagttctatgaccataattcatcatattccatctttaatattctccaacttttatgtataaaccaaaccttaaaatgctccaggtgagaaaaacacgcctatacacaaaatgcttactccctccataaaaaaaaaacagaatctagaactgaatatgacacacctttttagccaacatttgaccattcatcttattcaaaaaatttatgtaattattatttattttattttgacttgatttatcattaaatgttctttaagaattacataaatatttttatattttacaaaaaaaaaattgaacaagacgaatggtataaaaaataaatagcgtcatacattaaaatattttacatccaatattagattgggtttttatagaatagagtgagtagttgctaagcgaggcagtgatgctccacctaccgcctaggcaccatctaggtggagtaggcatggccttttaaaacagagtgtactccctccgtcccaaaaaaagacaaaccctgggtttccgtgtctaactttgactgtccgtcttatatgaaatttttttataatttgtattttcattgttgttaaatgataaaacatgattaatattttatgcgtgacttgtctttttactttttttttcataattttttcaaataagacggacggtcaaacgttgggcacggaaatcaaggtttgtctttttttttggacggagggagtatgttgttatcccacgaaacttgaactgaacactcaacttgctggtgaggaaaaaaagacaaatctcattagggaataatactcgtccaagtgagcaagaatgctccttctcggtcgcgcgggggagagaaaaaaaatcggttgctagctcccccttcccctcatcgcatggcaccagcagcctctctgggccctcaccacatgtccccgtccccacccgtcacttatccacacacaaaactctattgcaataaattacccacatattttggaaaccttctattaaggatattccattgcaaaaaaaaaccccacatattttagaaacccctattaagcgaattcgttttattttttgttccaccacaaaatattttaactagtgtattataatatttcactatgtatggatcaaatgttgcagtgaactgaaacatttgattcgctatttgctgaaatattgtttttatataaggtgaaacaacatccaatttaaacgaatgaaacattttcgatctactaagtgaaacaattctgatataccaggtgagacatcgtgcaacatttaaaaataattcaataataagctaattttttttcatcggaatatatccatatgtgtggtcttgttttgaagatttaattgcaacaaatttaatggtgtaatcggatcatgatttcgataagtaatttaagagaaaaatcagtttaaagtagttttgcacgtaaatcgggcatgttgacgtcaacgcccgatttttctccaaactgatcggacgcccgacccggtagactcgtccaacttttttttttgttagaagttgaacggacaaagtagattgttagctggtagttaattagacattttcctattaaaacatcttatacacatacctaaagctgtagacaacaatcctgcaagtgcatctagatacttggtcccgttgacatcgtaaacgtaacatccctgcatatcaggtccaagcaatacgatgcaaaatatcgttagatatcagagcgcaaatttaaataaatttcactgcaagtttttttagcgtttcattttaactttatggggaggggtggggacccggcccctgccagcccctccatagctcgatcctgtgcgcatatatacgttacttcacatatatacgtacgttataataaaaggaagggtacagatcaaaatatttcaaagaatgctagtacatcagttagatgacgtacgtctttagaaaatgtaatgtcattattaaaatttaactattactactagtttgcataaaaatatatttggattgctccaatgaaaaatatgatcgttatattttccgtgcaaaatactctctacgttctaaaatatagtaacgtggtcccagatgaggcatcatattactataaatttgggtgtactcagattcatattattaggatatgtctcatcccatgtattagattgttatattttgggatggacgtagtatatacccccaatatgtgtatataaaattttttaacataacggaagaaacttaatttccttgtgtgagagaaataaaattcttagggatacaattattccccaccgtgtacgtacataaaattgacacggatagagagaggaggcagaaacatgtttgccacattaattaagtagaccgtcaagttgaggcggagttgactcatttggagttgacattacgaaacaagccgcggggaggactattcaagctgcaaataattggagatttttatttttatttgtagatcggtactttgggatgtcttgactacatgtccttgaaaccatgtttactttctctaataataatcctcgaaatataggatgttgatctgacactggaaatctatccattaccttaaaaaaaggggaaaaaagtagaatgtaagtaaagcttgctcaatgatcttgccttcaattaattttagcaccccgccaccattttattctttcgagaactgtcatttatttttgttggatatagatataataacagtagaacacacctcattgtttcgttgcactcgaagacatatcacaaaataagccaccgctactacagatttgattttcttttaaggggcatttgcaaatttgccaccggtttttttaatattgtaaggatgaaggatgccactcgaatgatagttctagtggtatttttataattttctagtggcagttttgcaataacgatttaaagtagtggtaaatttgcaattattcttttttttaaaatgagggtctctctaggttataggtgggctgtaactatacccgcatacaaaaatcggacatccgagaacttcaaaggttttatgtcacatatggccctctaagaggcctgccccttaagagcatgctcacctctccaaaacgccaagactcacatgcgttccttttttctacgaaattaagacagtaaggaaaccatataccgttatggttttaaagatgttgcacagtaatcccaacacatgaacaaaaataaagatttttcttactcatatgaaaagtaagagttaaaagttgtatgttaaaaattatcttatcctctggttagtaaaaataagattacaagagaaattaaaaattaaactgagtaaaaacctcagatctctcaataaccagtggtggtgagatagcggtctgccatgcggctgtaaacggtgcaagcatggcatgatccttaaccctaacaggataaataaataaatcagcaaaaaaaaggcaaaaaactagtgtaaattaatgtagtgttccagtactagttgctaatgaaagggaaaatcgtgtagagagttttgacactcaagctactagccatgcgatttcttatcatacccatgttcttcagcagagtcatcagctggcacctgatcagagaaggcacctgatgagtactggaggaggccatgaggagtcgtcatatataaagatgaaagttcgcttataatgtctggcgcactgatcgttctcggagaaacacacgaggagatggcatgggtatatataggctgtgttcggaattctcagttcacgacatgcagcgcacgaaaaactgagcgatccattagcgcattattaattaagtattagctcatttgttttttaaaaatggttcaatatgatttttaagcaactttcgtatagaaactttttgcaaaaaaatacaccgttgagcagtttgaaaagcgtgcgcgcggaatattccaaacacaaccatagtaggagttttgacattttgcttacaccatttgaccattcgtcttatttaaaaaaatttagaattattatttattttatttgtgacttactttattatccaaattactttaagcacaactttttgttttttatatttgcacaaattttttaataagacgagcggtcaaatgttagattggaatagtgaatatcccttatatttacgaatagaggtagtagtatatacttatcgacgtttgatatcacgactacgttatttagatgatatagggatcgtcggtactagggtatatacgagattgaggttaaagagatggagacaaggatttttatacaggttcgagccccttatctgataggtaatagccctatatcctgttggccgaagccggtgttgctcatttattcatcttaattacaccagtataataattgggataacctatctaactgtcatcgacttggcggctagataaccaactcgtggtcgatgacagggtagtcttcctccttgaatccgcactcggcgagatcagagatggcgctagatccctttgctggtccccgtaggtaccggatggggtatgtctaggtttatctctgatatcgatatccggcgacgtgtgttgggcatgttggcttgtattgatcttgtggctttatggaatgtcccctcacctcttagggggcttgtatttatacccatagatgcccccttgtccaagtaaaataagggagataaatatggatacgatctgagtagtccttgttattttcatatagaactctacttgtcattccttatccggaactctttctatatacgaggtttgttttataagacatggtatgtggtgggctccgttgaacttagtcgattactattgggtatgtggtatccataaccctaacaacactatctttattttttaatgtatgacgccgttaactttttatcaacgtttgatcattcgtcttattcattttttttacaaatacaaaaatatttaaatcatacttaaaataacatatgataaaacatcaaatctcaataaaataaataataattacatatttttttataagagaaataatctcgaaaagttaatgatgtcatacattgaaaaataaaggcactcccttcgtcctgaatcatagagcgtccttttttaaggaaaatcaaattcaataacttttgactaataatcatactaaccatatatatgctaaatattatgcaagttatatcaataaattcatattttaaagtactttcatataatggtaattttatatttgttgggattgtaacatgaaattaattaatgatcaaactatgtttttgaagaccgtataaaaaatataaatcttataatttactcccttcgtttcataaaaaaccaaactagtaccagatgtgacacgtcctagtactaagaatctggacatacatctgttcagattcatcgtactagaatatgtcacatccgaatccgattctagatttgttttttacgggatggatggagcaggacttatggagcagctagcatcaacgtgcacggcaggttggcaccccgacctctgcaggtatcgcacgtacgtgccgtcgaatctctgcaggtatcgatcgtactcctgtatatcaacgtgcacggcatcccgacctcttcttatcgttgaccaacttgtagctagcagcgttacgtgcagccaccgcccgccgccgatcttatcttgttgttccaatccacatcgtccagctcggccgtcgccggtacatccggcttgtcaagtgcaccgcttcttcatttttcttattattatctacaccttcaccagctagccgtcgtctttaattattcatcaatttacatatctgatatcgtattaaagtttaaacctgtactacaactgaagctaagggtatgttatgtttagttcacattaaaattaaaaagtttggttaaaattaaaacgatgtaacgaaaaagttaaaagtttataagtgtagaaaagttttgatataatagaaaagttaaaaacttaaagaaaaagtttaaaactaaactcggtctaaacagatctcccaaacctttttttttcgcgtcaatgggtacaggataaagaaaccaaattctactctacctcatattttacgtgccccagttggataagcagcaggtagtgtgggtatctgtatgcatgcctccatagtcattgaagctcacgtgcgacgttgggagcatgatcgcgttggtgaaggtaaggccatgtgtacaacgcgtgaccctggcctatggtctcgtaggtccacgtcggagctgagccgagctggcacgagtttgggtggtctcgcagactgtcagtgagcttgcagaggaatcggtgcaaatgctgcgcctgggctggggagctgcgaagccacaagccgaagccttgcgttcgaggagtcggcgccccgcgcgttgcctcgtccagtcccccgtgccgtggtcgtcgtcgcctcgccagatccaccacagccaccatggtcgtcgtcgctgctccccgccaccgccaccgctactccccgccttcgctagatccgccgtcgtcagagctcgagcggcgcagatctgccgccggaggggagggcagcgaggggaggggagaaggaaaagagagggcggcgatgtggggggaggggagaggagaagagcgtcggtggagaagaaatcgaagagagagagaggagaataaaaaagagaaggggatgggaagaggctgacagtgggtctcaagttgtttaggagtatacatatacttcttttgattactatagggttcaaaatataaagtttcaataggtttgataatacaagggctgacatataaatagataggggctgacatgcaaaaacgttttggagtggctttcactgtgggtagtgtgacttttgtgtggttctatcctacgtggcgtcttgagatcacagttgcttatggctaccattgtacatgccctaaggccgtgtgtagttgcacagccaaaattcttttaagtatacgaacacacatttgaaatattaaatatagactaataataaaataaattacagattctgtttgtaaactgcttgacgaatttattaagcctaattaattcatcattaacaaatgtttacagtagcacacattgttaaattgtgcaattgattttttttatccacatttaatgctccatacatatgtctaaatatttaatatgataaaatttttagatgtttgaagggaactaaacacagtctaaacacagtctaagggggtgaaagagttgtatccatcacgatcgttccgacgccgcctgacgctgccacggtctggcccacctcgacgcagagcaccatcttgttggtcacctcggcaccactgcacgcaacacactgtagttgtggattgcctcagatcagtcgtgtgtgtcggggtacacaagcaggcggcgatggtctccatgcatctccgactcggaggaacggacaaaagagatagcagggagtccataacactcctcatccaagcagctggctgcagcatgatcagtcagtgaaagtggcaaatggttaagaaagaaatctctcctcaatagtaattttgtaggagcattggaaaaagtggtatttttgagagtgacgattccttagagcaggtataatagtagactataagttagctgtaaatatattttaaaaagataaatgagaagagcgaagagcagtgggatacagatttgtagccagctgtagcacggatttcaagacgcggtgtgtgtatgataggtgggaccagatattaatagtgtacagtatgtaactattatatgaatgaactattagatcgactatatatgaattggagttagtagttggctatactattaaacttgctcttagggtgtgtttgaataatgggaaacgggggtgggattgggattaggattggaaaattaatgaatggttaaaattaaatgaaagagagagaatgaatggttaagatttaaagatgtatttttgtaggtgagaaattatttccagtgtcaaatagttcaatttccccacgttggcggattaggatttttctgatgggtgtgcccaccaccttgactatattatcaaattgaaagactttggctatatataccaaatcaagactttgaccatatcaaattcaatgcacgtaggcacgccttgtactctacatagacaaatcaaacacttcaatttgatatggtcaaagtcttaattaaataatcagaaatgtatccagagatagaggtcaagaataacacatcaccaattgcaacttttttctacttaatttctcagttactctttgtctctattctgtagtttaccccatcaccatcatcaatgtgatgccttgctaagtgaagtagaatctgattctgatccgttatttggtgccttgctatagacagaaagtgtttctccttatatttgaatttgattcgatcgattcaatatttcttataagttcgaactctgattggtttcacctcttacatggatggctggatccgcacagctaacgcctgaagctggaccctgtatggctggcatgttgcctgctgatgcgatcgatcagtgcatccttgctgttggccggcctgttgctgttgtcgccggctcgccacaatgccgccgaacccggccagtccccacggcgctagtggctgtcgcctgttgggctgccggcgcatcatcggattgcgaacctctgatttacttgggcccccttgaaagataggattgtcaaaacatagaaatagaaaaaatgtagaaatagaatatcatatttattgaaattcctacgggatataaaaacacaataaagtttcaaaactaccgttcgatagtcacacagaaaagacataggaattcaagacacgggaaaaaaacataaggtaagacatcatgctaatttttctccaaaattccactacaatagtctattccataggaattttaaaggaatggtaggaatcaatcctttatttcaagagtaattttatggtctttgaggaggtatcatgaggtaccaccttttctattgtaaatttggttcctaggtactatgaggtaccaaattttacactaaatttttggtacctcatggtacctcctcaaggaccgtagaattgctcttatttcaaagggtctcatagaattatttcctattggttataaatcctttggaatttctatatttttcctttgtttcaaaggggatcttaacatgggtcactgatatatgatcctctactcaacgggtccacgtgtcagtaacttaaagttagagggacgtaaatgttgatgtgaaaaatcgcacgaataaacgaatacttgaaatatctgtttaacttcagtgccggtcctaatctttcaggttcaggacataccaattagtttgattctacaactaataatgtgtaaatgttagataatgataaccgatcggccacaaagccgattagagatcgtaacgatgagccgatgcttaaaagaatcggctatatttgagaatactttgcattgactagatttagattgaatataataaaaaagaaattctttaatagaatcaatcctgatagatcgaacctaatcgatacagtataagattattgacaatactaaagttaattatcatatgattataagatctaaataactagccggtgtacaaatatgtgagcagggcttaaaataactgtgatcggctcagaggtgatgcgacatgcaattaatgacctaatctttcgctttaatataagcaactataatacttcctccgtttcacaatatcaatatatgaatgtgagaaatactagaatgacttatattgtgatatctagattcattaacatcgatatgaatatgaaaaatgctagaatggcttacattatgaaacggaggaagtagatcagaacctaccgaggcattattaattgttggtaacaaagatcatatagattaataattatatgagttcagacaatagccgatgaggttacttaagctacatatggataatgtatcggctagaactctgatacaatcttatatgaaaatgtcatatttagttaaatatattaaacaagtcacgttcttagcagatcgaacctaacggtgaggtcaaagataacatgcaatcttaaacaaaagagttacatatcaggcaagcacactgaaaccctgataaaatcccaatcggcaattatagagcatgatatttcttatagctttaattacaacttagtagattcaaacctaaatgatgcaacaccaagttataattgaaattgatggatctaaacaagtccgcttacgcaagatacacagattaatctataacaacaaaacagtttacacgataacggcttaagcaagatgaatcagctgatagcagtaaacaataatattgtctaagattaaataatatatatgataaatgacgcttatatcgactggatcatagtgtcggttccaaccgatggaaaccctagccctgtcgatacatgcgtgttgacggaactcatcttgtcatcgaaaaccaaaaccgatgcagcccaactcaagaaaaaaaaagaactcgtcgaaaagaaaagctagggtggcgatgcaccgaaagttatattattgatgaattgtcctttacaatgatcccgggtgtacatatttatacacatgggttgatactacataattcttgttggatatggcacaaacttttctaaaaataaagtaaaaatatactacaagttctgatcgggctccaaacaatcttttctaaaaataaaatgaaaactaacttactttgtctaattaatagataaattatcatgccacttacttcttgaactcgatcggcctcttctagataaacttcctttaattgattaacttacttaaccaaatccactgatattaatccgactgctggcaactgataattcccatcaatcaattctaggactttgaaaccatactgactttaggccgatgaagattccaaatactttagaccgatgacgattccggagcttgtcaaattttaccgttacaagtaaatcagaggatactcttccgagcatcagcatagccacggcgttaaagcccggacctgttgtcgcgtacccacgacctgctgagtcccacagcgcccgcgccgccgatcgacgtgcgttcgctgcgctgaaccatatcgcgagcccaggggagaggagaactaacgctagctgcacacacacatggcacacggcagtacggcacaccgcacaagggcacctatagctagctgtgcttcttgggcacccgtccgaacattcagccaaccaaaacatactgcgccccggcggtatatttgtaaacaaaaaataatttatgaataaaaactgaaaaataaacttcgatagaaaaacttcaaaatcaactttaaatttaaggctaaaaatttaaattttagctgataaatataaacataagtaaaaaagatgaggctgctactccctccatttcatattaccggtctttctagaatttaaaattttgtatcaaaatatttgctctcacattccgaaacactttcttctctctgtgtactcttctaatgcagtcatacattaaagtactgtgataacttctattatatatattatatacttagaaaaataattgagatattttcttttaagatagaatggatataaacccggctgaagctacagtgattttttacgaggaaagataaggttacatgtattaattacaatcttcttctacaagtagctccaaaaaatgtatcaccgcagcaaacggtggatgaaatctccttcaatgtgagagccaatatatcttgaccggttttcagtagtgaatacaaattgtgaatacaataccggttttcagtataattcacggctgaacaaattgtgaatacaatccgtttccaaaaatattgatgaagccaacaccggcatttttacccatattttctcgcgcgcaagtggagatgttggcctagtttagctttttatgagattggattagcgcgataggagatgggaggacgattgtgtctttaaaggactccctccatttcaaaatataaagaaaaacctaaaactagattcagatatataatattaggtgatgtcatatcttaggttggtacactactacacaaagagttataggtgccggttcgtaaagggccatagatgcggattttcatccggcgccaattggtcggtaccaatacaaacaattgacacctatgaggaaaatagaactagcacctttagttttgctcgagccaaaaaaacagagagcccgctcgaatcgagccgaaatcaccaagcgtcgttacctcgccatgcgcccatgcgagttactccaaaatcaaattgaaatcccaaaatccccaaatcatccacaaatcatcaccaaaatcgattgacatcacataatgaacatactcaacaacaaaatcatccacaaattcacaaaaacatttacaaagaatccacaattgagactggggagaggaggagaggggatgacaaggggctggccaccgggcttcttcatgctccaccttctacttcgtcgccggtggggagaggagggcgttgccgtcgcctgccgcctgtcgtccgccacctcctctcttgcgccaccgcatgccgcctcccctcctgccagatccggcaaaggggaaggcgcagacgccgccgctgccgtcgccgaggtgcgccgcctcccctcctgctagatatggcagaggagagggtgctggcgccgccgcccccatcaccggaggccgctgcggcctcccatcccgccgcctcccctctcgctagatctggcggaggggaggtcgcagccgccgctgcgcgtgacaaagagaagtgagagaggcaagagagatagcgataatgccgatgctcactcattcgtatggataaggtcgacgacagatctgctcaacaaatctataattatttgtagatgtcgattttaattaactaacatttataatatattattataaagatgtcgggttttctaaaaaaaatcaatatctatagtataggtgacggtttttctttagaattaacccctaaagttaattaaaggtaccggttttatgtattttcaatccacggaagagagggaaaaatattataggtgatggttttagctgtttcgataactatagtcacaatcgctaacatgatgtcctcgtggttgtgccaagcatgtccttttcgtaccttgcgtggacgagttgaattcctctataaatgtgaccaaataaacctgaaccgagaccgttaatttgcttccttggtctttcgttgactctagtatagcttatcatcccagaagttttcctttgatcgaaagtggccgcccaggcatctggggagtcaaaataccacatgtgatcagtaaatgcacacgtacgtacgtggacaaatttctaatatggtaccgtaggctggtagcatcgtccatggtttaaacatgtactcccccgacctaaaatatacttcctcttttctaaaatgttgctagctaagttgttgtccagattcgttgtcataggataagtcaaatatcccattctagctagatagcaatattttagagcggagaaagtaagaaattaatttgtgtggatgtgacatatcctatgactatgaatctagatatgtcacgtccacctaaaatctcttatattttgagacggagagagtacaatattattgattactccctccgttgcaaattatagagggtactctttttaagaaaaattaaactctaaccttatatatgttaagtattatgtatgatatatcgctaaattcatttttttaagtatttttatgtggtgctaattttatatttattagaaatataacatgaaataaattaatggtcagagtatgttatttaaaatcatgtaaaaaaatatagaacttatagtttgtgacggatgagtacatgaaattttcaatttttttccatgtacgagaatagtcgttggagatgttatagtaattaattaagattagttgttattgattagtaactattaggagataactacacgttgggtacttgatccggagtgggaaaattgggcccccacgtcatgctgatgtcatcatgcaaaaactactttaaattattttttctcttaaattatttatccaaatcatgattcgattgtaacattaaattcgttgcaattaaatctttgaaacaagaccacatatagatatattctgacgaaattttttttttgcttattattgaattatttttaaatgttgcacgttgttctaccaagtatatcggaattgtttcactaagtggatcgaaaatgtttcaatcgtttaaatcggacgctgtttcaccttatataaaaacaatgtttcagcaaatagcgaaagaatatttcagttcactacaacatttgatccatatgtagtgaaacattataagtacactaggtgaaacatttttggtgaaacaaaaaaatgaaacgaattcctttaatagagggtttccaaaatatatgggtgatttgttgcaacggagtatgtgtgtggagacacgtggcaggtgggcagggagacgtggtggggccagggggcacgtgcgtctcgtgaggggagcacccgattttactcccccgccggtcgccagaccataaagaatttcgtactctctctgtttcatattgtaaaactgtctagtattgctcatatttatttagaagttatgcctaaatttttattaacatctatataaatataggtaatgctaaaaagtcttacattgtgaaacagagaaagtaattattaggtactccagttccgtataagacttacctggccttcttgaaaggcagcattataagtaactgtagccgcagaaatttcgtacttgaccgaacgaaagccgtagaatttaatcccaagtataataacaaatccgagcgctggcgcctataaaaggtggctcgctcattataccatccacggtcagtctcgcccatcttaattagcttgttgcataggccggcctgcttcaatcaaggtagaaacaagtgtaactctctctctccccccccccccccccttctctctcctctctctctcacattttatacctgacacacattctagttcggtaatactactacgggaagtgtatgctaaccatcaagccatgtacgtaggctgttaatattttgattttaggcaggaacgtttttattgacaggactgaaaatatatacagaatcagatcggagaatgatgcatgattctatcaaatttaaaataatgcatagtctctttgattattgaaatactctcgccattccaaaatgtataacgctgttgacttttcacataacatttgacaattcgcattattcaaaaaaattatataaatatcatttattttattatgacttgttttatcatcaaagaaattataatcttaacttatacttttagatgtttatattaaattctttaaataaaacgaagggtcaaatattatgagaaaagtcaaccgcgtcatatatatatatatatatatatatatatatagggatggaactgcagtatgttcttataaatggaaatctatatatattattgatttttaaaactctatgtaaagttaataaattttagtaataaattccatcatttaaaagggcacattcatgaataattgaattatgacattcatttgtatataacgtggataataaagtaattaatcatagatattaacatactcatctgaaatgttaataaagaagtccttaagaaaatacctgaaggtaccaagattttacactaaaaattttggtacctcaaggtatataacaaatacttgaaggtaccaaattttataaaatgtgatacttccggtactttttcaataatggcccgttaatataggtgttgtcagatcataatccattgagaatccatgcctttgtacttgaccctacattattaagaacacacaattctatgacattttggtcagcacgatccatgtcatgctagctccctgtaacaataagatcctaacatacgtcttggaatatcctatcaacctttcttgcataggctagcagtacatttctttcaactacttaaccatcacttgtttccatttagaaatagataataacctataggcaaacatgaatttagctccattgtattttcttgactctttctaacaaagaaatatagatcatcaagataatgcaagtattatatgctttaacgcatttttgctgattttggattcatcgatgatattccagatagatatctaacttttccaggtatttaattaaaaggtaaatcattataacccaagaataaaaattgtaaattttcatttgcaaccaacttggcatatttttttagtatatattgttccagacatcaaacataagaattcatgcttctaatttattcttatgacttatttatttttaaatgttttaattatgggttatacttttcatagttcaaagaaatagtaaattgaaaatttatcctacatataaacacttattatgacattctaatgttagaaattaaaatttattttgtatgtacatagaactgctataaaatcggtttggccagaatcggtttttacctgcggctggtcggatcacctgtaagtatacgtgtaaattaatggggatttttatagacggccaatcggaccacgtgccaaaatatattatcgtggtgatcataggcaggcgtcctaacaggtcagcgtgcgaaaatcgttatgacatgcagctgacttaagtgcgctgcatgcaataatgatttttcctatgatggtcgcttgtgataacatttttcaaggcgggctggttaggatggccacctgtgataatcgcatagacaatcaaaatcacgtcgcactgctctcttgacaagcacattcacactaacttgcagtgacaatcacattcacacccacattgcatcgacaattacgtacattcccaatcacagaaccatgacatatacattcataatcacaatcacattacatgcattgaaaatgacactgccttgtccaaatatactaccattcaaagataatatatgtagagagagagttcgacggatattttagacatattcaaccactgctggagaaagggtttttaaccccgattcgtaaccctatatagtccccgttatacaaccgggctataaatccaggactaaagataactatctttaatctcgagtgaaataattgggactaaaaaattcatctttagtctcggttggtaacaccaaccgattggtaggttttttagtttttttcattgtttttaattccttgcatattaatttcactccattcccaaatcatgcacaacaaattaatcatccataattcacatgcccatccacaaaatcatccacaatctacaagtcattcacaaaatcatccacaaaatctaaaataaactacaacaaagtttacaaatcattccaaacatctaaaaagatcacaaaatcatgacggccgccgccgccagccacgcgccgcttccaggccgtcgccaccccgccgcgcgccgcctctcggccgccgccactaggcttcccctcccgccggatctggcggaggggaggccgcccggccgtgcgccgccgcctatcccaccattgtttcctccgcggcggcttccgtcgggtcgcctccggccgccacctgccgtcgccgtcgtcggaggaggggagaaggggaggagatgggaaggggaggaaggggaggagatggccgggaggtggaggagagaaaatgagaggggaggaggaggagaggatgagaagggaggaggagagaatcggataaggacgagtaagcactactggagataatggcacgcggggctcggggctagattttcgcgattttttttagtttcgatcccggttggtataaacaaccgttccagttggtaatttcaaccggggctaaagataatgagggtttgacatgtttttgaaccgggactaaaaatggttaccaaccgaaactaaatatcaaagaagtacatgtaggcttttaaaccgggactaaatatatttttagtaccggttcttattcaaaccgggactaatgtgatttttatgtgactcagtaaagatcatttttctagtagtgacacatcacccaatttgtgtgcataccgcatgtacgtggtacatatagttagtataattattgtctacgatgtctacttcaacattaagtagtgcatgattaagcgcactttgtttcaattcgctccaaatgtttgatccattacagctccacatatattgtgaaatcatttatgctccgaataaaatatatgttggcctgaaacctacgtacgtcgaacatctatctggcccaactggatggggaaagggtcagcgaattggtacgtacccttgtacgtgttgacgccatttgaagccttccatttgacgccagaaaccctttgtgttgatcacaccgcaggagctagcagaaatataatgccacaacacaatgttatacacgtacgagtgggaaacactaccttatgttgtttctttctagtgaacgtgaatcctatagctaccatgcatgaaacattaatttctgctaggtttggtcatgatatgatcagtccattctgaatgcaaagggatcggatcgatcattctcgtggcttatacttggaatctcttttctttttctttgctggaatgactgactccattaattcatccaaactgtacagctagcttaatttacctattgacacttgtgttagctaggcttgaccggcgcgcgcggtggcgatggatctgaccatcactagtctcgtggcggcatgtctgagcatggcagttttgtttgtggccaccaaaatgatccaacaaagaccaagaaccctgtgcctgtacgaaaaggagaataaggaagaagaactacttcttccaccagtgatgagcgtagtttcagtactgactgcatatctgcctacacttatagccaagggtctaccggctgtgatccatgacctacactcgagactggtgacccttctggtgacggctcatttcttccaagcctcagaatcggagatccggcagtccaatatctacaaagttactgttcccgttttcggccgtggggttctgtacgacgtggacttggctaccaggagcaggcagataagcttctgtaccgactcgatcaagccaatcaacttgagaggccacgttgattctatggttcatgaggtggaggtgagcaatatgcaaacactatatgttatcctccagctggttggtcttttagtttcttccatgcatgcatgttaacttattactccctccgtttctaaatatttggcaccgttaactttttaccacatgtttgaccgttcgtcttattcaaaaaattttgtggaatatgtaaaactatacgtatatatataagtatatttaacaatgaatcaaatgataggaaaagaattaataattacttaaattttttaaataagacgaatggtcaaatatatttaaaaaggttaacggcatcaaatatttagaaagggattgaatatttccactcaattggtgtacatgttattcatatatagagatcatatatcaaaatgtttgccagtgtgacggatccggcttccagaagaactacttcatgtatctatatatataggcgctagctagatgcagttgcgaagccatgttgaaactagagggtgcacatgaacccccctaaattcataatttctcacttgaaaacactaaaatgtatagtattgcattaaaattttataaattttcaatggtagtgcacacccccttgttttgatgctatcttcgcccttggctatatgtgataagcaagcaagctagcaggcatgcctggtgtagtgatgtccaacaggagatgatgatgaacattaattatattattgattgaacaacattctttgttagcaggttaatttgctagcgtgaacttttaccatttgatgatctcactgaataattcagggcaggagatctgcctctttgattatgtggtatcatgcatacttttgacttttggtttgatttttcctatatatttatatgcgattttgcaatttgctggttagtaatatatatatatatatatatatatatatatatatatatatatatatatatatatatagagagagagagagagagagagagagagagttttcatatgttttattttgcgttatgacttagtatagatgccagagctagtcccatgcgtattatatatgtctcaattttgatcctagctagattgattggccactgcaatttgtagggctactttgcacagtggggggaagatggcgtagtggacataaagtatgagatggggaacctgatcctgctgattgcaaaccgatgcttgcttggaaaacagttcggggagagtaagttggaacaagtatccacactcctccatgagctcttcgacaacggtttccacttgatcagcctcttcttcccatatctccctaccccacagcaccgtcggcgcgacaaagcccgtgctatgctcggggagatgatccacgaggcagtgagatcacgcaggaattcaggcgtagctgaggatgatgtgctacagaaattcctagactccaaatacatcaacggccgctgcatgaccgagaatgagatcgccgggctactcatttgcatgatgtttgctgcgcagcacacgagctccagcaccagcacatggacaggagcttgcctgctcagccatggccaccgaagctacttggcagccgccatccaagagcagaaaagaatcatccagcaacatggggatcgcataaactggggcatcttgctacagatgaccacactgactcactgcatcaaagaggccctacggttgcaccctccagcaaacctgctgatacgccacgcaagcaagagcttcagcgtacaaacaagacaaggccacaggtatcaaatccccaagggacatacattggccacctgtacgactgtcggcaacagactgccctacatctataaggaccctaatgtatatgacccaagtagatttggtcctggtagagaggaggacaaagttggtggcaagttctcctacacaccgtttagtgccgggaggcacgtttgtttgggagaggatttcgcttacatgcaaattaaggtgatatggagccatttgctcaggaactttgacctcgaattgatctcccctttcccagaggaagaatgggagaaattcattccaggtcctaaaggtaaagtgatggttacatataagagacgacgattgctctgatcgatcagatgccgtattcttcttgtttgggcccgggacttacttgactcataattaaatatgttaagtgtgtaatctattagagagaataaagggtagaactgtgtgtatgtgtggagtcagtgtgtgtatatatatatatatatgtatgtaaaagttatatgcaagttatatgtgtggacactgtggagtcagtatacatacatacatgcatgcatacatacgtacgtacgtgggtgtgtgtgtatgtgtgtggagttagtataatgtaagttacaatataatttattgataaatatatagcaaaatcaaataaaagtgtgtgcacgtatgtttacactataagtatttctctaggtcgataatatgtgtcgttttggacaatgacacattctttagaaaacaactttaaccattataaaatatcaataaatatttgattttattccggccaggcggaggtggagacggcagggggaagggatggcgtaaacggcggactggcgggagaccggcagcaggcggtcgtggatgcggcgctcacgcggcggcgccccgggttggcggcaggggaggtgctggcggcgagagcacccgggaagcgatggcgcagaggcaaaggtaaggggcatggtgatggtggcacaggggagcgaggacggtggcagtgtggctttcggcgtggactctcgaccgcaggcgatgaagcacgagtaggcgaggcggtgcaccgagggtagcgggtgttggcgagtcgcggacgtcagcaaaaagagggcaaggcaggggtgatgtactgatgtgtcgagcggagagacgggctggacggcgtcggcgtgggaccgcgggaggccacagcacggcgctgtgccgggtacgggtacagggaggcggagaaagtcgtcggcgggggcccacatggccggcgggttttgccggcgaaaaaggaggcagcgcgtccgggattcgtcgcggagcggcgcgtgcacgactcggggcggcgcacggcgttgtgcgagcggtgcggggtggctcgacatttcgtcgagcaggtggcgcgcacaagtggctgcctagaggagaagatggcagctgggctggttgggccatcggggattgggggagggagatgggccggcctggttgctgggctgacggagagaggggaaaggagaaaattttcaccccaaacgaataggatcacgttgtattttcctgggaatttgggatttggaatttgaaggggatttgaattggattgaaatttgaatttcgaaaattgtaaatggactgtactataaatgggacattggactctaataatcctaggattatatttgtgaactttggatgatggagtagaaatctctaacggtacaaaccaaaattcaaataagtaccaaattttgaaaataaattttgtatttaaaataggttttaaatggaggcgaaaatcgggatgttacactttgtaactgcactgtaactatgatataacttatataaaacttgtattcaactatggtttggtttgttagcaccaggatcttacgcgtgacatgtgtgaaattttctttataatattatttctctttataaacaaatcttgaggcgatccgatgatcacaaatataaaaggggtaaaaaaaatactcaatctatttacttttgatagtcatatttcatcttggtataattctactagttattcctcgtaaacaagcgattcattaatatttacatttctcgatgcccatgtagccaatcttatgttgaaaaatagagagtcacgcattaaatccgagaaagtcattaagagaatagatggttggattgaaatataactatcaagtaaatttttcagatttaaaaatatgcctatcaaaaatacatgaaaagagtacttacagaaattttatagcaaatccgccagcgtaattacactctagtctatctctctgtccctcggggcttgatttcgactgttgtgacgggcatgtagtttctgtgcaccattttgacaggccaatcataaaattgatgggttgatttgtgttctactaccttcgttctaaaaagtcatgggtattcgtgtttaatgtttgatcatccgtcttatttaaataatttataaataaaaaattagtcatacataaagtattatttatattttatcatgtaataataataaataaataaaatttaaataagactaacggtcaaacgttggatataaacaatgtaaaacggtacttattttaggacggagttagcagtaagttgtagctgtacgccagaaacaaactaattttgcagtgttttcatatttcaaaacctgcaatgtgatgattgtaaggaaaattgacccattcaatagactttcatattgaaaaccgaaaaagctagagagggagagcaatccatggaaggaacacatcatcatacgcagtactcgtgttggagctccggcggctggagaaggaccatcggccggccggcgagtaacggcggcggagctcgggctgctggaggggaggtgccatccgccggcgtcggcgaggcgcccgcgcgatccgcggaaatagcatcgtcatggcttcgcgcgacatcatcatcgcaattagcgagcgacataggcggggattccaaaaaattcggatcgatcgaacgacgcaatccaatccaaacaagccccctcgtcgccgatctccgatcggatcgccgcttgattcgccatggatgatggtgatgagcccgtcccctatgtcatggatgagggtgtgctactacccttgctgtttccgccgccgctgccggccgacgacgacgccaccggcggcgtgagcccaagctgggtgtacctcgaagacagagcttacgtctcccccgatgcagtctccaactccaccaccgccttctccaccaccaccaccggcgtaaacatccatgtctccttctgcctcgcccgcccgccgcgcctctcctacctctgcgtccactgcccccgccccggcgacggcgagggcgcctaccggttcactgtcgatccccaagtcctcggcacgcacaccgatgtagccctcctccgcgtcccgcaccccaacgatgggctccaccgcggcatcaaatcctacgactacttcgtctacacggccggcggcgccacctcgctccggctgctgccgaacccgcgcgtctcccccttccgcaacgaggaggtcgccatcgtccgctgctccggcggcgcccgctacgtcatcgcctgcctcatgccaaccatcaggcgccccatggagttcaaggttatgcgcttcgactccgacgtcggccgctggaaatccacggcggtgtccatcagcgagccggtcgagagggacagggtgctccccatccctgacacggccagccaggtggtcttccactgcaccaccaaggtcatcacgctcggcggcaccatcggctgggtggatctctggagagggatcctgctgtgtgacgacgtgattgaccaacacccggtgctccgcgacctgccactgcccaagccagcgagaagcaaccgcaaatccttctgcagagggccgccgcatcattaccgggacatcaccgtcgtcgtgcaggactctgttcccacctgcatcaagtacgtcgagatggagacccgccccggtgatcggccacctcctcgacaacgacagccgccgcaacattctgatgactctgactctgatgaggaagaggacgttgcttactactggaaggctaacatatggagcatgccgataccagttggttcatggggggattggcagatggagtgcacggtggatgtcaccgacatcgccgtcgtcgacaatgtcaggttcagtgagctgctgccaaagattggcaatgatccagaggagacattgaggaggctggtcacaggtttccccacattgggtatggatggggatgtcatttctttcctgtccaagatcaatcgcttggatgatcagggatgggttatctctgttgatctgaggagtaagacgctgcaaggcgtggctgagcttgatgagaggaagaatttcctcttcgagcgctactacaacaccagtgagatctccaaatatcttatcaaggctacaggtttgctttataactgttgcaccataatactccgataatctaatggatagttcataaccttcactttgactactgtttacaagttgtctggttagaaacttgattcatatgagtgtgtttaattttcagggtgcactcctaggatttgtttttgaagtgccacttaaaccctctctctgtatgttgtgtgtttgatgcaggtgaggcaggaactcttgtaaaaactggggttaatagagtctcaagaaagaagaagtaggaattaattaatgaatcacgtaggctatctgggttgaagaaatgaaacgagctgcagagactgggcgattaatgagctactttatcagagttgttctgttcaagacatgctactttctgtaatggatttggttttcgcctatctatcctgagttaaactgtatcttcccctgatgattggccggaaatggatactcaggaattttgttcagttattatactataataaaatgtcaagctggcgaccccatcgttagagttcgtgttttacctttcgttttgtaatgaactctcttgctttccggctttcttcaaaagccagatttcgttcgaaatcagcaaaaaaatttcttcaaaaaatttcgttcgaaatatcagaatttgtctgaaatttcggaatttcggtgcccaccgaaattttcttgcttctccgaagggaaaaccctggctggaggaccatccgtcggccggcgaggaacggcggcggagctccggctgctgtagggagggaggcgcccgcgggccggcgtcggcgaggaggccccgcgatccgtggaaatagcataatggcttcacgcgacgtcatggcaattacaattagcgagcgagataggccggagttcggatcgaacgacgaaattcaatccaatcaagccccctcgtagctgatctccgatcggatcgccgccttattccgccctgatcgaacgactgttatttgatgtatttatatcgattaagttgtttatataagtctgtattggagtaatagccaatacagtatctattattgctctaaatactgaattatcggctatttctataatattgtatagaagcgattgataaaaacaaaagagatactccctccatttcaggttataaaatgttttgactttgatcaaagtcaaactgtttcaagtttgaccaaatttgtactcaacccaagacaaatttattattaaaatatattcaattattaatttaataaaactaattttgactataaatattactatatttgcataggaataagttcgcttgagatcccttaacttgggaatctgattttcgtccttcaaccataaaaccagatacaacgggtccctcaattattaaaaccgatacaaagcaggtctctcagcggttttgatggtggttttggctgatgtgacgcctacgtggccggtttgacttggtctttgtcctacgtggcgatgatgtggcactagaagcaaaattaaaaataaaacaaaaatgtggggcccatgtgtcagttagacaaaaaggaaaaacagtgggacccaccccatcctccctatccacggacgacgggagagggccgaccggccggcgcctccttctctctccctcccggccatccttcctccccggccggcgagcgcgcacggagagggaaaaaggcgccggccggggaggaaggatggcctggagggagagagagtaggaggtgccggccgatcacccctctcccgtcgtccgtggatagagaggatggtccactgtttttcctatttatctagctgacatgtgggccccatatttttttttaatttttataatttttatatttttacattttgcttctagtgccacgtcaccgccacataggacgaggaccaagtcgaaccggccacgtaggcgccacatcagttaaaaccaccatcaaaaccgctgagggacctgctttgcaccgattttgatagttgagggacccgttgtatctggctttttggttgaaggacgaaaatcggattccttaacaagttaagggacctcaagtgaacttattcctatttgcatataaatttagtcaaacttaaaatagtttgactttgaccaaagtcaaaacgtgttatagtctgaaacggagagagtagtattgtagccgataggacatacttcatctgtttcaggttataagacttactactctcctggtttcatgttataagacgttttgactttggtcaaagtcaaactacttcaagtttgactaagtttgtagaaaaaataataacattttcaacacaagacaaatttattatgaaaatatattcaattattaatttaatgaaactaatttgatattataaaattactatatttgtttataaacttagtcaaacttaaagtagtttgactttgaccaaagtcaaaacgtcttataacctgaaacagagggattatttagagtttgtcacttgtttatcataaagccgcagccgatttggtttaactgcatcagctgggtcttgacggtacgtcacccagggttattgtaaaaaacatcattctgctagtactgttttatttctagaagcgccacttatgatccattcaatttttaatgtttgatgccgtttactgctggatataatttgaccattcgtcttatcaaaatattatgcaaatattaaaaatgtaattctgctaaaagttctttaggcattaaacaaataacaataagataaataataattacataattttaataaaacaaatgatcaaaacgtacgtccaaaagttaaacgcgtaaaaaataaaaacagagagagtaattattactccatcaggagagtaattatttcaaaaataaagtgtttattagatattttgactgcattcacagactagttaagggcttaactaaaaactgcactttactaaatcacagtggtgtctgtcatgataacgttttagagaggatcaattagtttccgaccgtttgatctactcctaatcatgcagtcgccaggcgatagcacaagataaagagaaagtacttagcgcctgcatgcggctggtgctgccaataccatgcattatttgtgggactgcatggccttccataggttggaagaaaaattagtttggtgggtgagagaaaaggcagattaagggcttgtccgttttagagaaaaacaaagcatttggattcataagattaatttttatgagcgtcattccatttgttggattgaggtataggaaaatcaaaggaaagtttcctttcctacaagttgtatagagaaaacataggaatttttccatccactcaaacatgttggaaaaattcctatggattgatgtatgcaaacattcctattcttgcaccttttctattcctatggattcaaattcctcaaaatcgaataagccctaaagtggtgggggcctaaatttgattatatttaaaagttggatgatagattttttggaaatttttgtatagtaatccaatagctagttattgtatatattagcaattcctacctttgatgtgaacaactttggagacaaccgctagctctcttatatatattaaacttgctttagttaagaatatattgcgagagagagagagagtaaaggcacgttcaatagtaaagacgagtatggtcgcttaggcaatataagattatttagaaaccatgtctttacaacagtgagatgataaaagctctaatataaccattaattaaaaataagattcttttatttccattgtttcctttttttttcaccctcatacaactatgttttcattgtatgaaggctaaaagccgttgttaggcatgttcaaatcagagcccatatatatataaacgcttaaatactaccttcgtcctaaaatataagcatttttagctatgaatctgggcactagctaaaaatacttacattttgggacggaggtagtatttaagggtttagtaacatatgtttacttagataccatgtccttacaacggtgaacacagcaaacactctaaaccattaatctacaaaattattttttattactattatttccttgttcacatctttatgcagcaaagttttcattttatagatgttcaaagtcgtcgctaaaaagttgttaaccatagtaaaaataatgtttgcctctccttgtttctctctctctctatcatttagcaaacatttctaattagtaacgttaagagactaccattgcacatgccctaagaacaggtacaatagagtaggtacaatagcaggctataagttagccatagactcattttgagaagatagaagatgtgagagaatagcggcgggctacagatttgtagccagctacagtacggactttaaaatacatgtgtagtgtatgacaggtgggactaaatattaattatgtagtatatgtttataggtaactattgtataaattagctattaagttgactataaataatttgaaggtagcaatttgctatactattaaacttgctctaatactatagtatatccttttccgtacatgtagcaaaagcttactgttctaggagtattaattattgctagctgatcataccacgttagtcgttaagcatgcatgcagctaggacttaagtggtgccccacaaatagggctggaaacgagccgagccaagccaggctcggctcggcttgcaatggctcgtaacaaggtaggtttggcttgactcggctcggttagggaaacgagctaaaacataaactcagctcggcttgtttcctggctcgagccagctcgagctggcttgcgagccttctgttgaagctacataatttataatcattaaggaaaacaataacaaattatcaacatgtaaaattaaaataactttatatattcaattcattagaatatagataataaattacatattgacaaataataactctattggaaaataaaatcatccatataaatatatgatggcctaagctcacgagccaaatcaagcggctcgcgagttagctcgggcttggctcgtttcaggaacgagctaaaaaggaggcttgggcttggctcgtttggcattcaagccgagctgagctaagcgagcttgagccaagcccgagctgagctcacgagcccaagctttttttccacccctacccacaaataactaattaattcctgctttgtgtttgaaaagggaaaccatacgtgcttttgtgcttttgtacgcatgcaaaaattatacccctacttgcattaattagcacggttagttgatgttgatcctggtcgtgtagtatctctgttttaaaaagggaaaccacttgcattagcacggcttaatttgatgctacgtacacttgcatgcatggttacgaacgttctataactgcatcacgatggtggggttttgatagaagagtctacatagcctttaattgtttgttcggcgttctatgaaattagaaaaaattctacgttgagaaaaaaaatgtagacatccactcgtctaacgagaaatacccaggggtcttttggctaactccataaggtggtgggctatatgatctgggttcaaagcctcaccatttctaattatttgatattaggtcctttcctaatattcgagtctttttttatccactcgtttatggttccatgacattaaaaaaaactagatgaaaatatatagataaatatatgttaaatattatagaaatggtatatcgatatatgttgaaatatgtgaaaatgatgtggtgatgatgactttgatacgtttgcatgttaaaatctagattatacactaatttgtaaataatattgtatgtttgtatgtgctttaaaatcagtaataattgttgggtaatgatataacttgtgtgcatgttcagctttagaatatactgaggttataactaatatcgtacctagggattgaaggtccaactgcgaaacacataatgagactctaaaattaaatattactccgtattttaatggatgacggtgttgacttttttgaccaatgtttgactattcattttatttaaaatttttgtgcaaatatgaaaatattcatgtcatgcttaaagaacatttgatgatgaattaagtcacaataaaataaatgacaattacataacctttttttaataagacgaatggtcaaacgttagaaaaaaatcaacggtgtcataaattaaaatatagaggtagtataatttaaccaaagcatgctttcccataattagaaacgaatcatcaagcacaacccatcaatgggattgggtaaatgggccttgtaatctttatggtttgtttttttcttctgtttactaagccttgtaatttgatgctaattaagtatagataattactacgaatgatagacttgtggtcctaattttttttggcctgaacacctgcacaccttgtactataccagtataccggccaatatatgactccagttgtaactatggtataggctctacgcttgggagaaaaaaaaaatagtagtgagattgagttacaacgccaccacttgaatcggcaataagaaatttttaccttctatacctattcgatcgaggaccgtaaatttactagtatttatttagagaaaaaaaagagtttatatacgtactatatgttaccagtaccacacagccgattagctatttaatgttttgagactgcatctttagatcttttcaaattgagccacctggctgttgttttcggctgtataaagaaaacgcaaaccctcttactaatatttataaaaacatagtacaaacgtagttgtctataacacacgtatacttatctctataaatacacacacgtataccctattcctataagtacccataaaagattaggtcggtgcatctttgatattggtgaagttaccacgaacgtgttgctgtcgacgggtaatcaagaaaaagaaataaaacaataataaaatgtggtagaaataataaagggagtggtttgtttggaccaacgtactcacctgcttgacagtgtgtttagttcagcgtaaagtttagattttagttgaaattggagatgatatgactgaaaaattatgtgtgtatgacaggttgatgtgatgaaaaaggactgaagtttggatccaaactgatctaaacacagccatatactcctatatacacggtactcctagcttgtggttcaactttagtactactagtagcttgtggttcaacacgtctatccgaagtatataagaacccacgccggcctcagtgcggatgaggccgaggggttttttactttacccattgccctcccacctgctccccctcctgccctcccaccctcttgtgcgcattccgtcgagcacgtcgcgggcgcacctcccgccgctgcctcggcttgccccaccgcggatcgcagagcgaagcatccccgctaggctactaaagatgcctcatcatggtggtaggaagaagaagaacaagggtgggaaggggaagcctcggaagaagaccgacgaccgcggagaggccaatgtcgggtcgggcgacagctcgcccgccgtccgcgtcgaggaggaggcggaggtggaggcggaggcggaggtggggacggcggtcgagccgcagcgctcgggaacgttggcctcgcccactgacgtcgtcgaggcagcccaacacggccagcggcagcagcaggcctcccagtcccaacagacaccaagccctcgaagttatgcagctgcagtggtgaacaaaagagaagatgaaacagttggctacaacttccttcagttccttcgaaggtatcaactatttcttggattgatgtatcctagagagcataagactagcccaatgtgatttataaaaattgaagatgtgtttcatcagatcaagttcttattacgaacgacatagctgtcctactatgtttcttcttccgacacatgtgtgcacataagtgaagatcctacgtaaaatccagtaatcataataggagttttgggatgggcttaaagcagagaactgaatcgggctctcttttttaaagactggtttgagatattttttgggccttccattgagaaaagaagatgtatgctgggtgtatcatcgcctcaatgctcttctgctaattggctatttatgtagtctgctcgtctccatggctccatatgcatatgcatgtaaatccatttcttttagggaaactaccgtaggagagcatcctacacatgcacatccaattaagctctctgatacaaatatggacatgtttatgagtacatgtcaggattgctccctgcaataatgcaaatatgtctaaattaaatcccaatgatttcatacaatagaaaattcataaaatgccatcataaatataagtgagttgtgaaatactatcgtatacgagaatgatcatgtggggtctggacccacatgttaatgacatatacgatgatatttttcaacttcatgatcttcgtgatagtttttcatgatcatgtggggtctgcacgggcactttttctagtcatattataatttttttgaaggatgtataaatttgttttttgacattatagtctcatgcagcttcacagtagagcacagagaagggcctttctatgctggggaactaaagagtatggtctatcagaacagcaaaactttttgtgtctactatgggcacttccaaggacaatatgcaaacctgggtacaaaaatatccaactcatatgcgaggtgcgacttgctacttatttacattgcctttttccaaatgttatatcagctgaaaatattgatgaatcgctttacaaattcctgccattacctttcgaatttgttaatttatggtgacacaattatatagagagagcatgcatgtggaagtcagaagcaaaagtagttaatagagagcagactgaagacaggagaatatatgaatgactagagagtgtaactttcttttaatgtcaactgaaagtgtatgaataatttcctatgcttcttaggaaatccaattgtggtcaaaatgttcttactaatctcagtaacatgtattctgccaaatactgtggttggaatttatcagattattttggattgtgtagttaagtttatacctcaaatttatggcgtatgttgtatagacagatctttatcttttgcaaatgttgtaactgtgcgttcattctgaacagggtcgtgggcttcttgcgaagtgctataggaagattcatcaccgaatatgaacttgatgatcaatggagagaaatatcaaatgaccccccaaagattcatattgatgccctgcccccagctggaaggtttgctctctacatgagatagaaaagagaaaaggaagtcttatgcgccttgtcttttgagtaaagactaactgtgtcattttaatgcagcattgtttcacttcaatatttcctgggacaagcacataacaaacttgtggagactgcacgcatctatgatcccaatggtagcttagtcgctgatagtactaagctgggaaggagagtgttcctagggttcctcatatatatcatcaatcagcataaagatggacgcagttggtgtggtgaattttctattgatgatctactagtcagaaatgaatcaacatttggaatcacgaaggcagcttcttcccatgcaagttgtaaagcaatggctaaggatctgaaacagttggcaaagatactagagaaacactttcgcacagctcaagggcaggtccctggctacttcattaagcttttttctgaactaaaagagagcgcaggagagctcgggcagtacaactcagagaaaaccaggaagttccataagtatctgagttcgcatcttgcactcaggtctgcgatgtcaaggaggcacctgtttatggatttgttccgagcgtaccagctacttgggaaaactgcaaagaaggatttgatatcccttctaggatccatgtttccagaagataaatggcttgaccaagtagacaagcaccaaatgtttataaaagtatctgagtatggcatcgtggaaggtgacgcagataaggcatccaacagtcaagatcagaagaagaaaagatcatacagtggcgatcttttagatttgctggtgtttatccgccacgttactgagcacggggcggatcacacgaaagtacgggcatatgaaatcttaattttctctttcatttcatatatgtgcaagttcaatttcctgacaagtgttcaaaactttgtctttaaggatgataacatggagcaaaaactcaagagtttggttgaaattgacttgataattgctaagtatctttcggctgctgttgtagaccttatcaaggctttggtgaagagtgacttgctaaaagacacgtactttttcttctcttgtatgtttatttgttttctcttgaaatatatttgttgaaatgattattttccatattgcaggttttctgacccgtggaatgcgttttctaattcttcctaataggtatataaagttttacttattttcctgccatttgatcttctagtaaatttcatagtatccatattctgcatctgcgggtcaactttcttattactactataacaaagtagttgcataatgattactgtcaccgacaataccttgacccgcactatatatgaaaatccgctgcatttcgtgaatagtggctagcactaataacaatatcctgtgagtccactacttacatattacacactatttactgtcccagggcccataggttttttttttttttgccaggtcggccaaaagattcggtcgaccaatttcattaaggaaaaggattttggaaaacattacaaagaagcttacaacgacagtacgctgtcgagatggagaagggctaggccctcatcccgtaagctggagaggaaaaaaaaagtacaatgccctaaggcaaactctaatcagagatgatcgttattacatggttggataactcctgcggtcttccacactaggatttcctccttgatatcctccactagttgctcaggggtgcgcactttctgctcgaagatcctaacattacgctctttccacagagaccagcagattagggcgacaacactgtcaaagatgtccctgtagccggtccgaaaaaacctccttgcgttcgtccaccaatctgttaggttttcttcttcatgtccagacacggggaagctgattccaatccattttttcatcagtagccagactctctgggtgtaatcacaagtgagcaacagatgtgagcagctttcatcttcacgctgacatagcacacaatgttcctcgtgcggccatcccttcttttcaagattgtcggctgttgaacagtgaccctttgcagccagccacaagaaaaatcttactttggaaggtgtcttggtggtccagatcagctcactggagacacagagctccctggccatgaagaacagctcatatgctgaagaaacagataacctcccgtcaggtgttggcccatggggtgtaatactccgttgatgaactttcttcttagcctctgtgacagaccattttcaacctgaaaggaagcaacgaatcatgcgtgcactattaacaatttcttcacagcattattcctgcaaccactttgcttcaaacctgaagccactgttgcccccttgacatcacagaaatcttgtaactccaattagtatggtcacaggtttatgatctgagtatcttggatctcgtagtatcaccttatatgacgggaaccttgtcaccaattttgggacccaacagccctatcaagtctgtcttttacatatttgttggcctcatggctgttgtttcctccaggtctgtacttgtctcctaaataaccaagatcatgaaccttgttgaagtgtttggcacaaagccatggaagttgctgatgttgattttcaagagcttccaagtcttactctctcttatctgtctctggttcccataagagcatgtgaaccatcctgctccaccatcaccacattaatatgatatctggaataattgtgaactcaatgtttacatgtttcttccacaatagagcaagcccaccacttcttccacaatagagcaagcccaccacttcaatatttgacattcccagcaagtacttgaaccaactcgtcctcttctcatctattttagtttagtatctggtaatataaaatgttgaggtcctcttgcttctggaggtccagaagccctcaactgccaggacattccccaattcccagcagttccaagctgttaatcctcgttttggcttgctggcctgtcactgcagcccagactttacaatttctaaagtggtgttttcttcctttttcatcctccccatcatctcttgctttctttaacaaccctgtctctacctcaacctccatcaagtcagcattcctcttactcctttgtttgccctctccccttgctatacgcttcaaagtaccttgccttgtgcctgttgctgtcttttgatcaccgctttctactcttctctgatcccccactttctcatcaagcttatcactggtttgtcttgcgcttgatcactctcctttttagttgttgttgttgttgttataatattgttcttcttcttcttgttgttcttgtggagaagagacaacacgctaatttggatctataacctactaatattaggctttggaaatctgtgatatatcatataaccgagcagactcgacataaaaaagttttcctctgggtcctatctatggttaatagttgccgactacaattgccttgattctttaagtgaaacagttggagagtaccatatgtttatcccagttgaaaaaacagtggttatacccttctttttacaaaaaacagcaggcgagactcctacacatatagccactaaggataatcagaagttagggagtgaaatcggcctgaatcttttggactaccttatgcctgtacttagttaaaacttttcactcctgaataataaattgtgttatgtgtctagatgtgtattacaaatgcatttacatatgtggtttatgcttatctcttattgtactactctgtactattagcacaaatgtgtatgtggataggaatcgtttaaattgtttactttacatgttctggtttgctgaatctatccgtgctgaaaagccttcattaaattagttgttgttttttcttttttttaaaaaaaaaaattctacgatgtgccatggtctgtgcctccatgccaaaggcggggggtggggttatcatctgtggggttacttggtagtttatattaaaaagaagagtaaactaaaaagaattagtggcaaggatcaattctgataaaatttttaaggtttataatcctagcaactgatgccatcagttgtgaatatgaatagctccagcttccagttataatttcaaccatatatattattgaaccctgtttcttaacaccatcatcccaaaaacagaaacaaacagcaatgcaactacaaaagcttcatctatatgaaatcccaattcacatccaacatgtgaaacctacactgatacaatgttatcatatctatgaaacaaacatttgtatgactagctcacccttcagatatctaacaaaataaagcgcaccaacatgcgaataatttgtttgaatgccattgccaaacctacgtaaaccttgtactcttgaattttgctttccatagacactgagttcaaaaaccgatgatccatttccttcctatgactttttagtttatactcgtgaactttgctggcaagcccaaagctttatgtgttgtatcataatagggataatatttttaaaaaaatacaaagaagattacaagatcagaattgacaaaaaatagtggttatatcattggcaatatgggagtggggaacatcgatcgtatttagcatcaaagacttaaatcaccagccccaaccaattcctgcttgcccttggtgtggaagaagtaatccttttatatctgttgatgcaggtgggttagcacgcttgttggagaagagaggcaccactgcatatcttgtattcaaagtgccgtcaaggacttgagagtgcctcgttcagtaatcatagttagctgaagtctgtggtgtaggtgtttagcttccaaacttggttagaattttgagtttcctgcttactggcgtagtatgcttcatatttttttcctttttcttgttttgaggttgggccaggtgaggtaccccccgctctccagtaaggacccctgactgttagttctatgccaggagagtagttttggtgtgatgtgttgggacttgggagttgttcagtctttttgagcttaacctgtaaagttggtacccggcgtgcgtatggatcggagctggtgaacagagaaggaagacgcgcacattggggatgattttggagcgtgttgactgttgaggactggtaggttgctagggaaatcagcataacctggattacagcccttgtttggggggtttgttctctgtcggttggtctgcaatgtttattttaatcccctttcttattgttggctatttcttgtcatgctaccctcatggaaatatcgatcttttacattagcatataaaatattaattattggaccataaataatgcttaaagatataattccatagcaatttaaatcaatggaatatagaatactttggtaagatggccaaaattgccaaaattctatggggtctctagccaaacaaaggaggctggaggaatgtatcacgatagatgtgaaagtggtcttatatagattgcctgtgaattgtaatacaaaattaatcagttgggatggaccgggataattatttcatactttatataggcatgtgcatgtctcaaagtttgctaattttgtttgttgtactaattgataaggctggtgtatgcttttctaggagtatcaagttagtaatagtgaaaaattcttttagaagtggtagaagagttacctggtttttttaaccttaatagttgcctgattttagctcaacatccatagcataaggagcccattggctaaacaatctcaacgcacagtttgagagatgatcataacaaaatctgatagtaagagattgatgttaccagctgatagtctgtcaaacaatttagaggattggtgttattcatcttttttctggaacaaacaataccacatgtaatccaaaggaaaagatacatacagaataaagctaatgtaacatctacatgctagcaaaagtccacaaaagagagagagctatagaggtgtggagctgatagtaaaaatcaaaacatatacaaattcagctaggaaaagtgtgaaactgtacggtagctaggtaagcaaccagcagtagctatccgcgagaaagtacttggatgaagtagtaaaataattgattgtacatcaacaaatctaacatttactcagatgaaatttcacatgctgcgctcggaaactggatgctaagtgctaacatgtgagcaagaaccaaagagggagaaaaagatgatattgcagttacattacgcttgataactcgatttaccttggctgcgtatatctatttagatgtagaattcaggtattacccattagttttaaaaaagaaagcccgcggccactcacatttgtggtccaatcgattgataaagagcactccacattagggttgatgatggagaattacaatgtaattaaagaggataacggagagagggattaatcaccgcaattgatatttcattaataactagttgggtggccttgcgcggctagcacccatacaaaattatttattttttaatgtgattttgcttaaaatttgttaaatatctatctcgttgtcttaggattttgagagaccgaactttatcatccgcgcgtttctaattttataggttttaaaagtcacttcggtcgctaccccttactcatttctcaggtctttatttacttgtcgatctatcacttttttattcatatcttccatgaaacctttaaaaattagatcttttagtttttagagttcattgtctttgaattttgtttttataatttttttaaagttacgtcaaacaccgccattatactcctctatggcccctccgctgcctcctctatttattatcattgggattttaaaaatcaaacataattattgtttgtgtttatttatttttttactttctggaagtcccgctaaaccgtcagtggctttatcattgtactcctctgcgcgtgacccgcccgttgcctcccctctttattgtcattgagtatttaaaaattgagcatgattattattgggatttatttttctactttctagaatcccgccaactgccatgatcatgttgcttaatggtttgttcgttgtcgcatctcttaatcgtcattgggattctatttggagttttctttatatgtttatagtttttacatgtcccaccaactgccaccactttactcctatgcaggcttattgtttttcgccctcttcattgtcgatattgctgtctgaactattcttttcgaaaaatccatatttttcatttttataattttttatttgtaaattgtattcatacttgaactcttataattatttttctatttttgaaatttattttatttgttattttgaattttagttaatctcatcacatgttctatatggtctattattttaatatttttatttttattgcgaattttaattatttataaattgtatttctagttgaactctttttttatttttataattcctgaatttattttattttttatttcgaattctaattaatctcgtgctatgttattgattgattaattgttgttttaatattttttatgctgaattttaattattaaaaatatatattcctacttgaacttttcttttctttcctaatttcagaaatttatatatttagtattccgaattttaattaattatgtatttggttcttatatgaactcctctatcaatattgcttattttaaattccgaattagttatttcaaaattgtattcctacttaaactcttattttcttttttaatttcaatttttttatttttattctgaattttaattaatcacgtattgggttcttatatggactactctttcaatatttcttctttttaattccgaatttgaattttttttagattgtatttctatttggactcttcttttctttttcttcaattaatgtgtgaatttctagccctcacagcgtatatggtgccttctttttgagctgtgttaataatataactagccgggtggcccacgcaattgcgcggctagcacccaaacaaaatcatatttttttcagtatgattttacttaaaatttactaaatagctatctcgttgtcttaagaatttgaaagaccaaacattatgatccccgtatttctaattatatagtttttaaaagtcacacccagctgctatcccttacttctatcatatcattctttatttgattgcttgatctaccactatttctattcattctcctttaaacctttaaaaattagatcaaccgccaccactctactcctgtataggcatgttacttattttatctcgtcatgtgttttagatggtcttttctttcaatagtctttattttttatcacaaattttaattatttacaaattgtattcctaactgaaatcttttttctttttctaatttcagaatttatttttttcaaattttaattaatacagtatagtgttcttttaaatttattttttatttttgaatttcagttgtttcaaaattacatctctacttaaactctctttgatttttctaattttggatatttttttatttttttaattccgaatttcagttaattttaaattgtattcctacttgaactcttcttatctttttgctagtttcggattttatttttatttttattccgaatattaattaatctcgtatcgggttcttatatggactcttctctcaatattccttatttttaattccgaatttcagtaatttttaaattgtaatcctacttggactctccttttcttttctaatttcggattttattttattttgtgtcaaacaaaatcatattttttaagtataattttacttaaaatttattaaatagctatctcattgtcttaagactttgaaagaccaaaccttatcatcctcgtgtttttaattatatagttttaagtcacaccagttgctatcctttatgtcatctccttcttcatttgcttgctcgatctaccactatttctacttattcttcttgaaatcttttaaaattggatttttatagtttgtagagtttattgtcacgttgggtttcgtttttataatttctagatttcccgtcaaacgttgccattatactcctctatggtccatccactgtctttctctttattgtcattgagattttaaaaatcgaacataattattgtctgggttcatttttactctctagaagtcctgccaaaccgttagcggctttgccattgtactcctctatagctcgcccgctgcctcccttctttattgtcattgagattttaatatcgaacatgattatcattgcttttttttttactttttagaagttccaaacctttaaaaattagacttgtagtttcattttttataatttttagaagtcccattaaacgatgccattatgcctctctatagcccgtccgcggcctactctttattgtattcctacttgaactcttcttttattttctttttctaatttcagatttatttttatttttattctgaattttaattaatcttgtattgggttcttacatggactcttcttttaatatttgttatttttaattccgaatttcagctatttttaatttgtattcctacttggactctcatttcattttctaattttggattttattttatttttattttgaattttgattaatctcgtattgggttcttatatggaaacttctttcaatattgcttatttttaatttcgaatttcagctattttaaaattgtatttctagttggactcttcttttctttttctctgattaatagatagatagattacggacgttactaatacttgtacgcaggattttttgccagtccgttcatcgccacatcgtgtggaaggcatttcttcttccccgtagctgaaattcagatttaaaaatacatagtctatatataaatacaatttaaaaatagctgaaattaggatttaaatatatggaatataggagcagggagcatttttacccgtggttcaatcgatatggtgcttggtgcaggtggaaaaagttttttttttttcgtatgcacaagactcactcagatcatgtgcttgtgggagttggcttcaagaggagaggaatgacatctcaaaagcgtgtttcgttaaaatgccaatatgaagcgcgtgatcacagccattttgccattttcaattccatatttgctgcaatgtggcttgatgagaccaaattacccctgctcacccagttgctgctgcttcgtcaccacagcgacagagacatcccgacggagctcctggcggttctttaccgccagcgtccgcgccgacctccgcccggtcttcgccttcctcaccgacgacctcgccgtcccggacaccacctaacgccgcgtcgtcgtcaaatgcccccagaccctcgcctgcagcgtccgcgaccagctccgctcggcgctcctctacctctgccgccttggctttcacgacggccgtgctctctgtcttcaggaccccatcctcgactgttcgacggcgaggaggcacccccagccgacgccgacgtgcgctgttcctaaaaacggaccggtgctcgcctgctcggactcacttggggcgcgggatggaggcagcgagccggtgagcagcggcacgcatgtttcgtgactgtcacgcccggaaatatacaccatttccaaacgctcagtgcattaatcctcgtcccaggaggcgaggtacacatagacattgttgattattacatgccacacttgcggaaacgtaaaggagtacttgattacatgggcgacttaggccctcacactcaaagataaacaaataaaacagcggaagactacggaacagcagcagccacaggcactcgacggcggagcgaactagagatccaagccttcaccttcctcaggtccatcctctggattatttttgtgagcaagagtgagtaccaccaccgtactcagcaagtcacaccggaaatgcaacaataatgcgtagggaaaacaaggaaatggcctaatagggtttattttgcataaagccataatttaaacattttaatcaagttaaagctcattttaaaacacgatcctgttctaagccaatattttaatatcatcaaggtcgcatgagcctgcgaacctgccttaacccaggctaatctccacatgactacaccatcatgatttcaccctccaatgttttataaaacaaaactaactttgggtacattgctcagcttgcccataaccgagggcgcggctattcgaatagtttttaactctgatcagaggtgtacaactttacccacaagacacaacctcaacacgcgttgccacgcgccgggtaccaccacggtactcggatagaggtcgtgacaagactatccatctaggtctacccaaaacaggagaacccgctgaggtttcgccgcccgccggtccccgacaaggtaaaggttgtcggatcccccgggacgagtcaggcccccccttgcgccgggtgaaaaacggccttaatcctggccccacacccttccaaccaatggtctctgttttgagaagatctaaatttccagtcaggccttacccactagacttgtggttgcacgaagatgccttgcaacagaggcccgaagaccggtccttatattagccggggtgcgactaccaaagtaactagcttgcaccccaagcccagcccaaaaaaaatatattttagttgcacaaatcattttatcacccatctattgacaaaccagtcaatagtccataactaatccaattttagttgttaaccaccaaagtctagtttaaccaaaagttctaggttggaactaagcatgactaagcatttacctaaagcaactagtcagtccatcatgtagggtactagactagtcaagttataattttactagggttcacaaagatcatggatatcaaatcaacatcatggccataaccaagagcataggaataactaataaaacaatattaataatgaacggtataatttataaagcaatgcaatataagtaaaacaacataattttcacaatatgggattcaacatgttcaaggtagatatgacttgccttgatcgctcacaaagtcttcggcgtcaacggcgatgaagagctgatcttccggaacggcaggatctacacgaccaacgcgaagaaatacaaaaggactaataaaaaccatatgaacagaagcaataaagcacataaatggattctactcatttttaggagaaattagagatttgaacgggtcgattccgagttcaaacggtcaagatatggccatttgaagtttaggtgttgtttaaatggaaatttgcaattttgtgaattatttttctaaaggaaattgatttattgcacagagaagagagagaggggtccacgggcgggtcccacttggcagccgctcggtccactgtgagccgagagcaccgaggtggctcacggtgcaccgaggcacagacacggccgggcaggagcagcacccggccaggcggctcgccggcgacggccaacggcgcggcggcagtgcgacggagagcggaaaggggaaaaacggaaaggggaggagacgacggttctcaccgagcagacacggcggcgagaggtcgacggtgttgccggcggtgaggaagaaacgacgagaagcttcgggtcgtcggcgtcggcgtcgttcccgcggtccttgtactcgacggaggggtggacggggaagaggaggaagcgacgaagcggatggtggcgacgccgggctccgacgaggtcccgaccaccggcgaggggcggccggagttgcgacggcggcggcacaagaagagagcggcgcggcggccgcggagagaggagggagagggcagcggtgtgaggggagagaggagggagtcgggggtcccttttataggccggaggggagggagagaggcgccggggagggagatcgacgcggggcatggtggagctcaccattgatgagcatcatcaaaatccaccacgaataatgtgggattgagtgggaaattatgggggaattggagaggatgaggtgggaattaattcccctcaattaatttgatgaaacggcgagtggaggaggcgaatcggaggttgccgtcgcttggaattcggccggagagagagaggatggctggaggttagggatgacgagtgggacccacctgtcatcgagtaggagcacgcctgtcaggctgggcgcgcaggggaggtgaagcagacttttgtccgagggagatggggagcagttgagccagcccaaggagagggagggggaggggagagagggagggtgagggggcggctgggctgggctgagaggagggggagagagatgggctgcaaacagcccaacaggaggaagatgatttcttttagcttttcctttttgtaaaattctttaattgtttttgttgccttaaaattatttaggatgctctgaaaattcaagtaaaaattggttaaacatttttaagcatggggaatttattaaaaatacccacaagccaatttgacataaatcttggtgaattttaattgttggaggctcttttaggcttttaaaatttctagaaatgcattaaagcacgatttaaatttagggcgattttcagggcgttacagtgacgcctacccgctggtctgctcgccgacgaccacgtcccaccgcctcgctgtcccatgcctcgtcgggtcgccggctcctccacaaggacctactgcacactaccgcatgcatcctgacaggattcaccccaaacacctgcaagacaccgacatactcctccggcaccatcaagatttgcaaactagtacaagcgtgtatccatctcagggacagagaaagcaagcacaaccgttcatatcgatccccaacatgaatgcttctttgaatgagacaaaagaaacaccaatcaaacaagagagcaataaccatgcgaggtgatgtggatattgaaaaaaaaataaggaagagcaaagggagatggggactgatttgcgaggaggaaacgacggtgccaccacggcggagcacaagtgccggcaggatcgttgggaaccatgcggtggccgtgagcggccgcagccgccagggatcgccgcgaaggtccagcgcctcgcgcaggcggtggcgaggtcgtgacctcaccgggcaccagccgaacatgtggggccctaccgtttcttcctcctcgtcgaagctggagggaggtggaggcgtagaagctgcagaacggcatcgctgcgcggcgacctcttctcttccctccgattcgagcagaggagaagagagtggggagaggggcaaaatcgtctcatcaagctctgccccaacgaaaatgaaatcgaaaataaagaaaatggaaaagtggctatggttgtgcggtccatattggcattttaacaatcgcggtttcagaatagcattccagtgttttgagaatggctaaatatccattttctccctggagacagatcaaggaacaagaagagagacgtggcttaatcctatgcgtagaaaaagacacaacggttcagattaggtgaaaatccaactcccgtctttcccgaggcgggtgaggggggaaagagagaaaaaaaaaaaaaaggaaacctcaaattccccattcttcctcgtcttggggcacaactccgatttagggttagctcctcctcctcctcatcgctgattaggattcgattcgaccggatccctcgccgccttcgccatggatgatggtgatgagcccgtcccctacgtcatggatgagggtgtgctactacccttgctgtttccgccgccgctgccggccgacgacgacgccaccgccggcgtgagcccaagctgggtgtacctcgaagacagagcttacgtctcccccgatgccgtctccaactccaccaccgccttctccaccaccaccaccggcgtaagcatccatgtctccttctgcctcgcccgcccgccgcgcctctcctacctctgcgtccactgcccccgccccggcgacggcgagggcgcctaccggttcactgtcgatccccgagtcctcggcacgcacaccgatgtagccctcctccgcgtcccgcaccccaacgacgggctccaccgcggaatcaaatcctacgactacttcgtctacacggcccgcccaggcccgggcgcctccttgctccggctgctgccgaacccgcgggtctcccccttccgcaacgaggaggtcgccatcgtccgctgctccggcggcgcccgctacgtcatcgcctgcctcatgccaaccatcaggcgccccatggagttcaaggttatgcgcttcgactccgacgtcggccgctggaaatccacagctgtgtccatcagtgagccggtcgagagggacagggtgctccccatccctgacacggccagccagatggtcttccactgcaccaccaaggtcatcacgctcggcggcaccatcggctgggtggatctctggagagggatcctgctgtgtgacgacgtgcttgaccaacacctggtgctccgcgacgtgccactgcccaagccagcgagaagcaaccgcaaatccttctgcagagggccgccgcatcattaccgggacatcaccgttgtcgtgcaggactctgttcccacctgcatcaagtacgttgagatggtgacccgccccggtgatcggccacctcctcgacaacgacagccgccgcaacattctgatgactctgactctgatgaggaagaggacgttgcttactactggaaggctaacatatggagcatgccgataccagttggttcatgggaggattggcagatggagtgcacggtggatgtcactgacatcgccgtcgacaatgtcaggttcagtgagctgctgccaaagattggcaatgatccagaggagacattgaggaggctggtcacaggtttccccacattgggtatggatggggatgtcatttctttcctgtccaagatcaatcgcttggatgataagggatgggttatctctgttgatctgaggagtaagacgctgcaaggcgtggctgagcttgatgagaggaagaatttcctcttcaagcgctactacaacaccagtgagatctccaaatatcttatcaaggctacaggtttgttttataactgttgcaccataatagtcaaataatctaatggatagttcataaccttcttcattttgactactgtttacaagttgtcaggttagaaacttgattcatgagtgtgtttttcagagtgcactcctaggatttgtttttgaagtgccacttaaaccctctctgtgtatgttgtgtgtttgatgcaggtgaggcaggaactcttgtaaaaactggggttaatagtagagtctcaaaaaagaagaagtaggaattaattaatgaatcacgtaggctacctgggttgaagaaatgaaacgagctgcagagactgggcgattcatgagctactttctgtaatgagctattatcagagttgttctgtgcaagacatgctactttctgtaatggatttggttttcgtctgtttatcccaagttaaactgctatcttcccctgatgattggcctgaaatggatgctcaggaattttcttcggttattatactgtaataaaatgtcaagctggcgaccccatcgttagagttcgtgttttacctttcgttttgtaatgaactctcttgcttttgggttttcttcaaaagcaagatttcattcgaaatcagaattttttttcttcaaaaaatttcgttcgaaatatcagaatttgtccgaaatttcggaatttcggtgcccaccgaaattttcttgtttcccgaagggaaaaccctggctggaggactatccgtcggctggcgaggaacggcggcggagctccggctgctgtagggagggaggcacccgcgtgccggcgttggatttgattgggcctcaccgaaatttcggtccgaaattttgaacaaaatttagttgaatttgaacaaatactaccaaaattcatgaaaaaattcggtcgaagtaatatcgtaagaaattcggtccgaaatttcaccctgatcgcaattagcgagcgagataggcgggagctcggaatgcgtgtggggtgggcgcaatccaatccaaagaggcgttcgtcgatctccgatcggatcgtctccgtgattcgccatggatgatgatgagcccatccccttggatgacgatctcctcctgccattgctgttttcgcctccgctcccggccgacgacgatgatggcggcggcgtgagcccaaccccaagctgggtgtacctcgacgcgagtgcctacgtctcccccgacgccgtctccaacgccaccaccgccgtctccaccaccaccaccggcgtacgcatccacgtctccttctgcctcgcccgcccgccgcgcctctcctacctctgcgtccactgcccccgccccggcgccggccacggcgaggcctaccggttcaccgtcgatccccgagtcatcagcacgcacgccgacgtagccctcctcctcgtcccgcaccccaacgacgagctctaccgcggcatcagatcctacgactacttcgtctacacggccagcccccgcccgtcgctccggctgctgcccaacccgcacgcctcccccttcagcagcgacgcggtcgccatcgtccgctgctcgggcggcgcacgctacgtcatcgccggcctcatgcccaccatcaggtgccccatggagttcaagcttcagcgcttcgactccgacgtcggccgctggacctccacggcggtgtccgtcgacgagccggccgagagggacagggtgctccccatcccggacactgccaccgaggtgctcttccactacaccaccaaggtcatcacgctcgccggcggtgaccacgccatggccgtcggctgggtggatctctggaggggaatcctgctctgcgacgacgtgctcgacgaacaccccgtgctccgcgacctgccgctgcccaagccggcgaggaggaaccggaaatccttctgcagaggctacccacatggttaccgtgacatcaccgtcgtcgtgcaggactctgctccctcctgcatcaagtacgtcgagatggtgacacgccccggtgatccaccacctcggcggcgacgacggttgattgaacataattctgatgactcggattcttctgacggctcagacgaggatgttgcttactactggaaggccaacatatggagcaggccgataccggctggttcatggaaggattggcacagggagtgcacggtggatgtaaccgacatcgccgtcgtcgacaatgtcaggtacagtgagctgctgccaaagatctgcaatgatccagaggaaacattgaggaggttgctcacaggtcaccccacattgggcatggatggcaatgtcatctctttcctgtccaagatcggctacagtgatgataagagatgggttatttctgttgatctgagggataagacactgcaaggtgtgactgagcttgatcacaggaagaattccagcttcatgcgctactacattaccagtgagatctccaaatatctcatcaacgctacaggtaatttctagttgacctgtgttgatggggtattgctgtatttattatactcgagttaagttcaatagttcatgacttgttcatttggagaagggttcattttgactactgttagaagttgacatgttacaaactttgattcatgactcttgttttttttttttttgggggtggggggaggggagagagttcatccatgactgtttttcagggagcacccctaggattaacagtttcctctaggctttatgtaattagtagatgctgaccaaaagtaacctgaagtgaaacagtatttgaaaagcatacgaacggtattttttttctaggtaaaaagataattctattactgtcagaatgtactagtttctgtttaatgatccggtactgtatgggcttgtttagatcccctcgtaaaatttttcaccttgtcatatcgaatgtttagacacataaaattactaattacacagattgtgtgtaaatcgtgagacgaatattttaaacctaattgcttcatgatttaacaatgtggtgctacagtaaacatttgctaatggcagattgattaggcttaataaattcatctacttttaatactttaaatatgtatccgtatattcgatatgtcacgctaaaactttacacctatggatctaaacaccccctatgttgccctagttattagggagcaagaaaaggtgtaaccctttctgttgtgtgtttgatgtaggtgagacaggaactctggtaagaactggcgccatggagtctaataagaaaagaaaaaagaagaagaaatcacgtaggctgccagggggaaagagatgaaacaagctgcagagattgggcgattcacgagccgcttaatttttttttatcagtgatattctgctggatgatttacctgcctaatggctaatatgttatgttcaagacctgctactttctgtaatggatttggtttttacatatcaatcctaagggagtgtttggaaactaggaactaaatttagtgcctctcacaaaagtacaaatccctatggtagggacttatgtttttgtgagagggactaaagtttagccccactttagtccccccaaccaaataccacctgagtcatttcttccttttatgtttcctacttccttggtaagacgaaggaagcagcatgtctatattagtccatgtatatgtatgcatacaaatgcctctgccgttaagggccagctcgttattattagatgataagtacaagaataataattttggtcacacaatgcaagcaaacgtagtctcgttttgtaatgtagcagacagagccatctgtaacatagcagacagcatgatgcaagtcaagaaagagatggagatatacaactattataaccggctcagcttcatttcatttcattccatggctactaaactacatcatcatgacatgagatcgccatcacatctccagttggatggagcgctacttaacagtcaacagagaacaagattaaatgtgtttgccctttacagaaaataccaacatacaagaacgattactcctacccacatttcccacaatgtccatgacaacacaagtcagtcccagacggtcgtgataacttctttgaaggatggcaggaatggcgacgaagaaatgggtgtcaaaaccaggccaatgggctccagaatcagcagcgggtagagaggtcaatcaagattcaagggtgctaaggaatgtacaccgcaatgccaagaataacaatccctcttttctttttcacatatggcttggccgtcttttgccactatcagtcctcgatctcttggtaggtttagcccactggatgtctccaatgccgggtgatgaactccccccacgatcagattgctgcacagaatgagcaccccatccagctgaatgcatagactgctgagaagggtgtggatctctttggaagggcgtcctggcacctctaggtgatggcgccggtcccatccgcccggcgttggtcggggagagcggtccagttcggcctgaactggatggagaccccaggctcggccttcgatctctcttcttcttaactatgaacatatctgtagggtgcctgaacagccctgcgctatccgtgaactgttccctgctacctggtccagaatgccgggagtccttctcagattttgaagtgtgggcccggcctgaaacctcaccaactggtgcatgctgattgtgtctgctagtgcttgaaccatgctgctccgcttcactggtgcttgaacgacgtttctggcctgaagcagattgctttgttgattgcgcagcagagccacttgcacctcctccaggattcgaaaatgacatagcacccttagcttctctgaagtctgagtccggaaaggcaatcttcattatattgaaaaataagttgtggagggtctcagcttctactcggacctgcattttgtaggagcaaattcacgagtacaccagtcagactatcagaagttagagaagtatgaattcacagaattagagtctgtgcaagtatgtcgtggtatcttattctattaagtcaacatggttttcttcaggaatacagaaagctacgcagttcttctgaattttaaatagtaatcagtaccaagtagagagagaatgtcaacaaacttgatggcgaccatggacccatggtgtcagcattggaatgacccccatgatacttcaatttatacaaattaaggacaaaaaaggaagcttttctagtactatgaaattacctcatgcctatagctgaaatgttgaaccacacttttcagcatctgctgcatgtcagctatgaattcattcacaccgccatactcaaatccatcaactcgttgttcaattttctgtagatcaagggtgctgctagccaaacctttgaatgaggaattctcgttcctacgccaccaagaagatatatttggtatgatttgatgaccctctttgtcaatcctcctccaaagcttgtttatcacgttcttgcactgcaggtattgaatgagaaacgcttagctataaagagctgttaaaaaggcaaacaatacgagccaaaccatttgcgaaaggaattacaacaaaattgagacaacctcaacattaagataagctgtagtaataaatgatatccaaaaactacactagtaatcagtgtaagcaaaagcagtcaaaaaaaaaagaaggcaaacaatatgagccaaaccaaatggcaaaaggaatctacaacaaaatcaacacaacggataagctgtagtaataaatgatatccaaaaactacactagtaatcagtataagcaaaaacaggcaatagtcatgaaatagtccacaccacttcacgtgcaccccacaaccactgcacgggacttacgttgttatgattgtagaacaatgtgaaaacaccacatgaaataagcggcgtcatacttggctcttttgctaatgcaagcagatagcagtcgagatttacctagcaatgcagtatatttggtagacctcaactatcccggtatgtaggcaacatttaacttccatatttatgttatcaagttgagttaacagtccgaataaatattttacaagattttaggcaagtattatacttctatagaaaactgcagatccatttatgtttccaaggtaaaaagaacattgcttccttgatatattgctcatctgttctagttttccatgctcggcaacgtttaacgagcagggaccaagccatgtgtggtggcagtttttagctagcgtttgtctattgcatactaaaatggtctattcctacatttggaaggatcatggctctgctattttgaaggcggaaccatctttcttaagatgatgcttacacgacagagtatactaaattctacaaagtattccttgccgaagttcaatatccaatatccttttaagttttaaaagacgaggcaatgagtagctctaacagagtaaaccagctgaaacatacaaagaactaggttttgtatgctacctttctttgcatactgtcagacatctttgttccacttgaatttggaccagcagattctatcaccttgttactccaattttccttagaatgttcagcagatccctcaccagatccagacagctgagtcattttcccagccttagtggcagggggagcctttctagatggcatgttacgcttttgttttactgtccgatgaactgtgtcttgctgcctggaagcaggatcagcaaaggcttgctcagacttaaattgtgaatcataatcaccatctccttgaaatgcaagatgaacaccacgttgagggacggtcccatcaccggatctatcatccagtttttctgcattaggtcttggacgaatacggatactccgcttgcgctttatttttggctgtactacctgttcatcctcaccatcatctcgttcatgattccagctgcctgactgctggagatccagatgtgaatcccctgataatgcaatttctccttcctctaggtcatctgcctgtaaaccgtccattaaaaaaatgagcagttaatttcaacacgtagaaaatcaaattaaaacaggaaaaggagaagcaaataagttcagaagtaaaggaaaagaataggcaaatatggtgtgtttcagacatacagttctctttgacaaagcacccgggcgggaatctaatgcagacaaagaccgcaatttttttgaagaggaggaaggtgcaggtggtggcaatctacggccaccagatgaagatcctgttgaaccagcttcttcagatctatgggcttttctgcgtcccatcccatgtgaaaaatcatacccttcatcattgataggctcttcttcctctgattgatccttattatcaggcactgaatcatcattgtcctcttcatcttcaaattctcctatttccccttcttcaggcagagatgaggtattcctctcttcagaatcatcatcagattcctcaaaatcgtcatcatcaatctccctgtagatggagtacttcccagaccccttaggtcgcccccttcgtttctcaagtttttcattagtgtcaagagaaattcccccagccgccatatttctcaagggctttttggataaactcgcaacaacagcatcaagctccgtggagctaacacggagccacttgggagcttgattgtgtttcatcatatctcctgtccaatcaaattcttcatccatctgatcaaatagctcaacttcttcttcagtccgagcaatcatgcggttaacttgctgtagtgaaggaacgtcatgaacagtttcttgatatctctcttcatcatgcaggagtgtttccaaagtcatccgcctttcctcatgggttgttctttgatcaaatcgaccagcattaatgacttcatctgccatgtcaattttgtactgttggatattattgcggatgagactttctattgaacccatgtacctgtcctttcccgcaagatcatcctccagatctccacttcccccattcctcaactcatcctctttctgataacttgagatgttatcaacaacagcctccatgtaaataacttttacatccctagtctgccctatacgatgggccctagcaactgcttgctcttcattttgtggattcggatcagggtcataaattacaacagtgtctgcactctgaagattcagacccctgccagcagcccgaatactaagcaagaatataaaacaatcagaattaggcctgttgaagtcaacaattgctgattcacgatcttccaagctagttgttccatcaattcttctgtaaacaagttgcctccattgcaaatattcttccaggatgtcaagaagttttgtcatagtgctgaaaaggagtacacggtgacctgacctatgaagcttaattaaaatcctatcaagattccacaacttcccacaagatctgattataaaatcttttccatagtaattcataaaaggatatgacagcaatggatggttgcaaactttcctcagctccatgcatttgttattgagattcttatatgtcttagcctggtacattgcattcctctgaatacgtgctttctcatcttcaggatcaaccctgatggtgccagtggattttatccaatcatatatagcaccttgaataccagacattctgcacctcaaaacaattgactcctgcaaatgacatgacgagttaacaatgtagcaaacaaaaagagctgagtgacaaatagcatcactgagtgtgacaagggcagaacaatcgacctttcttggaagtgagccttcaacatcttcaacacgccttcgtagcataaaaggttccaaaatttgatgcagcctatgaataataattacttttttctcagtttccagccaatcatcttcttcttcactatgtgtaggaacatctctctgaaaaggttttgagaaccaatcttgaaatgccttacggttgtcaaatacttctggtagcaacaaatttaggagggaccaaagctccttaagatcattctgaaagaattgaataaaaagcattaaataatagccctaaagtgttatagaaataaaacaacatttgctgatgtggtcctaacaatattggcagaccagagaaaaggaacttccgtgacacaggaaaagaaaaggggattgtgttacaatgtagaacgattgtgttacatttattattaatgcttacctgtagaggagtgccagtgagaagcaaacgccgttggcaacgataacgatcaagatctcgcgccaagactgactctctgtccttcatccgttgggcctcatcaataataatgtacttccaatcaattcttgaaagcttggaacggtcatacataacaaattcatatgttgttacaagaacattgaatttcacagccagaacctcctgcaagattaatcaaaaagaatattgaagcaaaatccgtgagcaggtggttccaaatcagataatgcattagtaagcgggtgattccgaagtcagagaatacatgatttacgagtgttatccttccagaatatggatcaaacaatataactaggaccaccaagtatttaagaaacatttgtgataacaatactgttaatcaaacagtgatctaggagggaaaggtattgtgaatcttttcaattctataaatgctaagcagtattataagtccagatatagcataaaataggctataaaacggaagaaacttgcctgagagaataatttttgacgttgatcctttgcaccaacataaaagatgcaagatgcagatggcaaccagttcagcaattcactctaaatcaataatagaaatccaagtaaaaaattatgtttcaaaataaatatccccatcataaaatagatacaaacagtatttcctcagagtaaaggacaggaaaatagaaccttccagttgaccaagacagcattcggtacaattatgagatgtggtccataattccctttaaattccatcaagtatgcaatcagagacataacctatttattcaattggtggccacaaaaagatgttactagcagggcaaaaggaaatggggaggcaaatgagataataaaagaaaatattgtgaaatagcaaaagtctagcaggtagaacggaataagaaatccacacctgtacggtcttgccaagacccatctcatcagccaaaataccattcaacttattattgtacaaggaaagcatccattgaaggcccacctgtggataggcaacaaatcaaattgtagattttttttggtggttggaaatagacttgaaatgttttaaatatatattatatcatataagaaaattaagttgaaggtaaatggcctaccagctggtagtcccttaacgttcctgctcgcagcagtgagggctgccttgtaactctctcattcacagcatgagccaatgtgtagtacctaaaataatacggcaagtgtaagcttatttatgctgaaaactagtgtgcactaaatgcccatattgatctacagttagcagctccaaattagagagtgaagcaaatttactcacaggagtcaaaagcacatataaactttacttgtagtgaatcagaaacataaattgtcaaaatgaatattgaaaataagataattacttacttattaacagatgtgttttccctgggcgcattcatttcagagaatgtgttccttatcataacctcctgaccagcacattgtgcagcagccttcacttcttcttcagaaagaccctattaaacaagtggtatgctcaattatctacaggactatgaaacttggggaatgaatgcatcagtgcagctaaaagttatggaccagtagtgtataagtgcaatgatgaatgagggtacagataaacacaaggcaagaagtgtattggccagtgtactgtctgtacccccaacctcgaaattaaaaagtttgtgctaacatttatcgtttgcgtcacaacccataaataagaaacaaaagagggatggggaaaaggccgttatcattttccagagcaaagaatgtcatactcatacctgtgctcgggcagcagcagcagcagcatttgccgcctcttcaacttgctgatgattcttggcagcagttattttccctccaagtttatagagatactcctcagtctgggtcaagaaagaagatagaacattgtatctttgagctgcatcgccaggaacactggtttgttgttccaataatatttgacgatatctttccacgtcattgtttttcagtgcctccattcttttgtttcgatcatcatcctttttctttgagaattccctcagcatcctttcatggtacttggctacccctcggttacgagtaatccgtgcatcacgaatggcccagtgtgcctccaaaagcttcttgcgccactggaaaatggatttgagctgcttttctcttgaggctttctgcatctgctgaacttgccttgtaagctcaacacgctggcgttcacattgtctgacaaactttctgtacaccctatcaggcattgccattatttcttgttgctcctgttcaacttcatccctcatacgagcctgaaattcaaggagtttcagcttcttttcttcaatctgcagccttaaaacaagatctggttggatccttttcctctctagattaattgcaagcaagccactgatcttttttaaattatcctcccgtttcttgccaagaactatcatgccttcctgagctaacaaatccttcacgtcataaccgagtgctagattactgttgtaatttgcagacaccatggaatcatgtttcctggtaaaggatggaaagtcaaatagtggcccatggtattttcttgaaacatctctgttgggagtaggcacgctacttgatgaggcagctctttttgcctgctcagcgtctgctgaaccactttctgctggcaaagatttccccctttcaccattgtaatcacttctcccaggtgttctctggatacccctttctggatcctgctcagatttaatcagggtggtgttggtttgttcaggcattgaaactggtccaattctaagaggttccttgggtgaagctttcatcacttgcatgggaccactagcaggaatagttttgtcttctggagcagaaacctccacctttggtaaacagggcgccttcaacagggaagatctttcaggagctataccaccactctccacaggtcttccatgttcatcagcgctgcttgtagcagatctttcacggtttgttactggaggtccagaaacctgctgcgcttgtgaatcaggtggtggtccagacatgattaaatcaagaacttctggtggtagcttcttatcaccacgctgagatcaaccaatgaaaaacagaaggagatttacagtattgggattagtcagcttgaatcataacttaaaattgtggactggaactcatttaaaaaaaaaaagcaaagacacgaccaaattttaacattcctgtaccttcagacgccgaaaagctaatatctgagctttaagtacatgaagctgatgtttggtgaaacccataggtggtcgggcagcttgatttggggcctgtgatcctcctgtttcaccagaatttgctgaaggggcagtagctcggttagcctgctgcaactgtcttgcatattgcatctgcattgcttcggaatttgcattttttggattgggctgctcaggaatcttgtttgcatgtccagaactttggggcatatgcatcatttgtccaccattgcccattgacatggctggcctcgcagccctgtcattcgagctatctctgttatgagctgctaactgttgttgcatctgcatgttgctcatattcatcatcttaggctctgccccaccagaaacagaggtgcttggtggaagaggctgtcggggcttcgatggggcaccctgactaggaaaattactatgtcctggtgcatcattgttcatctgtgagggtacagactgctgctgtgacgccatgcctacctcattctgcttctgcatggcagccattctgtttgactgcaacattggtaggatttgagaaatgagagtcacatttgcaggattggacaggtcaacattgtgctctttggcccaggcctggatagcttgaagttgggccattgccatcgggttagctccagcattgctcatgccagcttgcccttgcattggctgcatcggcctcaccatacccgccgatgacaactgctgcccagggaccccttgtggtggcatcgaaggtggcctcatatcaccactcctttgctcgctattgctcggctgcccttgctccgcctgcttctctgcctgttgaagatgctcagattgttgtctcttgaacatctgggcctgggcctgagcctgaagggacataagctcctgcatttttgcagtgttggcagccacatcctggtcccttgtagatggccctgccatattcatcttggcctgctgttgctgctggaggagcatcccatgggccttctgctgctgctgctgcatcatgtactgcaggtatgcttgctgcatcgccgtcgggttatgctgctggcctccagccagaccctgcggtccaccgggtagcggcatgttcctctggccctggaacgggggcattgggcctgaggacggagggaaactactgctgccaccacctcccatcataccatgcggcgcgcccgatgggtacccttgctgctgctgctgctgctgatcatggtgatgcatcattgcctgcaacaacacaagccaacccgtttagaccaaccacgcaattggagcattccatcaacacaccaaaccaaacccatacaaacagagagacagaacgaaaccaaaatgccccccaaaacctcaacccaaatcagacacacagacggttccaaacccaaaattacacggaaattagaaccatccggacaagcatcagaaacagggcaggcaaaaatcacatgaggcaaggcaaagccaccacctcgcagtccagtgagtgggagaggacgaagctcgcggtttactgtttagggaagggcgcgtaaaaaagcgccgccttttcgccacacgcgtcaggattttttcccaaatcccaacggccacaacccacggttccccaccaatcacgtcgcgcgcaggccgcagtagagaaaacctcaaacccccaaaccacacaaaaaaaattcgaatcccaacgccatggtggggcagaccagagagagcccagactcacctgattcctaaaccctagctgctgctgcccctgcgccaccgccggcggcggccgcggcgacgtcgccggcgagcccccggaggaggggggtgcctcgccgggctgcatgtccgcgaagagctccctagatctggccgattcggggctccctcatgcgagatctaggtcgatcgggtgccccccaccgacgcgcggcggcccgtgggatcgccgccggagacgctcgcggttgaggcgggggcggtgagagtgtcaaaccctaaccaccaccacctcggttggtttcgcggcgcggattttcctctccgatttttccgtcggattcgtcgcgtttttttttaagagagagagaaggagacaggaggaggttggagtgtgaggaagaatggtaaatttgaaagaggaggtgggcttttaagctaaaaacgggtagggatatttttttcgtttaggccccttatattaatgatatttgcatgatatgagtgtactaactcgggtttgtgtatcaacaggaaaggaatatatccatgtttggttaaaattaaatcaaggctatagaattgtaatccccaaattggaatatatcctgtttggttaaaattaaatcaaggctgtaaaattgtgattcccaaatctccatttcaagctggaatttaaccattttccattattaactttcgatcgaagatatggtttggtaggaagcaagaacatattgaacagatcggaacattttctctagataacaaaagcacacttccgacctctgcatcgtgatatattggaatatctaaccatgggctttgaagaaaaaaattctagaacaattgagtaatatcaaccgtatttgattagcaaaaataggacgtggtcatgaaacaaatttagaaaatagaagaacagactgtagattggcaaggaatatggcaatttgtcacacacatggttaactgtggatatgtcatactagcatcaatttctcattgctgttgatgatgctacaactaccaggactgatactggcgaagactcacatagagcaagcaattaaggagcacaaacatgcccatactgaaactgatctctctatctctactctagatcactcggtcgtttcaaaaaaatttggatgtagctggaacttgatccagtgtttgtcgcatttggaactttgatccggtgattaacggaaattgtcgcatttggaagttggaggttaagtacctgtcacacttgtctctgtctgaaattctgaaatggagtatcttgacccccaatgaccggtataatccgattcctaatttcgcacttgtattttctgcaaggagagaatcacggaaatctacagtagcgtttagctgccacagaaaacaacagcaagcagcagagtgatgaatgcgtgcagttatttttgtcagctgtagtagctgtctcttcatcctcgggatcagaaatgcagttactggagtactcctattttgtcagtattccttttttgtgattaatgacatattgcctgaaagtcagtgcagaaacaagttcgttcccttgatgtttttctgtgaccggatgaaaaagaacgaactttgggatcggctacttcaaacctgactgaaaactcgatctgatttgatggacttaatctgaaaaaccacctcaaacaaaacctccaaatttctcagttgtgtcatgtttgaaatactactggactcagcgttttgtttatggttatgcttattcgtacgtcttattagtaattaaaaagtaatttgtaggtatttttttacatacgtgtccttagcaatttaaaagcaaatactagtataaaatgaactatgagaaaaaaaacataaaaccaaaccccgaaattaattttaaaatacaaatttttacttataagtgtaagcataagtttgaaaatgataggatcatagtacctttttattgcatgatagctggagaacaaatagctcaagaaatgtgtcttggctcttgacaaacgactagatacaaactcaagtgctattgtatctgaatctgtatgcctaatttgttgtatttgttcagaacatcataagagaacatagctgggttattaaggtttacttcagaaagaaagaaaaaggttacagatgccaaaggattgaaattgccctgctagcaagcaagaagctacttaattaggacacatcactgaattaatcacatgatgaccatcctagctatagcttcctccctccctcggtcgccgtcgtcgatcgccggatgccagccagcacgccggagctcgccgccgacctcctgtcgccgccgccgccgctcgccgttcgcagcatgcatcacctctcgatctccgacgacgcatgaggaatcagcagtacacaccccctgatggaagaagctacattgcaatcagctgcatgctctctctgaatctgatctgaatttacttctcagctccattctgcagcattagcagccatggcatgatgaatttatagagaaagaaaggattgtggcgaggcggctcgacccagggggataaactcgaggaatgaaacggtggcgaggcagcagctatagctgccactggcatcttccatggatatcctcaccacaaatgcttcacagttcactccactcgactcctttttttattaacatcagaaaaatgatttgcttttccccccatgctctcctgctcctctctctcgatcgtgctttatttttagtggaacaccattggttagctagtgcttctccttttttgaaaaaaaaagatatatgaatataagtaccttgtgccttttctgcttttgtttaatatattctctgatacacttcaaaaatatatatattctctgatttgtgtggatgcatggggtttatcttttgttgctccaacctgattatgtattattcagtttcgtcagacatggttgctatatgtgttagtactatttctcttcctgtagttcaggtgtatctgaattaattttgaaagtaagtgtgtcaagaattgcctagttgcaagttccaagatatattatacatacacactccacagagaactttccggatatatggtaattaaaaaaaaagagtggaagagatatgcttggacattcgatttggaggaacagttgagctacatctgtcagtcggtgctctgttgcatcaatattgctctaagctgggctcttttggaacgtatatatcttatgttattttcatagaaattagttaaattcccatgcataaaagttttccaaaaattcttaagtcccaatgatgcctatgttaagggtaccgtacaaaaaagttaggatggctataagaagctagccatcaatgtgttgtaattaagatagaaaagccaaatatttccaactcttcattcaatccaagcagaaggtgagagatttagtagtcgaacttagaatgcatctttcacaactggaaatagaaagtttaaagggggagttcttttgtattcgaagggggagataacgttgttatagtccaacaagttgtacctgtaggtaccaaaacagatctagccgtccatttccgaaggggtagtatagggaaaaagaatgtgtagagcttgtgtgccgaggcgcgggagggcacgcaattccctttcgtgctcatacacagctccctcgtccgcctcaccgcacatcgtcggagccgatgccttaccgcccctggcctacttctccaccgcgtctggcggcgtgggagaggaacaagggaacgacagtgacgcgggagaggaacaattccagcggcgccgcggtagaggacagcggcggtgggagaggcaaagctcattctagggtttatgttcagtcttgcattggcacgcaaaattacattactgcccttccacctacaatcatcacacggtaccacatcagggacaaaactggtaccccgcgataccaatctctgtggccatgtggccattggagatttgtccggatccaacagtcaagattcgataccgcaaggtaccgttggactgtaaaaatcctctggacaaactgttgtatagcacagtaatagcacaacgactttgattcttttaacatactgcaggttgttgcaacttgcaagtacttgaacagggaaattaagttgatttaattgattaatgaatcatacataattagcctaaccacatgtagtgccagcatgcatctgcatcaacaaaaaaaaaaaaatggttggtcggtcacacattctctgaggccaccgtcgacgccggcaggagtggttgcttcaggcaagaatcagcagcagcagcagaagctggttgctgctggtggtcagcaatggcggcagcagcagaagcttcttttgcagcagcaatggctctctcctggctcttcccccacagcaccaggtacagccctgccactatcagcaccgccccaatgatcctgcatgaacagattaaccatccaattagcactaatcatttactagttcttggatcctggatttttttatttattttttagactttttaatttttttaaattctattaatagatcttttttaaaaaaattccgaaaactaaacctcttaaccaggcgtggcagcgttattttgccacgccaaactgacatggcaggacaacgctgccacgctagctgtacttggcgtgacaaatttatttgggcggcgtagtcgaaaagtttagatttggaatttttttagaaaggtctattaataaaattaaaaaaataaaaagtctaaaaaaataaaaaaaatcttaatcaagagagattaatcggtataccctccgaggtggaattgctcgccgaggaggagggaagccatgacggcgacgaggagggtttgcacgggctggtagacggccacgaacacggggccgccgcggtggatgcaccacgtctgcacggcgaaggcgacgcccgaggcgacgaatccggcgtagaggatggtgaagagctcggagccggagcggacggcccaggcggcggcgtcgcgctccaggaacgcggcgatggcgaggaactggatgaggccgaagaagcaggtgtatgacgtcaccgacagcctcgccgggtagcgcttcagcaccggcgcctgcagcaccagccaccccgaccacgacacgcagtgccccagcaggaacacgcaccccagcgtccagctcttgttgccggcggcgacggcgacggcgagctgttgcggttgcggctggtggttgtggtgggtgttgaagatggcggggcccttgaagagcgtgatgacggaggcgccggcgacgcagagcagcgtgccggcgaccttggcgaggccgtcgcgggaggagaggcggacgcgctcgatgcggagcgcggcggccatggcgaaggtgatggccgggacggagttctggatggcggaggcgaacgtcggcgaggtgttctcgagccccagcaggtagaagccctggttggcggtgatcccgcacagcgccaggaagaagaactgcaccgccaagctcgccgtcatggccggcctctccttcctgcaagcatccatgattgattgattgattaactagttcatcattcgtatcaggaattcaggattagcggcattaggcatcgattaattacttctcgaggaagtaggcgaagggggcgaggaggaagagggcgatgaggttgcggtagacggggaagacgagcttgctgacgcccatgtccagcgccagccgcgacaccacgtggaacccggcgtacccgagctgcagcgccagcatcgccacgtgcagccgcgcgccgccgccggacgccgccgccttcctcccgcccgccgccgcgtcccccatgattgtcgtagctgggctagctagctcgtcgagctacgagaggagagctgagctgaagcagtgagactgagactgagactgtgagtgagttctgctgcacatggcgggcagcattggctgctgaatttatagcggcgattggatcggaaaaagacaggtggtgagctgtgcttctgctgctgctgctgctgcaaatggagttgagctcgtgtacttttctgtcgtcttcttgtctctctagctgctggagttggagatcacaacctgatcatcagtacagtacaatactgtacctgacccagctttgctgtctaccgtctaccacagctcaaaagtctgaaaaacctcttgaatttcgaaacttaataattgtatagttaattttgggggtcctttttagtggtctacttttaacattggcttttaaaatcataaataatccggatataaaagttttatccataaattatttttccgttgcttcgttcatatttttacgctttatcagaatagagctaagagactgaactctctgaatctgctaagctaggctaagtcatctcagctcagtaaactgcctgcaattttgtgccatctccacatacagaaactgatactccgatctttcaggttcaagtagagtccatgttcatgaatcatgactgaaatctcaccaaacaggatgcttttaagggtactgatcaaggtgagctttagttgcccctgttcatcataagagtggttgaatgaaccatggggacaaacacagtgagaagagaacactgccaaggagtacagagcatcaaacatggtgtcaactcatcttcctcaaggacagacatcacaggtacagcatctctcttttttaagacctgcacctacatggatttttgcaggattatcctcctaattacctctgccatcttgtatatagtactagcttgaggtaaatccattgtaaaattgcatttgaaggtaaatataaatttactcaatctatgtttctatatttaaatgcaatgacatgctctgcatattatggaaactgaaacaaacaaacaaatcagagatcaagcacaaacatatgcaaacacagaatatcagtagtaacccagattgagtactatccttcaacattttgtgctcattccacatgtgcaccatggtccatggggacaccctgcaggcttccatggagacaggacagcaatccactgcataaacagcttcctcactcaccatccattactgaattctgaccagtaaagtatctcaatccttggtggttacatatactgttatacacgcatagcatgtctgtctgctgcctttgccttcacactgatgtttcttgtgccctgccattgcaatgcatgaccctgacagccaccatctcatctgtcatgctgatgctaatctggtcattctatgttctgtctgaaatggttagcctgtcaaggtggttatgccatgtaggtcactttagctacatatacctttatgtcaatcaaattatgtgtgctttcttggtgtaattaattggattcatgtttcagttgtaccaagctggttgcttgcacccttagcttcatagatctaggaaagtttaaactacagtataggtacatacgcaacaattgatctagctttcatattttgtctctcttggcataacatttggcaaccttttctgtcttgcatctgtaactacctagctggagatgcaggatatgcatttatttaaccttgtggtcacaacacacaactcctcacatcactaaattacacacttagggacacctttatgcagggaaaacatgctgtgacacctcaaaagcttcaggaaaaaaaaacccaatcttttcattcatgtgatgactcaattaggttagtcttgcattgcttgttgttggctggtgaatgtgatctgtagttcctgaagatctgtaacatatccctttaaaatatatctgaacttgcgagtaggagaaggacaccgtgtttgcaaacggcagggcaaatctaaggaccactccttttaatttctgatgatgaaaattatgcatctcaacattgatcagcactttttttttggggggaaaaagtgatttgctttttgtgcatgtgacgctagtcaagaagcgtgcggattgaacagctatttgtgcgtgtaagtcccagaaaatgtcacattattctcttttaatataagaaaattgcatgcatgggatgattaacagcagacaggcctttgaaacatttcccctccatgtatttgatttttcatttgcagtgtacatgagtggaactttagttacatcgcggttccaacgttattttcagaattatgcattcagttgatacattgggaaaaagaaagagggtaaaaaaggaaacatgaagcttcaggcactccgtgaaacggcaactcaaactacctattagactatttcagttgtatttttatcacatcgcagcatacatcggttgctcaggaagctcggcaagccattcctccttgagtttcccttgagtaaatctcctcagcatttccagggaagctttgggttggtccattggaaccatgtgaccagcattgtggacctgcattagcatagaagcaacgatttattgtcgattatttagtaaggtttcttgatccataggtgcacgaggattctaatataattccttgtaaacattagataagcagaattaaccaggttgagtggtcctttcatgccagaatatggttatggttagtctatattagaccatctggtcacattcttctggcaagtacactaatatttgtttcttagtggtaacaacactgccataaaccagatgtttcgtactttcgtgatgaccacaaattttccatccacgccataaaaatatatagcgcattctaagtttgcaccaaattagtttttttttaaaaaaaatatggagaataaatcataagaaaattaattaggtaaaagtgtttgataaaaaccttgaggaagctgagtggcccgtggctcttcaaaacaccagcttcggcaccatctactacaaatggcgattcatgagatgatacaaagtctttctggccagaccattccatcgagtggacccacctcgagtttcctacatacatagaaaaggttacacttgatacaataactgcacaatcattaaagattttggcaatggacatgcaagacaatgtcacaaatctatcaaatagaagtgctataaagtttgagatgttagatcaattaggattttataaagctccctcttatatattgtcccaaggtgatccagtagtagcaaaccaacccaaaacaagtcaacaacaaaacttgtctggagtagcagtaatctaactggtagcaaacagcacagtaaaatgcataccaaacgtgctaactatagttatggaaatctagatgccataccaaacgtgctaactatagtaatggaaacacaaacaagaacagattggcatgtagcctgcctctgttactagtacccatttaaacgtcgattgatttaactgtggaatttactacactccagtggtaccagctctacagctatgcaactgtaatttactgttagtaatggtcatgcacctgtaactaaagagtaattttacagtccttgagaggtacgtttttagtggaaattttgataccttctagtaccaaaggtatcgagaaataccaaattttacaatagaaaatatggtacctccctgtacctccttaaggattgtaaaatcactcttaactaaactatagcatcagcagaaatttaacgttttgtatcctattaacaaattgcagggctatgcgttattattttccatgcaaggcattgcagtagttacaattgtcggtggaacaaaaggtgcaaaactgacttgaaaaagcattaaccaaatgtatccttaccaagccaattgcatataagatcatactctccagcatatataagcacattgatcccatcctcaagtagagctgggatgccaacttccaagtttctcatccagtctgtcagcattgcttgataaacagtagtgctgcatgagacaaattcaaggtcgccaactccaattgcttctttgactgctttatctccaaaaaacttctccaagtttgagaaatcatagcaaagtttcccttcgcattccttcctaacgtcatagtactgtaaagaagaattaatatgtaacggttttcagccttagtgaaccaatgttatgcagtcagttaagcaagtgaccattgcttacattctttgtcccaacaagcttcatgatggagctgaaaatagaattgcagaccatgtatgctgccatgcaagatgctttcccattggtacctgaaaaatcagtaggtgtgagtaacagttctcattatttgaagaaaccttagggtgttattacaaatgcactatctcatagctgaaatatagagaactgtaatgaaccccatttataccctaaatggtttttcaaccttttctgccagcattaatcattcaggaagttcaatgcagttagatatatgtggtttgctcaaaggtagaatatggtactgaccacaaagctttattgcaaattcacatggtgggatgaacttgttgatcctgtcgtaatctgattttttaataaggttcatgtccaatgcataatcggtgtaagctttgtactggattgctggatccgtgaggccattaccgatcgcaaaaccctacaagaaaaataggtaaaactgtgtaaaatagcaaagaagcaattaagttaaaagatatggcaaacttgggtaaggatcataccttcaagtttatgtgaatgccctcgtttgctttgtttccttggtgaacccggcttgcgaatgctggaatgtagtgcccagcataagattctccggttataaagaagtcattctttgcaaactctggatgcttcttaaagaacacctgacatgggaatcaagcaaatactacatattactctacatttttgctgaagtcaacaacacaaaataatcaactctcagatcaatacacaactctttagagagatccgtgcatattatctggtttggtgctaaatcttcggaagttatctactaccgctaatttaatgaagctatccagtcaaatatgttaggtacatcctttcatgtaagcaatgccaaattccaacctggaaatttcctatggtattgtagcaattaattttacaggagcatcatatcaggtaagagaaccactccacaaattgaggatgaaagcaataattaggcacaccagactgttgactgttagttacttagtcaagtagagtatgcaaataattattttgtgaaatggaactattattaagagcagagcctgcagttttaaaacaaacatattgctatgattactttacattggagatcatttatgtttctttattagtatttagtattgtaaaggaatggattgaacaagcctatatagtgtaatcagatatcacatggaattgatgaaacaaagagaaaaaggcaagcacgtcagttacaagggttgagagtagtacctgaagaaagctatataggtcattgctgacgcctgtctcatcatgacgagtatcacgatcatcagagctatagctaaatccagttccagtgggttgatcaacaaaaattatatttgaaatctgcatgaagaaagttttatcagaaggggtggatacaaaggaaccaaaaggtgtgtaggcttgatcattgtaagatgtgaactgactgcagcaatgaccactgccattgttaaactcatcatgaaactagttggaaaggtctaaaaaatcatagtaggaattaatgttcaccaataacgaacaatactatgtagggaaacattgtcctcaataaactcgtaaacttctgctgtcgtgcatcagttcatgtaaaaagcaataaaacttaacaaagactattgtggtggcataagagatgatagtcaaatggaacacatatggtaagttggtaacaacctaacagatagcaacaatgaagttctagccccagatggttttcttcaactaataagacactaaaaggcaaagtgaggaacacaatatagtaagttggtaacagttatccaaatttggtaacggaggatagcaaggatgatattctagacaataattttttcccccttcaacagttactgacttcaaccgggagaaactctgaaacggacattattttcactattgcttgcttaaccaagctagtcattcagtcaacaatggtcaaaatagttttttcatgttgctctcaccacaagattgcttgcaagcgatgatgcaacattaacaagttaatattatgaccaagtctgagtcgttaccatactaaggaaactaaacatatgatgcaatcaataacgtattatcgaatcgatggatcgttaccgtgtcccagccgaatttgttccaagcaagcgacatgttgttcgagatggtgaacgggccattctcgtagaagacggccagctcgctgctgcatccggggcctccggtgagccagatcacgacgggatcctccttcttccccctcgattcgaacaagaagtagaacatcctgcaagcaacgccccaatccatccaacaaacaaacactcaacccaaaatttccaaaagaaaaaaaaaagagagagcaagaactttgtactactttacaactaatttggggttcgaaattcgaaatctacctcgcgtcgtgcgtgttggggaggcggtagtagccggcgtggtggccgaggtcgccgaccccctgggggagcccgggcagcgtgacccgccgctcaagcagctcgccgggcgccacgctggggacatccccggcgccggttggcccggcctccttgggcagcaggttgagcgagcggatgagccgctcggcctgcgccgcggggaacttggcgtcgcggggcagccggagcccctccgcgcaggcggaggcggcgaggacgacgacgaggaggatgagggagacgcgcgcggtcgccattggaggagtttggagattcggagaggttttccctccgaatttatagcgttcgcggttttggtgtttgaaacggactggtttattagttttagtttttttttttaaacgaactttgcttccaatgcaatccaagcacagccggattccttttcttttttttttctgtttttggtttctttttgccttttcgagctcgaatacgaatttgtcctcgtgtggaatctgagctgattccgcttaaattcgtattgtactactacttacggttctatttctctgctcgagtggaaatcggaacagaattagtaacagaattcagcttgaccaactgaatttgcggctcagttttgatggcattgcatgggcaaacatttgcccaagtcgaaaaatacaaagaagatcagtttggtctgttggctggtgacatcttgagatttaattcaaaggaacttttctgacatctggtaccgactgaattaacttaaaaagaggtttgtgcaggctagtacgaaaacaaagagtgctgacatatcagtcgcagtagtttcagatccgtaaaatgtggctgaatccacatctgcatgactgaatttcggttccctgacatttaatctcacaaattgtagaagatgtgtgttttcggcatggtttggggttgcttgaaaggctggagaatgtgatgccccaccttaacatggagctgtccttatctcggcaactcgatcagttaataatagtttcactttcaaaaatcacatggttcagatgccactaattaagaagtgaacatgctgctgtgctagagaagctaggctgtgtttagttccttctaaagttagaaatttgggttgaaattagtacgatgtgactgaaaagttatgtgtgtatgacaggttgatgtgatggaaaaagttgaaagtttggatctaaacacaaccctagtagtatcataaaacttttcgcagcattagcatcaggccacaatgcttgacagttgacagtatcaggaattcaggaattcgttcatgtaaaaagtacatcacatcaattgtttcagaaggcatgcagttgacatgatggagaggctgtttatctgctaatgtaatcgacagtaacacgcatgcagtatctgcactaattgttactacacaggagtaagattgcaacacgcattgctgattacgactgaatctgtcagaatcagtcctaagattttgggagcacattgctcagggatcattgcagcaataattatatcgacgacgagttccttgcacgcagcagcctcacgagccttgacgcatcatcgatcagtattagtagtagtgtcagtattggtttgggtcgcaagaattgcagagaggcttgcaagttgcaggttgctttgcagctcgtcgttgcttcgcttttgctactagcatactacagcaggagtactaattaacgaacaaattaatagacagttagctggagatatggcctgaagattaaggtgttaggtatcgccgaaaaaatgtagatcagcaagctgcctctgcctgcttaatttgagatcagcagcattccagcctacgactcgtcaacgccagttcgtgattgctcgttgcgtacttgcgtcacgtaatcaccaattgtgttaaagatttcattttctttgagaggatattgtgttatgaaatttttggatgtttatttgtggggttgcaataccggcgttagcttgtgagtactgaagaattctgtctgtccaaatatcatccgcagcgaccaatcaggcccatctaatatggacgcacagacgccgcaatccttttccaggccatattttccaaggaaaaagtctactttaggtctctcaattatggtgagttacatttacaccgctcaaccataaaaccaggtaaaatccctcaactatcaaaaccagtacaaatcaagtttctcggctgtttgaacggtgatttcatcctatgtggcatctacatggcacgttgacctagttttcgtttggcgtggcacttacttgtaattacagtcacaaaaagaaaatataatgggatccatatcagttctcatagtaatatgagagttttcaataggtctgcataaaatacattttttggggtacgggtaaaaatataaactagtggcatgtatcaaactattatgaaaattgtaatagcaaaatatcatttttcaaaaaccatcaaattgacctttttttaattatttttctgatttgcttgtcctctaatgggagatccattgcacaagctaaatattttgttttcccttttcccttgcatgctgagttttggtggcctttgggctgccagttttttttttctcatatatcgattatctgcttcagctgagaacttaattagaatatgttgttgttgaagcagtgcaaagaaatgagagtgtttgttacttggaatcctccagatgttactgttgtcatggccccttttttttggaatgctagataccggaattccgtccggacgggatcctttttgtctccttgcttattcaaagaggagcgatacctgaccatgcacgtcctgagcagcagcagcctctacaggagccgctccagtgcgcacgcatggttgacatgggcagtagtgttgcggcgcccacgcccgccctgtcgacacactgccccgcgaccgcgagctcctcgccggtggatgaggaagtagatcgcgaaggtgctgccctcgctgccgccgtcggtgcggagcacgacgagcacatacttggctaggcagaggacgcggccaccagcgacaagctccgacgtggcatggacgatggaggatacagccatcgccgacgagctccgtcgtgggacgtggatgacgaaggacgcggccgccggcgacgagctccaatgtggcgtggacggtggaggatgcggtcgtcagcgacaagctccggcgtggggcgtggagatggaggacgcggccgccggcgatgagttccgacgtggcgcggacgatgaaggatgtggccgccggcgacgagctccggcgtgggacgtggacggtgggaccaccggcgacgacgctttgatgctcggctcctgatatctagtaggtaacgtctgatacctcacaagtatcaccttttacgtggtaagaatcgcatgatacctgataggtatcacccgataccggttaggtatcaggacctgataccttaaaagtatcatcctctaagtggtaagaatcgcatcataccttatagataccatctgatacttcacaagtatcacctgatacgtggtagaatcgcatgatacctgataggtatctcctgatactggttaggtatcagaacctgatatctcacaagtatcaccctctacgtgataagaatcgtatgatacctgatagatatcatctaatacctcgcaagtattacctgatacgtggtagaaacgcataatacaggttaagtatcaaaacctgataactaaccggtatcatcccattcgaaaacgggattccgttgtatgacagccgcttttttttctcttttctttttctcaaatgacattagatttatataccaacttaggggcgccaagtggcctaatcagctggtaggtggcctgccatctttagaaagatggatggactaatcaattggccttgggcttgtcggcggcggcggcgacccggccgtcgttgccggcgagcttcatgtacttgtccttcctggtgagcgtggtgcattggaaccctagctccttggcgatcaccctctgcacgtggttcgccacctccaccgcgctcctcccgccggcgacgcacgtctcctccggcctcagcgccggcaggaacgtcacctcgtaccccggccgcgggttcatgtagaagaagtaagggtccaggaacttccaccccctcgccgtcgacccatagtacgtcccctgcctcgcctccaccgccaccggcacgatcctcgccgtcagctccgcgaacagcgccgagaaccgcagcaggtacggctcccggcacgtcgtcccctccgggcacaccaccacgtccccctcctccagcagcgccgcgatgcgcgccgcgtccgccgcgcggtcccgcgtcagcgccgccgcgcggatcggcgagatcgccgtcgacagccggctaacgctgtacgtcacgcacgtcacggggcggcccagcgcgatggacacgatgatggggtccagcgcggtgcggtggttgcacaccaggagggagcccggcgtccccgggcgcggcggcggcggcggcgccccgcgcacggcgaggcggatgccggtgaggcggtaggtgtggcggacgaggcgcgccgggacggggaggttgaggaacacgcggaggagcgccacggcgaagcccacggggaggtaggccagcgcgaacagcgcgctcgctggctccgggcggcggacgaggcggccgtcgtggaagatggcgcgcgacagcagctcgtcggcggcggcgcgcggcgcgcgcttgttcttgggcaccatgtaggcttcctgcgcattggcaatttggcgccaaaacagagttagcacactaaggctgtgtttagtttcacatcaaaattgaaagttcggagaaattggaacggtgtaacagaaaagttggaagtttgtgtatgtagaaaaattcgatgtgacagaaaagttaaaagtttaaagaaaaaagttaaatctaaacaaggcctaatttttacaaatatctggctttggagtatattcatatgtacattttgaacacttgtcttctttttttttcgttaaataaaaacaaatattgatgatgggctaggttgcattctgaatgtaagcatgaaattttagtttatgatagtctaaccaattaaaaattgctagtggtcaaagttgaaacagtagagtcaatattcagagtaaatgcaaatggagagagtactaaatccacattaattgatgcaaagaaaacaatactatatgagtaaagtgatcaatgataatgatattactataacaagtcagcatgagcaaacaatatttgaatataggagtacatactaatttggggttttggttttaaaaaggacgaaataaataggaagcaactgctaactgcctactaaaggaggtgatggtaccaacagtattgagttttggccacaagttttgcataaccataatgtaaattctagagccttcttgatctttcctatgaaaagaggggaaaaaaaggcaattcaacaaaaaaaaaaggcaaaaagctaagaagcgtacatattcttgctactcgtgctaccacaaatgagccaatcggatcgaagccatgaacactcgaagaacaatcgagcgtgcaattcctaccacaattaatttcacaatattttctttttttatttttggcgttctaaatgaattgttaaattattagtggccacatgatgcaaaacttcaattttgttcatgtgtgattgattcaattcaagaaatgatgaaaatttcgagctttggatcgtaggccatgaagtgtaccttgcagatggccatgaagtcgtggtcgctctcgcggtcgccgaggccgacgtcgggcatgtcgccgccggcgaagagcctctcgacgacctcgcgcttcttctcgccgacgaggacggccttgatgcggccggtgaaccgcttgccggaggcgaacgtctcgagctcggtgccggccacctcggcgccgaggaactcgcgcacgaactcccccaccatgacggccggcgacgcggtgaccacgacgcggcgctcggcgcagccgtggaacaccgcccacgtgtcggcgcgcaccccggcggcgtagtggcgcggcagcacggcgcgcgccacggcctcgacgtcgcggacgcgcagcccggcgaacgtgatgaacacgagcagggcgatggcggcggcctcggagacgccgacgtagagcgcgaggagccacggcgcggcgagcagcagcgccagcgcgcggaggtagctgccggcctcgagagccacaaggaagtagtacgggaacgccgacgacgacaccagcagcgtcccgtcgaggtccgccgccaccgtccgcctcgcgcccgccgccgcgtcgtacgccgtcaccggcggaaagaacctcctcctccccgccgccgccgccgccgccatgtcgctcgcagtcgccggcgaggccgagctcttcacgcttctagtagggcgatggagaagggttggtctgtttgttgagctgcttcgtctgcaccaccgcggccatcgatggcgacgtcgagcttctcctctgtttataccccttctgcaaaaaaagccatcgaatccgactcggattacgagcttgtcaattacgcgatccgaattggacttgggttaaactaaagttgccgccacaagactgattaatcacgcacatttcagacctcacaagactccgatttaattggttaaaaactttcagccactgttacatttgatcactactccatccgtttcacgatataagtcattctagcatttctcacattaatattaatgtgagaaatgctagaatgacttatattgtaaaaaaaggaaaaggaagtactaattttctccaagaaaagattcgagaagttgtatttatactggcggtatgggaacgcaggtaacgcgtgacaggcggcgcgaaacatgagaaaaaattgcatcgagttgtaatcaaatttgggtcaagaatggcacgcatgaagataaatggtggattggattattcatgaggttttggtgctggatcgttgttcgtttggatttggtcaagacgtacgggcgttcgtcgcaacgttttcggagtgtcggggcaattagtgagagcaaatgaaatgaattactagttctttttgtttgagagagaagcaaatgaattagtttgatgtgtgtagctatccgtccccgatataaacgtgagacgtgagtgaacgagtgatcaaatggaacaagcatccacgacgagaagactagtagtactactaatgtgtgcatctatgtggatgacaagggtttcctaaaccggcgccgcgcggtaacagtaaaaaaccgtacaaaatttattaaaaatttaaattattttttaaatttatttaaatttaaggaggttaccgtggtattgtattaccgtacctcgcggtaaggccggtaaccacggtaaccacacggttaccggcggtaaggtaaaccctacatcgacacacatggaggcatacggctacagtttaacagctacttaggcaggaatgtacgtatgtgcgttgaagagtttggcatgtttggacttttggacgttggacagaagaactgaaagaaaatttaaacaaaaaaaaaataagagaagaaacagaagttgctgtgcagttaattagcgtgaagattactagcacgggtggttgatgcggatggccaaaccattaccttttaccaatgctgctgtgagcatgtgaattactccctcattctttaaatgtttaacgctgttgacttttttaaatatgtttgaccgtttgtcttattcaaaaacttttgtgaaatgtgtaaaactatatgtatacataacaataaatcaaatgattggaaaaaaaattaatagttacttaattttttttaataagacaagcagtcaaacattttaaaaaaagttaacggcgtcgtacattttgggatggaggaagtatatatttcctccctatgtcactgtcaatgcaaatgggtaggcaaccataattacccaacccagtcttttgttggtccacggcagattggcagtggcaccatattcctacctctatatttcttctgcgtggacctggaaaaagacagcattcgtattgtattttagttgacagtttttaaccaaaacaacaacatcagagtggcgcagcggaagcgtggtgggcccataacccacaggtcccaggatcgaaacctggctctgataattattttttattttattttaaaaaacatcaatttcatcacttaaatggctaatttttaaaatttcaatcccgctatcattttcttattcaatttcatcacttaaatggctaagttttaaaattttcatcccactatcattttcttatttttttaaaaaatcaatgtttcgtcacaggctaatttataaaatttcaatcacaaatcttatatggctcaaagataagtcagaacttagctacttcaattttatctgtaaactaaagggccgtgtttagttgttttagcaaaataattttgagcgtatgaacacacatttgaagcctaattaatccatcattagcaaatatttactataacaccatattatcaaatcataacgtaattaggcttaaaagattcatctcgcaatttacatgcaaattatgcaattgtttttttttcgtccatatttaatgctccacgtatgtctaaacatttgatgtgatgaaaaagttagaagtttaaatagaactaaacacagcctaactcattcaggaaaaattcagaacatatcagcaatagaatgcctagatacaccatcagcatgcaagaaaaatgaacaatcacacataacaatcacaggacgcatcacactcgtgaattatgaacaagttattatctcaatatgtataggtgtgaaataaacaactgaacctcagacttcgtttgttacagcaaacgggcacaagtcggagatacagcaaaaatactacaaacaattaaacaccaattagcaacgggcactctctcgagtaaacaatgcctggaggattgccttatttcatatgtgcatcaatcaacccatgtcaccttcacatgtgtgacattttctccggacaatatacagttaagctgatgccttcagatgctgataacccggcatctctcaggtgggaagtcatgctccaccaatgggcctgtggaagaggacaccaagaatccatctgccctgacagtatccaggtcaattgtcactatactcagccctcttccaataatgtaaatctttctcccaatgcctacgagctcacaaggaggccttgtaagcttgtcagacagcctaccaagcatgatccactccttcgtctccttctgccacatcatcagctttgtgccgagcgactgctccagcatgtagagcgttccgtccatgacgactgttgatccagaccaacatagggcaatttcattctcagtgcccctccaagtgcggcacaatggatcatatatacctgcaaagtacattctgttccaggcagccttgtgaacagttaccaactccccatccaatgccacgaattttacaatgtcaggggtgagcattggattcttgtgcacacaccaagagtttgtgactggatcatagatgtcccatgaatttggcgacttgtctgtcaaacctagtccaccagtaatgtatagtttcttgtccagagctgcagaaacaaaatagcacctgaaaacaattgaggcaagtcaaaatgcgtgcagatgtcataaaacagcttcacgtgaaaaaaaatgttaatggccagtaagtaaactttgtcatcatatttacctagcagtaggcattggagctacactgctccagcaatttgatgaggcatcataacaaaatacttcatcattagcatcttttagccagctacaaccacccaaaagaaataatctcttgtctaaggtctcaatggaaatgccttccctagacgagcatgggggttcgatgacttgcataattttcaaggagcgggttgtaggatcaggagcaagtacatagcatttgatgcccgtactcctacaaatcacatatacccaaggctcatccaaattgttcctcttgcggcaagagtgccactcttcactggaaagcagtgccctccatctctttgagacacacctgagagcattatgatatcgccgtggaactctcgctaagcaaagaatagcaatctcatcaggaagaccatgtataagtgaagtatgggggccatcagaatccatgccgctacaggatagctttccaccgtgctttatttcagaagtcatcaattgtcctaaagagaatgagaacagatgagaaagtggcgatagacttaattaaatatatgctctgttgatacaggagataaacagtgtgaccagaaatttctaacaaaaacagaaggaaaaaaagagaacatcagaataaggaaaatgttactttcatgcttgccccgaatatttcagttctggatgtaatcaacaaaggagtggttaagagcaacctcactcagataccatccttataggagtcattagagcaaactaacaaggctaacaggctaaatacgcatatccattcaaggttgtgctcataaagggtgaaactatacaaggaacaggaacacagtgaatgcaacgaagcatatattattttttcaagttgggaaaaacagtccaaacattgacatgattttgcaccaggagcatgactagcatgctacttgctattctattcacatgtttgctcagaatctctgatcagttttggatgtaatcacgtgaggaccaccttttcaagtggttccttactaagataccgtccatgtaggaatcatcacagcaaacaagcaagaaaagaaaaggcaaagcaaaaatctcaattggtttattattatcccttttttttatattagccacaatatgtgtcatggttaaaaagggtgaaactatatgagcaacaaaaacatgatggaaaaactaaatttctgaaaacttttatctgttaactttaggagtaggcgtgtttaaatagggtgacaccatataaggaacagaaacagtcttttgagttaggaaaaacagtaaaaaaaatgacagtatcttgctgtttgcaccaggagcacaacaaggatgttacatgctattcaattcagatctacacacgtttgctcagaatctttgatcagttttggatgtaatcatgtgaggaacactctttcaagtagttcctcactcagataccgtccatgtaggaatcatcacagcaaacaagcaagaaaactcagtcatcacagcaaacaagcaagaaaagggaaaaaatgaacatctcaatgggctgatctattatatcaaaagtagtgatgctttaaaaggggcgacactatataaagggcagaatattgaacctagtgaaagcatcaagcatatatttttccatccagttgggagaacagttcaaatttacacatgttttctctgagtctctgatcagtattggatataatcatgtgaggaacacttttaagtggttccttactcagatcgtccttaccaaagaggtcatgcctgcgtgacactctacataatgagcttacacagtgaagccaatgaaggcatgttattcttttcagctgggaaagcagttcaatcacaggaaggattttgctcaacaggcacagcgacttcattatttattatttaattcagaattgcatgtttgctcagaatctctgatcagttttggatataatcatgtgaggagctctctttcaagaggttcctcactcagataccgtccttgtaggaatcatcatggcaaacaatcaagaaaagaaatgttaatgggcctaactgttaacttcaaagggaaattatgtttaagtgtaaaaagagcagaaaccaagcagatacattaagcgcgtatcattgacaggtttgcataacagtcaaatgtacgacaggattgatactctggttctattcagattcacatgtttgctcagaatctctgatcagttttggatgtaatcacgcaaggagtactctttcaagagccaccttactcagataccgtccttgtagatgtcatcacagcaaacaatcatcataaaaaaaaaatagggggtgtagcatgactgtaaccaagcctacatagaacaggaacagcaaaatattccttctttcacagagtgaaaaatatgcagagttttgctcagacatttttagtctcagtttaggtataatcacgtgaggatagatccatcgctcagataccgtccttgtagatgtcatcacagcaattatgagatacagtcattaagttgagcaggcccacaaacttaaaaaccacctcattccaatctaaccatgtaactcagcgacatcaactcaatcaaaatgtactaccttataatacgtagtaccttaacatgtttctcaggttgagaaacagtcaaatgtacaacaggatagacaatttcttctgttcagacacatgtttgctcagaatctctgatcagttttggatgtaatcacataaggagtactctttcaagaaccttactcagataccgtccttgtaggaatcatcaaggcaaacaatcattctaaatccagtgcaaaacaatcattctaaatccagtgcaaatcatcattctcatttcaaggcagtaacaaagacgacacagaacacgaatagcatatgctggttgctgcttagttctgaacagcgagaagcaaatattccaacttccagatggtaaaaaagaaatgcagagttttgctcagacatttttagtctcagtttaggtataatcacgcgaggatagatccgtcgctcagataccgtcctattagatgtcatcacagcaatttaatttgagatacaatcagttcagcaggcagattaacttgcacgcctcattccaatttaatctaatcatctagctcagctagctcagcgatatcaactcaaacaaatcctaccacctgaacatacactaccacacaagagcaaccttaacaacaagatgataagagaatgagaacgatacaataccatcggggggaaaaatcacacctcggaaaggtgcttaagcgtcggatctgacgaggagcagaggcgggcgggggtggacgcggtggatttgagagcggtgggcggagttgtggtggaaaggaaggagaagggcatggagcaccgtgaaacaacaaacaaatcctagatctggtggggatcagagggtggcggcggcggcgggactagggtttcggccattgccgcagcccggaggaggaaaaaggcgagatgcggagaaggggaaatgcggatggtgacgccgccattttatcgcggcgagatgatatgatggccattatgcaataagacccctctattttttctaaaatacgcgccgttttttccgcaactataagagggaaaaggagaaggatagcaacagtagatggtttcaacatttaaatctaccaaaatcaactaggaaaatgtagcagatttatgaaggccccatgtgagaatctcatccactcaaatcacagcaaatcaaccaaatagaggagaaaaaactgggacagggaagaggatgcccaaccttgcaatgggcgacggacaactatccattgtgctcagctcgacggagagtgacggtggagcagggggcacgaccggcaaaagagagggaggacgaccgaggagagccggagtcggaggagaggggaggggcctcgccgccgccagagccgctagggtaaaccctagttttttcgcgagagggagaagtagcggtgaccccatatatcctccgtgagcgggtgcatcactcgagtcgagccaggccgagcagcgaagtccgtttccgtcgggccttgggcctggctgaggggctattttttgcatcctcgtggacaggctgggaggcccggcccgagcaggcaaccaaagaataagttcattttgggtccctctatttgtaggtcagtctgattttcgtcccttggtcgcaaacaaatttgcatggactggtgcgggccaaccaaccaaacagcctcaaagtgaacccaaaaaccctagcgccgccgccgccgccatggaagaagcgtggccgcctctcgcccccgccccggaagctgcggctcctcccggaggaggaggaggtggaggagcatggggcgcggcggcggtggcgcagcggaaggaggtggccgaggagtcgtcggcgcatgcggtgagccggctggtggcgagctgcgccaacacgagcggcgtggcggtggccgtggtggacgccaacgccgtcatatcgggcggagccgcgctctcctcgtccgccgcccgcctcgtcacggtgcccgaggtgctggaggaggtgcgcgacgcgtccgcgcgccgccgcctcgcgctcctcatggcccctgtcgagaccctcgaccctgcccctgaattcgtcaagaaaggtaggtactaccttcagcaattctgactgaaccttgttgagtattagcaataaaactatctacagatcagtgaatttcacattttccttaaaatagattttatggtacgagtgtactaagaactggataacggtgtaggtgtagccaagaccatggtttaataagttttgtggttaaaacattgcctttgtgtaacatgagctggtagtttgtttaatgttgttgtcttaaaacttaatgtaagcatgagggaaatggcaaggcttgcatgtgcaaaagcaattagatgtcacaacagtatggttttctatagaatagaattagccttctagtcttctactatggaaattttcctcatctttgaatgacgtaatgatgagaaaggctaatttctcaatctttgtttctggcagttgtcaaatttgcccgggaaacaggagacctccagacgctttcagatgttgatatcaagattattgctctagcttacatgctggaagctgagatccatgggactaaccatttgcgggagcagccacctcctctgcgtgtggtgaatgtgagaaacctgaaagaggctccactgccaggttggggctctaatgtgcagaacctagcagaatgggaagaattggaccagatgtctgaagcaggtggggatctcaagtcacgcatacttccactgaaggatcttgagaaccacgaaataccgaatagtgagaccaacagtatttctgacaagcaaggtgatgaagagcatcagcctgcaaagaaagatgtaggtattgcttgggaagatgatgagaataatgaaggttggttgcctgctgttagtcgcagtacacacagaagatatctacgaaggaaggcgagacgtgatgccctcaaggaatctgaacaaagtattgagacaagttctgctgccccatcaattgatgacgataaaattttatctgaaaatggtttgaatccagtggatggcccttccgctgatactgatgttatggagcaccaagaagtgaatgaacctgaaattgttgcagatcattcgcaatctgataataaggacaatggggtaggcaatgttggtgatgttgaggagaccggcggtacggacgcatgcattgaagagttggataatttggatatcaaaagcgactctgaggaaggtgtcgattcatctcttgcagatgatgggagcagtgagcagagttgggcgttgaggtccttatctgaatctactgtagcatgcataaccagtgactatgccatgcaaaatgtcatcctgcagattggtctccgtctcttggcaccaggtggcatgcaaatacgtcagttgcacaggtatgagcttttagcatcttcagagctctttcacgcactagttcttgttctatttatagtagtttctttgtaacgctaatgctttgggatgctaatttggcaggtgggttctgaggtgtcatgcttgctataaggtgacccaagagattgggaaaatattttgcccaaaatgtggcaacggtggcaccttacggaaggtttcggtaacagttggtgaaaatgggatcactatggcctcacgacgtccgcgtgtgacacttcgaggcacaaaagtgagtgtagtttcaaacttaatgctgtttttcttccatgtggcctagatacttttatgttttgtcacttgcctgattattgtggcaatattggtttgtttgctgccttgctttactgttatctgagaaatagaaaagcacattttagactcatgccaaatgtccagatagtttatttccatgcttgtaatatgtatgatggtcagaggttcaaaagtgtcgaacatagtcttcagtgtagtggtgtagaaaatccatgagctttggccagtcccgtatgcattccttactaatcaagtccttctagactctctttggtgaatcgcaatacatatcctgccatactatggccttctacatcagttttcgtattcatttcttagtctgaatgcttttggttggatatttttccatgtgcccacctggcctttccaagttgattcctactgtgatgacaaaagattttctttttaattgtatgcctattttctttcagttttccctcccaatgccccaaggtggaagagatgccataactaagaatcccattttgcgtgaagaccagcttccccagaaggttctgcaccctaaatcgaagaagtcaaacaagcaggtaactagcccttgctattgttagatttactgaaaagcctccttttataaggatgcctgcttttcggcacttaaattcaacatctccaaaacgttcttttacaccaactatgtgctctgctaaacagatattctccattctgtgggtgcatatgcttttttttcctgtttttgtatcgcaatagttaagcaactatttatttaaccattaataatattctctataggacgatgatttcttgggtgtcgaggacatattttcgcacagcggtgaaaagaaagtaccactgaaacctccagtgaggaaggcccttgcaatgttcagtgggaaacggaatccgaatgacaaccacttttctcgcaagaagcattgaatttctgttccccatttgttgctcttttactatcatggttttgtactgcattgtttgacgagagaagtagagtgtatcaccttgatggtgattgtggagaaaaaagtcatcctgtagactgaactctgatgaagcatgtaagctatacaattttgcagaacatctatgtaaggctcagttccatagtaccattttcatatcaattacagctggagtattttgagtgcatgaattgcgaatacatccagaggtttaacgttttttcgaacatcaattattagtgacaagtaatcactctattcctcaaaattattcaaatgagcaactggagaattcatcaaacttactcgatccaacaataaaactttttctttcagttgggtattgtgctactactacttgagaattacaggctcacatttacacagacaaatggttacactttttttattgcagaaacaaccaaagaatatgtccagcctagggtgtgcttaacttctactacatcacattttttcttacaaaagagaagaatcaaattaatgaagcagtataccgcaatttctttcgatgcttttacgctcaatgcacacaaaacacacgaactcgatcgatcatatcacacacaatcgtcatcagaagagcagatcgtcactagtggcagcaaatccgccatagatgtctcccatgtttagcaggtcaaagtagccgccgcctcctgccattggagcagcagcagctgagctctgatgctgctgctgcaatgcgccgtagctgccgctcatctggtccccgaacgcgccgccgtgcgacggcgtcacgttgccggagctcgccgtggacgccggccagtgctgcgccgagatggagtagctctcctgccccgccgccgccgcagacatcggcatccagtcgccggtgaagacgaagctcttgggctgctgatcaaatggctcagcgacaggtgcaggagcagagatgccgccatggctgccgccgctgctcaggttggcgtcttggtcatgggaggtggtcgtgctgccgctgctgttcttgatctgatgatggtgagggtgatgatgatggtgatgcaatgatggtggctcggtggtgctcatggaggtgacctcagctgctgctgctgctagattgttagggatggagccctgtgcctgcatcaccctcttcttgaggtaggaattccagtagttcttcacctcgttgtccgtcctcccaggcagatgcatcgcaatctgtgaccacctgatcataaatttctcaaaacaatcagcatcatgtagatgaaatggaacaattgaaaatgctcaattttgttattctgtgacagcttgagctttgttttttttaacttaaaagacgttgttttgtctgaatttcaaggtaaagttcagctacaagttagaactagcttggttttgtatcatcctgttcatagagattgtcaggtgtgaggattacttgttgcccagcttggcctgaagattgatgacaatgtcctcctcctcctgagagaacattccacgcttcaatcctggccgaaggtagttgatccaacgcagccggcagctcttgccatttctctgcaaaccttttggaaataaaaaggagagaaaaaagggtcagaaataatagcagtgaatgagacaaagatttcatttttatttaagaacaagtgaacaactgatgaactttagagagctagactctatgtactgtaatgcttttgttattattttggaaaaaaaagggtgagaattcttccttggctggaatttcaactggcctaagaattgtgatcaagctaagcttgaactaacccaaagctaagtactctctgtaactgctaattaccaattagagaggggactagactaggctagaattcacaattgtgaagagggatgcattggtgaatgcagcaatgtgcattcacagtagagacagagagaagcaaaaagctcaccagcctttgcagggacagcactccagcagccaaggccatgcttgacaatgtagtccctcagcctctggtcctcctcaggagaccacagccccttcctgtagttcatcttcggcttgtcgcaggaccggcaccccattgctctcttctttccttctctgaatatctcctcctgttcttcctcctgcaacctgtatgttggtcttgtctcaatatgagctgttgcagtagcagagttgtgccagtcctttcagcaccatgtgaccccttgtcatttaaagggggttctcacattttggtgttaattagtttaattggtgggaatgagtaggtaatacatgcacatgcatgaggatcatcaagagggaggcgttggtcagaggatatcacattgtcacctctttctcttcattacacaaaaaaagattctgatagttattctttcagttttggccttgttctaatgatgtggatgcttgctggcactaatgaccacattttatttttgtttttaagtcggtgactatattgttattgtaattggcagctgatagtatatatgttaattacctacttacttagaccatcggtttagtaccaaaattgttagttatcagagttttactgacaaagtaattcgtttcagaggcagtattttcagatgaccctgtaaaactattagggccatgcattagtagtagagtgataatggccatccaatttgtttactataaaacatgattatccagtaatcagcgtgataaaggtcagactgtctccaccaatgatgagtagagcattgacatgagctgttattgcgatgaaacaaacaggctcttggattagcaatgacaagacatgatttaatcaccctctcttaatgccaattgccaatcattgaaagcatctgcctagacaaaacaccaaggaggatgaagaattgcccaaggacacaagaaaagacaggctagttagcatccatccagaaggatttgcatctgcaaggatcaacaagatgaactgcaccatggacaagggccatacataaacaaggaccccagaagcacaaattaacaatgatgttgagcttgaatgccaaaccacaatgctcctttcttatgaaattttaagaacaacatagctggcagaagaaattcagagtgaaagaatcacaatcattttacacggcttcatgtgctcatcatatacaatacagaaatcggtgttgtttttcctcttggtgatacatagtggcattgtcctaattcagcgacacttggctagttgtctgtcttagttttcatagtgaaatgatgatgatagattgcaagagaagtacggtactagtttgtgcagtttgacagctaacatcatctgttcatcaagatttttgtcctttcctcgaactagttgttcttagaatcccagtataggtacaccagttctctttacttcttctcgagttcctcgcgtaggaaaaacaaagacttctccgaaagtgtcaaataaacgaaagccaagtttgcgtcatgatgatctaaaattacatcaaaatctctgcattttggatgccatgtgtttgtcttttactgctggtgctgacatgatttaatttcagaaaaagatgaagtgttaagttcagctagatgttgactcgttgttcttcagggtagtagctctatgtgaatgggttcagtgcttcagtttgcagaaagctgaaaagcatcaaaatctacagcctactaagtatactaatacttgtagaactccacaagtatgctgagcttaagctacattataaaattttaacgattttacatcctctgaaatcagtatacaacatgctcgcgagacacgagaaccgaaaacaaacaaagcatgatccaacgcatagatgttatttacccgaagaaagaacaaagaactaaaatttaataataattagctctaagagtcctatcatgactagtgatatctctgtcctcttttaatacacaacaatataatgtcctacaaaaagggacggttccatgtgagcttcagaggcgtcttaatctcctcttctcttcctcagcatcaaaaaatgagatttgctgatgagaaaaaaatcagagctctcttctctcaacattagccgacaatgataaactaatacaagtatacaacactatgattttattaacaaaattaagtatacggccctgtgccaaattatatttgtctgcaaattgacttgtgcataagtgcatgtggacaaacacctaatccccgaacaaattcaggcatcttgccctatacattatgtcccagtggttaaactaatagcactgttctgaagagaagaaggataaaggaatcttttgtcagttccacacacacataaaatcctagtcctagttaagaactgcatcctgacttgcgaggcttgttgcttcttgtcacatctagaatgtaatgtaaatgtgtagtactactgatttagttaatgattaaagaattattgggaaaatgatggtgatttgcaaaatatgcttctaaaattaaaaaaatgaagcaggaacatgcaagagggcttctttgtacttgcaatgatgggatgcaagtcaatgctctcttcagaattaatccacagagacaggcaagatggcccaattgtatacacaagtacagctcatccgggtactcactgaataatgaagactagcactgcaaattgtcagtatatcttgccagaattaagtataatggatggctgcaaaaattatgtcatcttgataagcacgtacacgaataattattaggcatccttgaggattttgagaggaatgctgaagatggtgattaagtggatggatgctgtttaacttgcttgttaatcagcatgcagcagcaacgatttgcttctgaaagtaccatgtttatgcatacttggtagcaaagaaaagcttatccgattattttaagtacattatcatggattgatgataatgttcatgcaaggagattaggagaagctagtgaccaaagtggaggcaaagaggggatccatgaggaattgagtaggctgagtacttcaggcaatgaaagatatacagatttatttcatttgacagccttttgagtctaaagtttgaaagaagatatacaaatttatttcatttgacagccttttgagtctaagtgagaatgaaaatttattttctataaatctagttcgttggacagctttggagtctatgtgtgcaggaaagaagataggcgaaaccagttcattggacaaacttttcagacataagtgatagcaagatcaatataatagatatatctatctagttaaagacagctttaatgcaaattaaacttactttcaaataaaaaatgcaaactgaactttataaatctacttacaaaattgtgcagtttcttatttaaaaggaatagttattcagtaatcgcaccttgactgggccaaatgaagcccagtttatgtgggccgataccaaaaatgggccttacctgttaggcccaactcctttgggctaacactaggccgaatgactccgttgcagtatgggccgacactgtaacattgattaggcccacagcatctaaaacttttacgaaagaaaatgagggcaaaaaagcgtggtatcgcgcaaaatcgaactgaagaaacatacacaaatggcgctcataaagtgaaaaaaaacatgtaagtatactcaatggtataatgcatgctgttggatcaatggtaaatggaaatttattgaagcattattattcttgtttaaagaataaatcagcgtgtacactgtcaggaacacatcgatcacattcaccgatcgaatcaaacaaaaaaaaaggaaaggaaaagaatcttaatccatcagtcatcctcttctcctcctctctgacaacttgagcattacatccatatctttctccctttttttagtatagaaaggaaaagaagaaaatggaaggaaaaatgtggtgattaaacagaaacacaaacacaaagaagagattaattaagaatggcggcgtcacggtcgagcacggtggcgatgattaattaatggaggatgatgatgatgtgtttgcaatgcgttgctcactgtcatgcagccacgtcgtcgtcgtcgtcgcccccgacgccggcgacgtcgggggtgagacggcggtgggtggtgaagagcttgagcacgccgtcggagccgccggcgacgagctggccgtcgctgtcgtcgccggcgagctggcgccatgcgaccgcgctgacgaaggcgtcggcgtgggagaatgggtggacccagatgggcttggaccagcggaggtcgtagacgaagacgtggccggactcggagccgctggcgatcagccccgcgccacgccacacccccatccccacgaagcttcgcccgctgacgtggccgctgtacgaccgcacctccctcgccgccgtctccgccgccgccggcgccggcagcgcccacagacggtgggtgccgtccgccgccgacgtcaccacccgccgcgccgtcgccgcccaccggacgtacgtcacggcgcggccgtggccgtccatggacgccaccgcgccgcgccccagcgcgcgcacgtcgtgcaccgcggcgcggcggtcggcggagcccaccgccagctgcggcccgccggcggggtcgaactccacgcacagcacggcgccgccggcgcgcgccgtcgcccacgaccccgccgcgccagccggggcgcgcgggtcccacacgtgggctgtccggtcgtccgacccggacgccaccatcgtcgccgcgccgccgccgcgggcgtagtcgagcgcccacacccgccgcccctcgtgctcgtcgcgctcccagaccggcacgccgcgctccacgtcgtactccgtcacgacgccgtcgtagtcgccgcaccccacgtgcgacgccgccaccgcctcgccgccgccagggcgccaccgcacgctgctcagcttggccgggacgcagatgcaggcggcggggctagacggctcggcgaccctgtaaatccggatcttccgggcgatgccgccggtggcgaggtggcggccggtggggtcgaagtcgaggctgccgatggagtcggacgcgcccgcgagcgccggcgacggcacggtggccgccaggcgaaactcccattcgcacctcggcggcgacagcttgtcctcgtcgtcgggaataatgccggcggcggcgtgttcttgctgcagcgccgcctcgtcccggtgatcctgatcgtgcagctgctgctccccggcggcggtggacgtggccggcgaggaggggttgctcatggaacgctagcttgctcgcctcctcatagggctaagctagctaccaagctaagcttagctcaagctcaagctcacaaccctattcttttcttgattcgagatcgatttttttttggtttgtttttgttgaatttgatttggtggttcttgtttgtcctggggcaagaactagagagagagaaagaaaaagattgtagagagagagagagagagagagagaatggtttggttgaggtggattattaatggagagccacaggagaggagaggagccaatgagaggaaaggtttaggttgcagtgcagggtttgtgtggctgagtgaggctcatgtcgtggctgcatttgcaattgcagattagtacgtgctcctggtaagtggcatggtgaccaatcacaattcaaattcaatgcgaatccaattcaagctggctaatggctatggcttgctgagctgagctggtaggggttagttaattagtttggttaggtttggccacatatacacaggcagataatggtccaagatcgaggcagttacttgtactgtactgtgtcctggttggaatatttctcaccatttattttggttagcagtacatctcaactagtactactctcctgcctcttcttttcctttatttggaaaaaagtcaatcctccttacatgtaatcaactaatttaatcatgcatgaggccgggttaattctcatcatgtcaactattattggtacatgcatgcaaagtataattcattcgatcagtacaaaactacaaactgaaaataaattactccatccgtttcacaatgcaagtcattctagcatttctcacattcatattaatattaatgaatctagacatatatatatctatctagattcattgacaccaatatgaatatagaaaatactaaaataacttacattgtaaaacggaggaagtacttacaatgtcatacccacgagtctcctaacacacacctgaaaagacagatagacgaattctcggtctcactaaatttgtactcctaaagctcacttgcgcgtgtgtaaattcctattgaaactaaagctcactcgcgcgtgtgtaatatatatatgatttgtttattattgacgtgcattgcacattacttgttcaagaaattaatattttttttcagaccaaacaaaatttaatttatacgcagtcaaatgttggataagagaaagctagctgcctgcaaattaattaattaatttaaattttaaaaatagattaatatgtgtcgacgagggatgcccgtagaccggatatagagggtattggggtacgctggtacgaggatctacgtagtacgacatcaagcaaacagaaaacagagattatactggttcaggcccctcggaaggtaataaccctaatccagttgatatgagattatatgattgaaatcacatattacaaagggtataatagaactcgatgataccgtcgagaccgtagtcgagttggttcgactagatcacctggcgacttggctcctgtaggctccggcttcgtaggctgtggtggatgtgttggcggtaagatttgatgccttaggtcctcccggggggttccttttataccgtggtcagttggtctttaagtagaactcggagacatcagaccccacacgatacagtaacgacccggttctgtccgagtaggactccttccatccgtggactccatttctattacacgatgaatttccttaacgtgtacaggaaacatccgtatacacgcaggtataccatatcagtatacgtcgtatatccaagggtagagggtataccttatccgtaattctgacaatatgatttttaaagaatcttttatataacgatttctctttttttttgcaaaaactacatagtttagcaatttgggaaacatacaagcgggaaacgggttcttttgtttcttttgtggttgtaacaaacgcaacctagtatgtactcgaaattgtcaaagtttttgtttgtttagtactaattaaaagaggagaaattaggctttgggggacaaatgaaataaaataaaagatcgatccccattggaattattatatgtatagtttgtatatataggatcgagaaaacagtggagatatgagatggacgtccttactagctggagtagctcttttgttgtatagatagatagatgagattggtggtcacaccgttgacaggtacgcaggcagtgaacgcgtgtggaccagatcgtttccagttcgtacgtactagctttattagttggcgtaattactgtgtcctagttagctaccacttgcaatataaattattgttttggagcatatatatgcaattaactggcatcatatttagattagtagtatatatgaatgcatgtgtgtgataccgcaaccttttttcaggaaaatgtgtagttttcatatttagattagtactccctccgtccataatataagctccgttccataatataagggattttaagtttttgcttgcaacatttgaccactcgtcttattcaaaattttttgaaattattatttattttatgtgacttacttcattattcacagtaatttaagcacaaatttttgttttttatatttgtaaaaaaaatttgaataagacaagtagtggtcaaacattgcaagccaaaactcaaaatcccttatattgtaggacggagggagtagtatatatgaatatatgcatactggtggagaaactatctttggtcggtccggcaaaatccacaatagtcccggatccaaaaagaaccgggactaaagattgtttttagtcccggtaataaaaattttgatctttagtcccggttggtaacaccaaccgagacaaaagatgatctttagtcctggttcatcctctgtcagatgtatgtcagggggccgagaatctttagtcccggttgatgtcaataacaggaactaaagatcaccactttagtcacggttggtagtaccaaccgggactaaaattaaacacgtacggttggtactaccaaccgagactaaagatcaagaatctttactctcggttggtagtactaaccgggactaaaattaaacacgtagtatataatccctatccattattctctcctccacagttacaacttagacagatcgaatctcacccctctcctcagatctatcctctctaactctcctctccaactcctccccttctctccccttcctccttccttcccagccggcttccccttcccatccggcgggccggccggcggcggggccgcgcccggcggggtcgcgcctggcggagggcggcagcgccgcgcgcggcggcgggcggtggggcttcgggcggcagcggctgtggcgggtggcagggccgcggccgcggcagctggcggggccgcgcccgtcgttcgtagcgaccggcggcggcggcggcttctttgtttttttttaatttgtgatgattcattgttatgtatttgactaagaagttacaaatttgtgattcgcggttaggggagctctcttaatgacgtggtggaatgtgtggttagagagaaataataggattttcgccgatagtgctagaactgagcgtgaggtggcctatgtcataaagcaggagctagatctctgcaagtcggctttcaggccgccctgatggtttttcctctatttggcttgtaagcactatatttcctatctctaattaaattccggcagaactcctgccgtcggtttcctaaaataaaaaacaaatttgtgattcattgtttggatctgtgatgtatttgagtaatttcttaggatattgtgatgcatttgatttatgtgtataagtaactttatgattgtgatgtgaatttgggatgttagttagatttggggattgatttggggatttgcctacttgattcgggagaatataaaaatgaaaaaagaaaaagaaaaaggaaccatctgtactgccgctattgtctcttttagtccaggttggtaacatcaaccgggactaaagatcccctctctttagtcgcggttggtagtaccaaccgggactaaagatgaatatctttagtcccggatccgtactcccggttggaaaaccgggattaaagggggttcccaaccgggagtaaagatggtttctccaccagtgacatgtgcatgcagtgcagtgtgataccgaaaccttttttcaggaaaatgtgtagttttcatgaataaatctcagatgtatatttttttatttaatggtagatatctgcaggacatatatagcatacttttctatcttttttttatttcgtgttgaatggaagtcaagtactactctctccgtttcacaatgtaagtcattctatcattttccacattcatattgatattaatgaatatagatagatatatgtgaaacggaggaagtagtttacaattgttaaaaaaacgcgtctaacaatcgtgaaccctaaagaaaaggttcttgaaaaaaaccctaaagaaaaggaagtcgcgtgggggtcacatcaaaattgaacagaactttgtaaaaaatggtgttaattactactccctccgtcccaaaaaaaggcaaaccctgggtttccgtgtccaactttgactgtccgtcttatacgaaatttttttataattcgtattttacttgttgttagatgataaaatatgattaatattttatgcgtgacttgtctttttaattttttttcatatttttttcaaataagacggacggtcaaacgttgggcacggaaaccagggtttgtcttttttttgggacggagggagtatgttgcacgaatgatgacatgcatctaacatgagtagttgtaacatctatttttaatgtgttggaatttagaacatgctactatgtctgtttcatattataagtcatattaattttttttctaaattaaatatttctaagtttaaccaaatttatagaaaaatatagtaacatttataatatcaaattagttttataattcttataattttcagagtatatttattttgttttaaaaatattgctatatttttcggtagatttagtcaaacttaaaaaaatgacttataatgtgtgatttatgatatgaaacagaaagagtcctaaactatttgaaacatatagtaggaatggcttatcttttgtgttactgcgtatttctttgtaaagaccagctaactcaagacagcgttgtacgtacttatatcaggagtaaattaattcatatggccaagtggttaattattaaaaaaaccattgcaggcaggcaacaggcattgacggcattgaaattaattataattaatataatcaagactgattaaggcagttcgtatgtattcttgctaatatttttgcgcctcacatgctgtacatttttatctcgtccaaaatccctattattgatgtacacttctgcaggtacgcatggtcaattcatcaggattcaggacgaagtgctctttgattaatttctctccttcaagatttcctgggtgatcagtcaccaagttaaatagtaaggacatatttcaaatcttttgctcatatatgtgtactggggacgacgacctattgagaaggagcgaatgtgagattgtgagaggtgctccactatggattatggaaagacaagatttggataagcccgacatgcttttgatgcaggctgcagggacagaacagccgggagggtccattatgcatgcaatgtcagtttggactggaatcggtcgtacattaattactccttccgtctctctccgttttaaaataaacacataatatgatatatttagtaatcataaatctggacagcattagaatatgcatacacccctaataagttgtacaacattctagcggtagctcttaaatcatataatatatataggtgttattagaagataaaatattgaatctgatggttgcgtacttaaaatattggaactgatggttgcgtacttactctacatgtgtgtgggcatgatggaaggaggggcagaatcaagaaagaagaacaactccgcttttaagatagtagagaaataaatttattttcaattagtcaaacacatattaagaaaaaaagttaaaagaataccttgcttttattaatatggagagaaaatgttaaaagactagtatatttttaataaaaactaaaactatacttattaggaaggaggaagaagcttattactattacaacaatcgtcacattttctttctcttgaaggcaaatttgcatcagaacctcaattatattataatatatattgttcacgtgaaatcccagaaaaagaataaattcagcgaaaaacatgtgagagttttatttcctgcaggagattgtgatatcaatccccagctgctagctactccccccgtttcacgatgtaagactttctaacattgcccatatacatatagatgttaatgaatctaaacacatatatatgttcagattacttaacatcaaaaataaatatgaacaatactaaaaagtcttacattgtgaaacggagaaagtacttggttaatttgagatgaacatattgcaaggtgtgagagtgagacgaaagcgaaaaggagacacgaacaagtccagcagcatcaggatgtgtatagtagataggagtatactataggagactatagagtgagatgagttcacatattacgtgggcaggggatgagttacgtgtgcacacgtgcgcctctcatgcaaaatgcaaactgcatctgccatgcactccaacgatccatctgatatgaatatgatgcctccacctacgtacatctccggatcttctctgcctacaattacaacgtacgttgaaggggttttttttcgcttgtttagatcgatgatattttcgaacattctatttgctaaaattgatagttaaatggctacatttagtttgttatcaaatattgacaacgtgtacgaaattctggtaacattattagccaatcgtaccaaaattttagcaatattgttaatttgttaaaattttggtaaggattattttggcatccatctaaacagacacttgattctctcgctccaattcaacctatcatcctttagtcgccggtatagtataaccataacgtttttgtcttttcttttttttttctcttgaagtatattgaaaaaacttcaacttggtaactaaaccggcggcggccaagaggataatagaactcatcttgaagaattaagtaaattaaacaacatacatgaaattcatcaggatcgatctttcagccacgtgaacataactgattgatccagctgtttaagctgcacggagcacgtattaaaaaaaaacaagctacaatcttttctgcaatacacaccatagggattggggaactcgcttcaccgatcgcagagacaggcggctcaattaagatgtccatctctagaaatataggcttatttttacaggtaatcatctcagattttacaggtagtcatcttagatcctatttgtttcatcttatgattattataatttagattattaagctggattataataagctgatatataataagttgtgagttatttgtttgtctggattattggaggtatatggattattgagtttgaaaagttaaagtctataataacctcagctatctattcggttgatggcatatgtgggtaatttttctcaagtatataggggtagtgggtctttagccacttaataatatgaaaaaaactcatctagagcagcttattagattataataatctagtttatagattataataatctgctataataatctacttatttatttcagcttacttttaataagctagattataataatcctaagatgaatcaaacagtgccttagattgtttaccaagtgaaaggtttaatactccaagaaaaaagttaaaggtgctaggagattcatcttgaagaaggaaattaaataaaatgcatggaatctatcgcgatattttagccacgagaacaagattgattgatccaatttaagccgcacggagtatatatatagagataaaccgattactttccacggttatgcctttttgtcattacccacttctttttttaatttttcttttgaaaacatcaaactaaaaacaatgaaatgatggagaaatagaccctacgtaccaactaatgatcattgtgttatatattgcgaataattacgctcttattataagaaaatcaatgcccttttgttctctttgtaccaccctatctagcttaattaggttattactcatttaactcgtcctatttttacaaagatgtacaatttgtcctatatatgtcctattgtcatatgtatacactatcttttccacctctttgtcatcgatttttattccccttcttttcccgggaattatatatcttttgtttatttctgggtattaattcaatttcttttgttttgtttgtgtggcagctggcgtgtaaaaacacctgccacaaacaaggccacataatgttctcttcagggagggagatgattaagattaaagcaccagttccaatcagtacggctagctgcttaattatagcttgtgctaataagatcagacaggtaccgagtgtcatatctgtccatctttttatctacctgatgacgccgtcactatctactactccctccctcctataatataaaaaaaattaactttttcttacactgtttaaccactcgtcttattcaaaaatttatgcaaatataaaaaatgaaaagttgtacttaaagtactttggataataaagtaagtcacaaataaaataaataataattttaattttttttaataagacgaatggtcaaatagtgcaagaaaaagtcaaaatcccctatattatgggacggagggagtacgtacttcgttcgtctcaaaatataaacaattttaacggaataaaatacatccgacactaatactataaatatgaacatgttacaagtctaggtagttttacgaatatgaaaagttaaaaattgaactaaccaatgtatgacattgcttagttcaaatttgcactatctactacgaagtactatcctttttctatatgacaacgtatgaaagtaaatataggtagtatttaataaattgagttttggtattgaataaattttacaaaactacatgtattttgtacaatttatcacgaaattacagattcagtgtctccgtttatcacaaaactatatatgctttgtacaatctatcagaaaattacatatttaaaaacttatttcataaaactatagattttatatagtatatgtagttttataaaatttactctttagtatttattatcggacattttctggctaatcatataatatgttgtacggttaggtagccggagtagctaacactaatttttgatatccaatcaaatcaacctctgatcccaagttcccaacatctgaaaaaaaagtaccccctctgatcccatcgattaagccgcaaatgaaagagtttgcatgcatcgatgcaccgaaactatttaggccctgattagtttccgtaattttttttatccaatcatattaaatatttggacacacacacacacacacatatatatatatatatatatatatatatatatatatatatatatatatatatatatatatatatatatatatatagtattaaatatcgatctacagtatggagaagggacacatatatagagtattaaatatagatctacagcatggatagggcagatcagcagctaatattagcttgtgagtatttgttaatttaatttgatataatcgatcacgagaggtgattattaattaattagattggatacacaacaacgtaccgtacctacttaattaattaagagtagcaagcaaaggcattgaatgcatgggtgcaattttcatattgcatggtttggcgacccccccacattgcaggagagcacgtgcattcctatggtccatacaaactactattactacacacatctccatctttctatcatatcgtgccacgtagccagccaatagcggatctaggaagaaataacaggagagtacgaaaaaattagataaaactacaaccccttcctatttactaaaaacaaaaaattttaataaatgcttcgtgaggactctcatagttctcacaccaatagtggaggctggagaccccgtcgcccctgcagccagctactgatcacatatacgaaatatatgtatttatatattcaccaaggttttaaatctctgactattagtcactatctctagtactccctccatttcgaaatgtttgacgccgttgactttttaacacatgtttgaccgttcgtcttattcaaaaaatttaagtaattattaattattttcctatcatttgattcattgttaaatatatttttatgtaggcatataattttacatatttcacaaaagtttttgaataagacgaacggtcaaatatgtgctaaaaaataaacggtgtcaaacatttcaaaacggagggagtagtagtttaaggagagtagctatttgcatgctctcatgtataatttagatattattagacactgtaacctcatttagccgctattaactgtttgaaagggtctatacttaaatgttttagctcactatttaaaaccgggatatccacaccaatgtatgcatatgtattttgtacaggaaaaaaagcactggctctaaacctcatcgtaaattacaaaaataaaaacctacaaaaaaagaaaaagggaaaaatatactgtagtactttgtggttcggagaataaaattccaaccctgcgtgacctcattggaagctgacgaactctctctaaccaacagaaggcccacgggaatcccggcctagttctttccaggcccagataaactaaaccgagtttgggccaagatcttggggtggaattgggcccagaaagagcccaaaccattcaaactcgcgaatttaaataaccaaacaaatttagaaagacttttgaaacttcggagtagctatgaattgaagtaacctacgtgtcatgcaattgacaagttcgatgcaaatttgttgaacctattttttttcctttttttttttcaaaaaacgtacatcgtgtcccgtgttaaaaaatctacaattccaatcacggaatcacccccttaaacttgttagcaaacacgaaaaacaaaacagaaaaaaaaaataagcaggagttggagtttaaatctctgaaccctatccatgacctcatttgagaaggcccacgtcttgtatagtttaaccccatccacggttaaggataatgacttcaaacatggccagctcctatagtgtgacgggcggtgtgtacaaggcccgggaacggattcgccgccgtatggctgaccggcgattactagcgattcctgcttcatgcaggcgagttgcagcctgcaatccgaactgaggacgggtttttggagttagctcaccctcgcgagatcgcgaccctttgtcccgcccattgtagcacgtgtgtcgcctagggcataaggggcatgataacttggcctcatcctctacttcctccggcttaacaccggcgggctgttcagggttccaaactcatagtggcaacttaacacgagggttgcgctcgttgcgagacttaacccaacaccttacggcacgagctgacgacagccatgcaccacttgtgtccgcgttcccgagggcacccctctctttcaagaggattcgcggcatgtcaagccctggtaaggttcttctctttgcatcgaattaaaccacatgctccaccgcttctgcgggctcccgtcaattcctttgagtttcattcttgcgaacgtactccccaggcgggatacttaacgcatgtaacgccccgattttcgttcgggattaaaaatcatttaataatgcatttcctagaaattaaataaaaagttaagcaatttatccaagtgaattattgggagaattaaaattttccctttaaaaattattggccgggaatattttgtaatattctttgtgccctaaaatactctccggaattttccgtgaattttcggagctcgagaaatagttttaatagcacaaagatcattgcatcaattaaaataaaacgaaaacaaataaaatcctccttttcctcttcttgggccatcggcccagtccaccccgccgcgcgcgccctcctccttgtgggccggcccaagccgcccctccctctctccccgggacgccgacaggtgggccccacctgtcggacccgtccccttcctccagccggcgccgccgcgcccgcaaccgccgccgcgtccacgcctccaccttctccgggccacgtcagccacgtccgtgtgtgcgccgcgtcccccatgcccactcccctctctctcccgcccgcgccccgcgcccgagatggccgggattcgattttcgaatcccgcctctctctcctcccccacttccccacgttggccgacgattcccgcctctcccggccacgtccggccctcccctcccctatttaagcttccccgtcgctccctctcgctttttccccttctcgccgaactccctcgtgctccccatcgcccccgcgccgtgcaaccactcgccgccgccgttttcgctactccggccgccgctagccgccgctagggtcgccgccgcaccgcgccgtcgccgccgtcgggttcgcgaggctaagctccaccccggccgccccttccccgtcgagtttcgtcgccggaattcgcatcccctcgcgctccggtgagttcaactgctaccgccgctttcggccatgaataccggtcgccgtggttcatctccctccctctaatctctctcttctccttccttagggcaccccgaatcccgtccgccggtggccgtcgtcctcccgtggctcgccgtcgccgttcgccatcgtcttcctccgcgccggccaccctcggtgaggcatcctctcccttctattcccctccctctccctcctagccgccgctttagcgccgccgcccgttagccgtcgctttagcaccaccgcccgtcggcgccgcctttgcgccgccgtctccgtcgccggttgccgtcgccggcaacgcgtgtgcgcgcgccgtcgccgtcgccgtggccgcttggccggtcttgagccgagccgggtcgccaccgcccgtccgatcgaccccgagggcgatctgggccgtcggtcccgtggaccggcggtggaccacccgcgtggtcccggtccacggtgaaccgcccccccttgtgtcgctgaccggtggggcccgcttgccggcgccgcctctcccccttgctgacgtcagcgaggtccatttcctttgtaaaaataaataataattacgcaataaatcgagtttaattctagaaattcatttaaatggctcaaaacttctaaaattcatatctaattcattcgaactccgaattaagccattcaacttgcaaaattcatctaaaattgagctctgcatgtttgtttagtttttatgtactgtttccttggtttttattagagtttttcctcattttgtgtgccagcgtgtagaatccgtcgtttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatgggatccgggtattacctatctgctcgcttgtgccatgtttacttgatatctgttctttgtcaaccttgggtaatgaatcgactagctcatgttacttatgtgtcctagctagaactatatgcttagccatgcttaattaccactagctcagttgatgggataattacagtattagacctttttagtatcagagtgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctacgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggtgcacgggaacgtgtcgtggggctgtgtcttgtgggtacagttgtacacctctgatcagagtaaaactattcgaatagccgtgcccgcggttatgggcggtcgactagattcaccgtgattagtcccaccttaataaatcgactcaatacactgtagttcaggtgggttggttgggcctgttcaacgtggtgtagcgttgatcagtggagattcaatattactttaattactcaacagttttactgttttgctcaataaaatgttttacaaccgcctttatgcaaatagccacaaaccatccttgtatccccttgcacatctgcatcgttggtgtggcttgctgagtacggtggttgtactcagttttgctattattccccctttttcagaagtgtagtgcttctgagcggaagatggagttagaggaccaaggctcagaccccagttgagttttgcctgtggagtggagctgaagccccgctaggatcgcctttttccgctgctgtcgttctgtttcggtgtgaggactaagtgcctcttccgttttacgctttatttacgtttggaactgtatattacttgtcgttttgtgtaccctggctggtcctggacagggatttaatacgcaaaatagtctggaaatttgggttaaatttctgggcgtgacaacgcgttagctacagcactgcacgggtcgagtcacacagcacctagtatctatcgtttacggctaggactactggggtctctaatcccatttgctcccctagcttttgtctctcagtgtcagtgtcggcccagcagagtgctttcgccgttggtgttctttccgatctcaatgcatttcaccgcttcaccggaaattccctctgcccctaccgtactccagcttggtagtttccaccgcctgtccagggttgagccctgggatttgacggcggtcttgaaaagccacctacagacgctttacgcctaatcattccggataacgcttgcatcctctgtcttaccacggctgctggcatagagttagccgatgcttattcctcagataccgtcattgtttcttctccgagaaaagaagttgacgacccgtaggccttccacctccacacagcattgctccgtcaggctttctcccattgcggaaaattccacattgctgcctcccgtaggagtctgggccatgtctcagtcccagtgtggctgatcatcctctcggaccagctactgatcatcgccttggtaagctattgcctcaccaactagctaatcagacgcgagcccctccttgggcggatttctccttttgctcctcaacctacggggtattaccaaccatttccagttgttgttcccctcccaaaggcaggttcttacgcgttactcacccattcgccactagaaacaccacttcctgttcgacttgcatgtgttaagcatgccgccagcgttcatcctgagccaggatcaaactctacatgagattcatagttgcattacttatagcttccttattcatagacaaagcggattcagaattgtctttccttccaaggataacttgtatccatgcgcttcagattattagcctggagtttgccaccagcagtatagccaaccctaccctatcacgtcaatcccacaagcctcttatccattcccgttcgatcgtggtggggggagtaagtcaaaatagaaaaaactcacattgggtttagggataatcaggctcgaactgatgacttccaccacgtcaaggtgacactctaccgctgagttatatcccttccccgtcccctcgagaaagagaattaacgaatcctaaggcaaaggggcgagaaactcaaggccacccttcctccgggctttctttccacactattatggatagtcaaataatgggaaaaattggattcaattgtcaaccagtcctatcgaaaataggattgactatggattcgagccatagtcaatctgtatgattttcataaaatctgtacgattttcccgatctaaatcgagcaggtttccatgaagaagatcttgttcagcatgttctattcgatactggtaggagaagaacccgactcggtattcttaaaaaaagaggggaagcagaaccaagtcaagatgatatgggtcgccccttcttcttgcgccaaagatcttaccatttccaaaggaactggggctacatttcttttcaatttccattcaagagtttctatctgtttccacgcccttttttgagacctcgaaacatgaaatggacaaattccttctcttaggaacacatacaagaaaaagggataatggtagccctgccattaactacttcattttcatttatgaatttcatagtaatagaaatccattcctaccgagacagaatttcgaacttgctatcctcttgcctaataggcaaagattgacctctgtagaaagactgactcattcggatcgatatgaggacccaactacgttgcattgccagaatccatgttccatatttgaagagggttgacctctgtgcttctctcatggtacaatcctcttcctgctgagccccctttctcctcggtccacagaaaaaatggaggactggtgccgacagttcatcacggaagaaagaactcacagagccgggatcgctaactaatagaatagcactactaactaatactaatatatagaaatagatatctagaaatagaaacgaactaatatatagataatcgaaattgaaaagaactgtcttttctgtatactctccccgttctattgctaccgtgggtcttatgcaatcgatcggatcatatagatatcccttcaacacaacataggtcatcgaaaggatctcggatgactcaccaaagcatgaaagccagttagaaaatggattcctatttgaagagttcctaaccgcatggataagctcacattaaccgtcaattttggatccaattcgggatttttcttgggaagtttcgggaagaaattggaatggaataatatagattcatacagaggaaaaggttctctattgatgcaaacgttgtacctagaggatagggatagaggaagagggaaaaatcaaaatgaaataaataaagaataaagcaaaaaaaaaaaagtcgaagatagaagagcccagattccaaatgaagaaatggaaactcgaaaaggatccttctgattctcaaagaatgaggggcaaggggattgataccgagaaagatttcttcttattataagacgtgatttgatccgcatatgtttggtaaagaacaatcttctcctttaatcataaatggaaagtgttcaattagaacatgaaaacgtgactcaattggtcttagttagtcttcgggacggagtggaagaagggcggagactctcgaatgaggaaaaggatccctttgaaagaattgaacgaggagccgtatgaggtgaaaatctcatgtatggttctgtagagggacaggaagggtgacttatctgtagacttttccactatcaaccccaaaaacccaactctgccttacgtaaagttgccagagtacaattaacctctggatttgaaatcactgcttatatacctggtattggccataatttacaagaacattctgtagtattagtaatctccgaagacttctccacgaggctcataccaggcactacggcgctgaagtatgtaacccatgccatactcccaggaaaagctcgaacgaccttcaacaaaggggtacctgtacccgaaaccgacacaggtgggtaggtagagaatacctaggggtgcgagacaactctctctaaggaactcggcaaaatagccccgtaacttcgggagaaggggtgccccctcacaaaacggggtcgcagtgaccaggcccgggcgactgtttaccaaaaacgcaggtctccgcaaagtcgtaagaccatgtatgggggctgacgcctgcccagtgctggaaggtcaaggaagttggtgaactgatgacagggaagccggcgaccgaagccccggtgaacggcggccgtaactataacggtcctaaggtagcaaaattccttgtcgggtaagttccgacccgcatgaaaggcgtaacgatctgggcactgtctcggagagagactcggtgaaatagacatgtctgtgaagatgcggactacctacacctagacagaaaaaccctatgaagctttactgttccctgggattggctttgggcctttcctgcgcagcttaggtggaaagcgaagaaggcccccttccgggggggcccgagccatcagtgagataccactctggaagagctcggattctaaccttgtgtcagacccgcgggccaagggacagtctcaggtagacagtttctatggggcgtaggcctcccaaaaggtaacggaggcgtgcaaaggtttcctcgggccagacggacattggtccttgagtgcaaaggcagaagggagcttgactgcaagactcacccatcgagcagagatgaaagtcggccttagtgatctgacggtgccgagtggaagggccgtcgctcaacggataaaagttactctagggataacatgctgatcttccccaagagtccacatcgacaggaaggtttggcacctcgatgtcggctcttcgccacctggagctataggtgattccaagggttgggctgttcgcccattaatgcggtacgtgagctgggttcagaacgtcgtgagacagttcggtccatatccggtgtgggcgttagagcattgagaggacctttccctagtacgagaggaccgggaaggacgcacctctagtgtaccagttatcatgcctacggtgaacgctgggtagccaagtgcggagaggataactgctgaaagcatataagtagtaagcccaccccaagatgagtgctctctcctccaacttccctagagcctccggtagcatagccgagacagcgacgggttctccacccatacggggatggagcgacagaagcatggaaataggataaggtagcggcgagatgagccgtttaaataggtgtcaagtggaagtgcagtgatgtatgcagctgaggcatcctaacgaacgaacgatttgaacattgttcctacacgacctgatcaaatcgatcaggcacttgccatctatcttcattgttcaactctttgatgaaaagatgaaaaaaccaaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaagtagctcgattccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggtacccccaggaagagatccagtggagacggggtgggcctgtagctcagaggattagagcacgtggctacaaaccacggtgtcgggggttcaaatccctcctcgcccacagccttccaaacgggaagggcctttactttccccctgagggtaggaaaaccatgatcgggatagcggacgtaaagctattgaacttgggtatgctctttccttttgtcgaagtggaatcgtagaacagaatgtgatatgataagataaaatgcaatagaaacaaggatagcgaacgggttacctactcctaagggtcaaagcaagccctttaattcaattctttattcttaaattaaagaatgaatcaaatctccccaagtagaattcgaacctacgaccagtcagttaacaaccgaccgctctaccactgagctactgaggaacaggggggattcgacctcctagagttcaactcccgctctcaacccatgaacaatatgagtccgaagcttctttcgtaactcccggaatttcttcgtagtggctctgttccatgcctcatttcataggtaagcccagagtggctctatttcattctatttcacttcctagcgcttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggttgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattgtttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgtaaaaaaattcattattggcccaccattgattagaagatttaacttgtataaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaattagcaaaattcttttattttagatagaagaaacttttcttctatctaaaataaaagaatgtacccttctatccaaatccaatttgcatcgataaaataaatccaaattccagtagtagatgaataattacaaatttttgtgtgtacgagattacaataatttcaaaataactgacataattttttatttttcctgatcagaaaaatacatgaaaaaaaaggaggtagaaaattttttggatttatggttaaagaagaaaactggggttatgttgaatttcaagtattcagtttcaccactaaaatacggagacttgcttcacatttggaattacacaaaaaagatttttcatcggaaagaggtctccgaagacttttggggttttcagatcacaaatcgaagtgttcggagtaaaaagctaactgaatttaaatagcccaaacagatcgataaactcttaaaacttcggcttgatttacaaaaaatgatcaagctcctttgtttcatcacacaagtacacaagtgctagtataacacgaatgtttgaatcagagtagcccatgtttgatacgactgacaagtgacaagttcgatgcaaatttcattcaacttataatttttcaaatcgcctgttccaccacaacggagtagaaaattccaaccaaaatgaaggaaaattcaatttatggcaggttctctctcctgtgaggaacaaacggttgagatggtgccacgtggcgtgtatcggggccgaagcccccgctaacttatccgttacctcgctcccatcccgctaaaccccaccgcgacctcgccggccttcctccgctccggccatggaagccttcgccgccgccgccgccgcggccggcgtcttcgcgggcgccggcgcagctgcgcgccccgtactgctccgccgcagaggtgccccccggtccggccgggtgcgcctcctccgagcgccgccgcgcgccggtggggacagaggaggggacctgcccccgctcgacgagtgggacaggatggagctggagttcgggcgcttcctcggcgaggatcccaagctcaccctcgccaaggtttccttcctcccgtgtgcctgccttactactgctctcatctcatccctagagagagtagaggctctcggaataagatggaaatgtcgccttgttttttttaaaaaaattcaatgcgaattcatacttgcgttgatagataggatgtcacgagtgttctaattgtagcaaaacgatcgttgcgacttgtgagtatcatgcgggtatgtactagaaatgtttgtgcataattgtggactagtgttcaggttctactgcagccttatttttttctagtatttgtaccaccgcatatgttgttatgttgtccaatatgactgtattgttgtactccatgcttaagtttggatggtttgtgctaaatttacttatttttagtttaaaataagaaggtcgctagatggagtagtttagtactcctatatactatactatccagtcttgctaggatgttcctaccaatgtggctagtcgcaattgctcattgcagttggagcctaataatctgaggattacaattttgaattttatttttgtggctgaaccttgactcaactcccaagtagtagtactgcccaaatgtattgctaggattctaagatctgataactgcgaacctgtacactacaaactgacacatggttatttcacacgtgttctgtagcgatgtttctgtcacttgattttctcatcattagcatgccttaagtgtttttgaattattccctcagatacttctcaagaaagcagacccagatgcttcatcgctcgatgtagagaatctaattgccaacaaaaaggccaagttggatgatattttgagggagtttatggatgctaacagacaggaacagacttctgaatcaccagaggaaacaagcaagccaatggtagacaaaaattctccaagcatgtcaagacctgttcagaccaatgcaaagcaagatgagcctgctttgactctgctgcgaccagcaggaagcaaattgaagcaagatgatcctcctttgactttgcagcgaccagcagggagcaaacccaagcaagatggtccttctttggctccattacgaccggtagggagcaagccaaaggaaaataacacttctttaaccttggtgcggccaatgggaagcagaccaattgtccggggtaaaccggtgcaagatagttggcctagcaaggggagcttagctgccagaagagagtcgagcgatgttggcagcacctcaagaaagaacaatgtggatgtttccttgcggaaacccaccatacatcagagtgatgatgatgaattgaagtcgaagctgaatctgaaaccaaatattgacttgaaaatgaggaaagatatggacgaggatttggccaacatctctcttcttcaaaagccagagctttcagtagataatatgaattcaaatcaagagaagtctgatgctggacctgcctctgttgcttctggagaggataatggtgcagttgacccagaaacaaatggtaaggtacaacatcccaaatgcaacaggccatgatgagctggttcttttggatctgatggattgcaaatttttcaatcttcaggtcttgatgaaagagtagtgattgacagtattaatgatcgtgagtcatctgtgcttcctgatgatcttagtgcaggtaaggaaggcataatagatcagtgactagtctctattcatccatcatactaatgttatgttaaaattttcaagaattacagccatctgagcaaaattttaaccgagaaggcgacccttctgtggtggatgatcaatcagccgtcagcagtaatttctctatgcaagctttcttgcaaggaaaacctaagatgtactttctgatgaaactatgcacttctatttttagcataacattttcatcgcttgtaaaatatatatttgacatttctgcttaactaattgtacttcatgttgttacattgatccaaattgggtgtatcccttcttcttttgagtaactcacgtcattacagtttctcgcatgttggccgagctaccactaatatggcaattactacattgtaggaaagacttagctgttgaaacatttccatctcaagttgatgctgagaagatgaatgccagtgagaataacatgaattatgttgatgatggaggcaatgtgttatcatcgaaattagaggtaatgtgaatttcataatgtttgagcttcagcatcttataggcttattatcaaactcaacaactgtagttcttagagtgggtgttgccttctgtggaatgagatgtttccctattcaagggtcattgagtcatatttcatccttttaattcttctagatattgattataactcttgtttatggaatcactaatgcaggacatcacagagagtgactggacaaggctggagaattatgcaagtaccggagaaaaagttgaggtggagctgataaactgcagctcgaaaggatttgttgtaagtttttgtccagttttagaattagcacctttttaatcaagttataatgaactgatggtacctgacctctatcatcatttctttgccaggtatcactcgattcattgataggtttcttaccgtatcgcaatcttgctacaaaatggaaattcttagcttttgagacttggttaagacaaaagggtggcgatccttcactcttcaagcagagtgtgggcatagaagaaagttttgaggtcaatgacaggaacatagaatcagtatctagctcagattcagaacttgctgtgcaggatcaaggttctatgccatctaaggaaaaatttgaagatcttcttcgaacatataacactgagaaatctaaattcttatcatcatttatcggtcaagtatgaatcttttgttagtctccaaacattcttcagttgaacccttttagctaacatgccattgcttgttttgcagagactccgtgtttcagttgtcctggctgacagaaaatccaagaaaatatttttctctatgaagccaaaagaaagtgaagaattgattcagaaaaagaaaagtctcatggtacttactatgttgaaatgtctattagcttagttcttttgctatgcttagcatggtccaacattttcccttttattacttatttatttgttcggctgcacacactgtttttcttaacatgcaggctaagctcaatgtgggagatattgttgaatgcactatcaagcgatttgtttactttgggatatttgttgaggtaggtctaaccatattttctacgctttttcattcagtatcagcagctaactgtttctttcaaaggttgaaggagttcccgcattaattcagcagtgggaagtgtcttgggatgaaaccttggacccatcagtttcttacaaaattggtcaggtaacacttgttttttgcatggaccttatttttgttgcaatctggctttgttaacagtgtgtgtgcacccatgtgtggataaaggaggagttgcaagttctcatgttcattttgaaactgacatacctctctatatcgtctagaaacttagatacatcacgtgacaatgatcataatgccaaactttctgggatttacagaaatttattttgatttccaggttgtggatgctaaagttattcaactggactataataataaccgcatatttttgtcacttaaagatgtaaaggtacctgggggcctttccccttttccctcatggtggttcagcttattgaattgctgatttcaggctttcatttattatttttgtcatttcccccttctatgcagccaaatccttcagtaggcgcattggaagctgtcattggtgaggaactatcactgggtggagctcttgaacctgcagaagcagattttgaggtttgtgtgacttatggcattatttatcatcatcttgaaatttttcattgtttgtgatttgaaggttatgcatatttagagggcctgaaatctaaatctaatgccctctctctattcaactgggaaaaaccacgtcatcagattgttttctaacttctggctaaatgatgaaaacatgtatagctgctacatggcagttgcatcccattttctgagttatgtataatatcttagcctgtgccaaagagatcgaaactttttgtaggtttgctggtagggcctcctgcatggtctgtgattgaatatgggcatacctgagttttttcccttctattgcaagcatgttttgtcatacagaagttgatagagctctgtatttgaatgcggggagtctgtgctacccaagcctggatccttcctatcttcttagtttgtttaattagttattgttcttcattcaaacttcttttctggatattttgtggacatttctgagagctgtagacatagcagtgaacttgggtcatgcaatgtttgtttcatacgtctgccttgtggcattgattttctttcttttccttatccatccactttgttgcatccttgttttaacactccattatttgatcataattattttagtggcctgaagtggatgctctcatggaagagatgaaaaatattgaggaagttagggatgtttataaaggacgattcttgcgaagcccaggactagctccaacctttcaggtaaaatctaaaatgtagatacgtttcatgttcagcattcacacaattctgcaccttagttgttggaattgacacctgaccttatttcctttttaaatctattgcttgctaggtgtatatggcacctttggttggtcagaaatataaactccttgcacgctatggaaataatgtccaagaggtatggacaattaatgttaaatgcttgatcgagtcacaagctgaaaattgtgtgttgtcattcttacatagcatggactgaactcttgtgcaggtgatggtggagacatcattagacaaagaacagttgaaagaggcagttttagcgtgcacaaacagggtgagctgatgatcagcgtctccgtgctgtagtatttttccttcttttagcttgcgaagcagatggttgtacagaattgttgtggcagtccaattttgcatccttgtagcatgcttttgagtcgtttacacctgattttcttccttttcaagttgaaaataccaggtgatatgtagtcctagctcaactttgtagaggatgacaggtgtaaatcgccttgatacgttactacggaattgcaacagaattcgatttgcatctttcacggtgctagaattaatctaccatatttttgtttgaacaacgtagtaaatgataggtgatagcaccggtaacatggtttattggttaatctgaaatttggaatgaagataaaaaaaattaatgattcatccaactagatattaattatcattaccataaacaggtttgtttttatttcgttttcatatcgacacgaacaactcagcgccaatgaatatactcgctgtgtgggtcacagttgtttcattgccgctccaaaaggttatgtaaggctgggatcatgatataactcagcttaaaaattgattttaagaaattagaaagaactcaaagtcagacggcatattaccattctcaatatcacagcaatcacattccctaattaaagtcattgtaagtatagcggagaaacaaaatgttgaggtagagtttctgtatgaagttggcggtgtcaaacatgataattaaaccactgatgtcgtagatatggttcgtatatagacctatggtttgggaaaaaaaaaagagaccattgaagtgataatttaaatacttaatagtaatagactctttgatggagtattacaacatgcagcagtggcattaatacgccagtacattaattaagttacacatatgcaggctccattttggtttcttttaatttatcgtattacagaatttctgtagccttgctgatgatcacttggatatcatgtactagtaattaacaataggatgcatacaaaagatggcccaacgacaacagaagatgcgtgcatctgacattgtctggccttatttggttggtagtactccaattaattaacaagagatgatgcattcttgtgccttagtttcttcacatgcttggcttcacgttgagcctattcgcaatcttcacccccaacgactcatcacactgcatgaagtaaatgagttaattacatagttagtgcaaattaatagctttttttgccggaattagtgcaaattaatagcgattaagtcatattaatttcaaattctctacagtggtttaaaattatatatttcatataaaataggattaaataatttatctatggattcataaaactgttgtgctaaacatggtgttaatcatgtggattaactaagagaaaacaattaatcattactaataactactccctccgttttttttatatgacgttgattagttcaaactttaactagtagtgtcataaaaacaaaaatggaggtaatactaaattgctggtatgaattacctgggagaggtagttgacccagatggcgcggagctcaggggagaccttggggtgcgcgagctcgccggcgaagcggcggatgaacctctcctgtctatccggcgcccacgacctgtacctctccccgggctgcttgaagtcgttctgcttgtgtatcgtcgccttctgcctcctccccaccacggggcgcggcgtgatgggcgtcggcggcgcgtggcggagcggcgcgtggcgcgatgggtagtagtccacctcctcgtcccggtgcatgaagttcatggcgccgtcgtagtggttgttgtggtgggcgcacttgggcgcgttcaccggcagcatcaggtagtttggccccagcctgtagcgctgcgtgtcggcgtacgcgaacaccctgcactgcagcatcttgtcgtcggagtagtagatccccggcaccaccagccccggcccgaacgccagctgctcgttctcgttgaagaagttgtcgacgttgcggttgagaacgaggcgccccacgggccggagcggcacctcgtcctccggccatgtcttggtgtcatccagcgggtcgaagtcgaacctctcctcctcctccgggtcgatcacctaacagtattaaataattaattagaaggagtactgcggcttcgaactcagatcgtataggcgttaatttctggatgatcacctacctggacgaacagcttccactcggggaagttgccggcggcgatggagtcgtagaggtcctgggtggcgtggctgtggttcttgccgccgacgagcgtggcctcgtcgtccatcaagcagctgacgccgcaggtgggcttccagtggaacttgacgtacctggccttggcgtcgcgggtgacgaaggtgtaggtgttgacgccgaagccgtccatgtggcggtaatcggtggggatgccgacgtcgtcgaagaggaagaagaaggtgtggaggctctcggggtggtgggacaagaagtcgaagaccctccagtactcctggacatgggagcgcgggttgggcttgaaggcgtggatgacgtcggggaacttgatgccgtcgcggatgaagaagacggggaagttgttgccgaggaggtcccagttgccctcgcgggtgtagaacttgacggcgaacccgcgcgggtcgcggatcgtctccgggctgccgcgctcgtggatgacggtggagaagcggacgatgacgggggtctgggcgcccggggaccggaggaagtcggcgcaggtgatgtcggtgacgtcgtgggtgcactcgaagaagcccttggcggaggcgccgcgggcgtggaccacgcgctccgggatgcgctcccgggcgaagtgcgccaccttctcgatcaggtggtagtcctcgaggaggatcggccccctgggccccactgtcagcgcctcgttgtcgttccacaccggagctcccgcgttcgtcgtcgtcgtcttcgtgtcgaacgagctcgacggccggaactgcatgggtagcacgtattactattaattaattaattaattatatacttaatgatcgactagctgaatcaaccagccatgcatgtttgaagagcttgagactaaaaaagaaatattcgtagaatctagtcgataatctaggttatttcaggaagtttctgataatcgaccaaatattctataagaagttaagctctctcttgaatctacacaactagctaaatgaaacctcaattattaactacaagattaagtagatttagtctcactagtcactgagtgactgaccttgcaaggatccatggtagtgggctagtggcagcagcaggtatctgggagtgagaggggtttgtttctgctagctctccagcttgctcggtgagacagcctgcctaaaggttatatagcgggaggtggtgaggagcactgacctccccggtgagcttaccggagaccggtgccacacactgactggtgggcccgggtggccatactgcatggttgggtcccacaggaactggacgaggataaggtgaggtggatgtgggcccccctcgtgtggaaaggaaatacatgcattgcctggattggatgcatggagtgtcatcacttcatcagtgctcactagctgcgtgccatcactgcatgtccatcgtcagatcagatcagatcatcggatcatatctcttcgattgatttcaacggcgccgaattgctgccatcgatagcttagctcatcccctttctcttgatcggtcggccaaagtttgacatgcttgcagttgcagctaacgtctctgcattttctttcttgtttctcagattaatttcaggctgcttaattattctgtaagaacgaggtgctctttgtgctagctagctatggctcagctacaccctcgtttatcataaacatacacgtttctcaaactgtaagctataaacagtgtgtttcgtacaaaatctttttatactatataaaagaatttaatggtgatggtgaatctaccatcatttagagttggtgagatcttctaatgctacataaatacatctttgtgtgtggtttggttttctattggatgtttgattgcaattatgtttgacaaatacaatttctaaatcaagaaattcacataaatcttttaaaatccgtccgttgcagagcacgttactttgctagtctttaaaattttaaataaatttagttttcaagtttataataggtaatactgagtttatcatgtactattcacctgttccggttttcatgccactaactagctcagtcaaactcctttatcgaacacagcccagccagaatgcacccttgtctttttacctagtgctataagaggaaccaattcaagatgatgatgattgatttaccttgtagcattactacgcagttcaaattactaacctttcagattaggtacggtctgaatatgtgatggaagatcgaagcagctgtatctcataaaataaattacagattccgtctggaaactgcaagacgaatttattaagcctaattaatctattattagcaaatatttattgtagcaccaaattgtcaaatcatggcgcaattaggcttaaaagatttgtctcgtaatttcaaggcgaaatgtttaattgttttttttctacatttagtactctatgcatgtgtccaaacatcctatgtaacagcgtgaaaaattttgtttgggaactaaacagaccctgattgtgatgcaacccataagtaattgcaaaactagctagctatctacagcatcatcagcatatatcttggtggtctaaacttctcaggaaacaaaagatgagaaattgttctgttcttagtccacgctgatgataacgataggtgtgctgtggtgggcacaagcttttttctttctttttttttttgaggggaaagttgcttaagatgaagtgacataaacaagattaattcgaggaaaatgtgcgcatctcagatgtgtactccatttatacaaaacccagcaaattaagaaggtacaattatctgacagactagcgaacaaactgaaaattatagtcgtagtactacaaatttgcagtttgtggctgaggggaatctatcccatctggtatatgctgtcactttgtgctagtactgtactatgtactagcctgtagcctctacttttgtaattgaatgagaatatttgaatgttttacaccacataatggaacagctcaaatctcataagatcttggagagatattcttgattactctgattaatgggtcatgtgttgatgcatatatatatatatatatatatatatatatatatatatatatatatatatatatatatatgttaatgaatcaaaacgcatgcatatgtctagattgaatgtgggcaatgctaaaaagtattatattgtgaaacggaggaagtagtagtcaaatggtgctaagatctgggttttcatgaaacaacactagacaccaataatgcaatcggtgggtatgcttttgtctctgacgactaattgccttgtgaatgaaaaagctttggattttagctcctaaaaatctgcaatcttaatcaaaagggagaaatgcacaaaatgagctattggaaagaaaggaactacgatatcttgcagaatatatttcaaataaaaagatagttgcttattcgttcgagaaaacaggttatcaatttggtacagatttggcttgaattttacattttaatgctagttggtgaaccgtccagtactctgatggccatattaataatttccccataaaaaaacataaactaaattcaacctcggacactcaactttatattgcaaatctgaaataattttactgcattagaaaaatcagaagatggctgcgagtaatattagtgtcagttggtgaactgttgagtactcccatttccatatatattaatcattttcccatcgaaaaatgagaaaccaaatgcaaccactcaactttacattaaaaaactaaagtaattttgcactatatagagcattaaaaaaatcagaaaatgatttcgagtaatgtgagtagtcatcctgcacgagcttgactaatgcttttggaaaaagggagtaattgaggtgaggtgtgagagtgagattccccacctgtgggtacatgacaaaacaaaccaatcttgctgttgaagcgcatgatgtgagataagatcatcaatcagcagcaccaaaaaatatctctccttctattgcgtgcatggtttgttccttacatgattctatcttgagcagtgctcattcttcagtgatcattagctgtttcttgtaacttgtaagaacttgtttgaagcgcaggaatatttttttccttgaagataaatatagcgaaattggaatgctgaattatcaattaccggtgtgtaaatgccctctgatgaaataagaagagtaagtagagcacaaattttacagtaacaaattaagggctcctttgaatcgtaggaatgaaaaaataataggaataggaaaaacacaggattctgacaaaaatacaattgtaaaacagaggattgcaaaacacaggaatgaccgtttgattggaccacaggaaaaacgcaggaatcagatgagagagatagactcagaggaaatgttccaagaggttagacctcttgctaacttttctctaaaatgtgcataggattaccccatttcataggaactttaaaggattggatatgatttaatcctttgtttcaaaggccttcataggattttttttttcatagggttaaaatcctccaaaattcctatatttttcctataaatcaatggggccctaacaatagtagcatatgctagtacaagaaacaagagaagagaataaaataataacactgtaattgaggatttacagagaaaattaacgtatatataatcacggaatgaatgctttccaataggttcacgtggtgatccaacaagttggatgttggattgttgattgatgccgaaaatgtttggggctgaatgcaactgaaggaaagtgggaccgtgcatgctccaaaagaattgcatcgaccgtacagtagcgctactgcctacctaacttaatcatgttgcaaagagccagatatttattcaccaattacacgtctgatctcaatcatcattactcctagctacagtttgttcggtttcaaatcttaaatttaatccattcaaaaagtttcagttttactgcataagaaacatctcagtaaaaggaccagttgcttctggtaataacatatcccaaatttctgtcaaattccacggttgcagtatgagcagactgtactgaactctgaagatctcaagaaatctcaaaccgatcatacgcttgattagcagaacgatatcttcttcatggacaaaaatgagtgagcagtcagaagtctttctttcagacgatagcagcctcctactgatactgttcatgcatcctgcttgtgcgtttggatctccttcctgcaatttcatcttcagtgacagagacgccacggctgcgaaggatcgatggtgacatattcttagctaaggtgatggactgatggtccattggaggaccgaaccaccagctatcaccttatctgcaatttggatctctttgtttgtaatatataccattattcatactctccttttctttgaaattctattcattacaactggcgtggtagagtcgcctgactgtatttcgtactatcaatagagacaccgtaaaagcgaaagggtatgtaatggttgcagtgaccgaaataccacgaaattctgagttcaaatctttatatgtatgtaaaaattgtcgcattataccgacagcctcatcttttagcttatgcttatgcttataagccaaaatttaaattttcaacattaaatttggagttgattttgggatttttttcaatcgtagtttatttttcagcatttgcttttagatcgttaagaacacgtatataaaaattttatttataaattatttttcgtttgcaaatataccgtttcgcttataccgtcgataagcgaaataatggagtcccgatcgagttagttgcacaagtggtttagtgtagtacttataatctgcggggaccttacatagaagttaaaacctttgcagagcaacttagcaacaagacaatcgtcatgcaatcgtgataaggttgtagattaatttccatgtttatgtatgcagtgtaaccatctggaatattttcctgcaagcatccggacaacgctgtcaaaattatctagattacccgactttctccatggacacacaaatcatgagatattgtacatgtagaaaaaaaacgaagttgaaaaatatgatgttttaagatggaagctttattaaactcaaatagttacattacggtgatacaatcatagtgaaaatactttttttagataagggtatttttactcggcctctacattcaaccggatatatgtaacatttttaaattaggaacttggccccctaaacagtccaatcttaaattcgctcttataaaaatttgaaccaaagaatttagggtgctactcatgttactgcaccattacatgccatttcgctagtgaaaatacctttggcctatgtctataactaagatgcatattaagaaaaaaaacctcaaatgcatatgttagttatctttaaaaaaaagaaatacggaaaatgttaagaaccgccaatcaatatacaagatcatagtccatgctcctaggtacaacactcgaatgttgtaactagtgagccgtccgatcctggaggagtggtctggattaattaggtgcgagttgattaattcctcgtttgatagggagagtgacaaccacatgccgtccaccactagcgagctagctctgccagtgtcacactgccagtgaagcaagttggcactgtcaccaagagagcggcattgcattgcatttgcgtgtggaaattacactaagctgatgctaatcctgcatcatgagctgctcatcaactaaatgaccctcacttttggtaattaatcccttccttcaggaaaaagttggagattcagacatcctcaaatcagaacacagtagactagccaaatttggttgcccagctcatcctgatactttgcactaacagaagggttcttgatgatcaagtacgctttgatcaggaaataattggggatggctagtgggaaatgaccaaatatctcaatcaacaaagccaatcaatctcacactgcaaaaactaaagcaagcttttctctctcccggctgggtgcgtaataacatgatccaaaaagacatcaggtagtactcttgattgcaatttgcaaactaaccacccaaaaattatattgatatggtagaaatataatagaaaaggtacttatctagtttatactatatatgcatattatgtactgagagatctgggtgtcatgtcgatctgatcatctccaattctttattaattagtcatgtataagttgttgagtcatccattactgcctttttctttttttttctttttttgataactcacagccttaaattgtttcatatacttccagttcactgtattggaacaatgtaacattatgagaattgatgggcaatcaagaaatgaacaggataaagaatcattctcgtgctttgcatagtgatagcactgtagtgtatactttctgttcgttacagttcatatggccttctctagggaggcccatctacagtgggagcccagaagcgcggtgccaagagcggggcccacgacagcaccaatgtattcacccatctaatctgcaccgtacaacttcgatcgaacgtctcacggagatcaaagcgagtcagagttttactctccgatcccccttggatccccaccgctataacgtactactccctccgtcctaaacaaacgaatctaaaatagaatataccacatcctattacagtgaatctggataaaaggtacgtctaaatttgtactactagaatatgtcacatccagtactaagttggtttttatgggatggagagagtagctccatcctataataagcgcagatgtgggttttagtgtctaactttgaccatccgtcttatttaaaatatttttatgattaatagtatttttattgttgctagaaaaaatgctcgtgcgttgcaacgggtgaatgctattttaattttattattgttatacggtttagttaagatgaaattcactttcggaattcgcttggatatttttttagaaaatcatgaactgcaattaggagtctgactttcatctcaagttagcatgcgagtttttttaaaagatatttcttatacgactccttttatatttctaaaagcaaaaaaatttaaaatccgactcaaatacagatctatattttgaaaagcgaacgaacttaaaaaccgactcaaatacggatgacataccaaaataccggcaaaaacatctttaatttttataatagtaaagattagatgataaaatataaatagtactttatgtatttatgacttaacttttaaaattttttataaatttttcaaataagacgaatggtcaaacgttaggtacggaaacttatggctgcacttataatgggacggggagtattactgtaacgaatatacgctaacacgtggatccacccgccgacggcgccactccggccaccggaaagccgtctccgcttttctctggatggcggccatgcatccgccattgacggggtgaggagctccatgaaagcaagcggtggctcaaaggttcagagttcagaatgggcaatagatgctacggcatatccttgtgctctcacagtagcttgaagtcctgcttcatagtctgtaaaaaaaaaagaaaaaatttgatccatagcacataaaaaacccggtaaaaaaaatagcacaacaaattttccacttcgactaaaagcacagggcaccaattttcttgcgattcatagcactcccgtcacatttgtcatccaaacatgtgagttgatatgaaaaaaaactcatctacccttcttccccgagctagtgctcttctccctcagcgatgttgccgcgcccgtgtcgccgatgctcggtgagctgacggagccgcgcttcccgcccgtccgctcgcgaatcatcccaacgtccgccagcgcgcgctgcaacctgcctgcataagcggcaggtcatcgtccccgtcattgtcgtccccgtcgctctcatcgtcgtcgtcgtcacgtagaagcagtggcaagccggcgcggcgctgcgccgtggcgagggagaggctgttttgcggtgccgagtatggccaccacgggccacatccatccacgtcgaagctacggccgcccacgtcatcgtcgtcaagcggccgccggcgtgggaggcttgccctcgatcagcagcgccgagtgccagacgggatccacctcatcgtcggtggcgacggcgagccacgcacccacatcattgaagagcgcacgcgcagctcgctcggcagtggcgggcgccgcgcgccactgtccatgagggagcggaagagaagacctggtgggtaacgtggggaacgaagggcaaatgtgtccgacgaaaattttgtccactccgatctaacgccgttacttcaaaatttgacggaagtgttacaaggcgaagaaaaatcggtggcctatgctatagatcgaaagcggaaactttttgtgctattttttggtaccgctttctttcctgtgctatggattgaattttctcaaaaaaaaaaaagggttgtggaagaatttccacggttttcccaggtggattattattcacccgattaagtgagacaagaatatacatagctagtcagattgatcataaatagcatcgcatatatcagaataataagtatcttgtatcgttctgtattgtttggggtttgctgaaatctgaaaaatatactacacatgttcagagttcacaacttcagactgacccatttcaatctgcgcatacagagatgatacatattcatacttgttttttctgcaaatcttgtctgcaatcggaagtgtgcatacatgtgggatgtgttctgattattgcaatcggcagcatgcatccatacggctcggtttgtaggtgaagaactgaagatacaaagatttccaagagggttcggagttttattctccgaacaccttgggtctccaattttttttatcagtaatttctcctctcagtagagtaagttcggcccgataaaattccaaatgcgtgacatgtatgtataataaaatgaaatccaaaatgcctatgtttatttcggtgaatatatttacctacctgacgattcactgacgagcatgtatgcaccgctatgaaggaggcttcaagttcagaatgaatcagatcaatagacggtacagatacatacttcagacttgctaccccatttttcactgaagtacaccacccctctctgaacttctcatgcaggagtaggaaccacacaattgatagagagattgaattagcatgcccaaggggggtctgaacccccccttccttttttaaaaaattatcttctaactgtccactacttttttttagaaaaaaaaaacgaagcccaaataaatatgcacaagatcgatgcatgtatgcatgcaacagcttccatatccatgcatactgatcgatatggcatatctccagagttcagaaattcagaccaacccattttcttacagttcaaatctgcgcctgatcaacggttcgtttttcaaactatctttttctgcattgataggcaatcgtgtaatgcagaaaaacggttgcaatcacagattacatatgatgcgtacgaacgtgttgctaaatggaactaattcaataatcatacgcttcgtaggcaacccaaaagaggggtcggagttttcttctccgaaccctcttgcatcccccaatttttcaatttgtgatcttcccactggctttttttctttcttttttgaaaggaaggtaaattaggcccgtttaaattcaggcacaaaagcagcaatatgaactagtggctcgatcaaagccggaaactttgagacacctttgtgcctaatagatattctgctgtgtcctaacacaatagcaagttgcaatgatctgcttcacactcgagaggcatggaatctccattttcctttagagcacacaaccagatatactctgcaactttaattgactttgctatgttcagtatacgatggtgtttggttggaggggctaaagtgggactaaactttagtccctctcacaaaaatataaatctctaccatagagacttatacttttgtgagagggactaaatttagtccctagttcccaaacacccctatgtacctcaagatcatgcatggatgcatgcttgctgctgactgatcgatcgattgactgcaagttccaactaaaacagtaacgtgaaattgcgtctacaccaatgtgttcatccatctaatcttgaccgtacaactttgatcggagatcaaagggggtcggagttttcttctccgaactcctatccatacacgacggtcatggatgcgtgcaggaagcttcaagtacagaatcgatcgagagatctacatgctgattaaatggaagtaatcagatatccaaaggagttcggagttttattctccaacctcctttgaatcccattattttttctttgatatcttcccactgactaatttttgttttgagagaaaactaagcctaaagtaaatttggcccggcccatctaaactggaaaaagttcacgtgcaagttcagtcttgacaacttcagaccggccaagttcaaataagcaccttaccgatggatgtttcagatgcaatgccgagaagagagggctgcaattgcaatggcaagctacatacgctcatatgtacgtgttgttaaatcctaaatgcaaccaactatatactgcgtaggcaactcaaagagggtcggagttttcttctccgaccccgcgttatcgccaatgaaaatcatctcgctgacttttattttttataaggaagctcggcctttaagtaatatttggtgagcctgaaaattaattgatacgatgatcacctaaacacaagtgcaagttgcaatgatctgcttcacactcgacaggcaaggaatccccatgtttgatcgggcaaaatagatgcagttgatgtggttcttggaagcctcctcggttcagtaactggaaagttgctgatgataaaaactaaaaagtaagacctaattatcgtcctctacactaatatatggattaggtccctatgacttttatggttatcgaagcagaagctagctactacaagattatggttgcaggcagtatttagaactacgagtaacagtaagcaggccacaggacaggagacatagtaattaaaatttacttatgtttcttcttcttcttcacagttcacatggaaatcagaaggaagtagcaaaaggaagagctgttctacactcgacagagtaacaaactaagagagcaacacaagtaacaagaggagagatttagtctcttttctggtgttctgcaaataaaactctcccctcttgctacccctaaaccccaacccaaggtagtagtaagtcaccccactaaaagtaaccggccatctcttacaaaaattggctgtctcctttgaatcaatcgaatcagatcatcatcatcatcatctacagctcgtcatgctcgtcgtcgacgccgccctcgccgtcggcgccgccacccggggcgccaccggtcctctggtagacggcggagatgatggggttgcagacggcctcgacctccttgagcttctcctcgtactcctccttctcggcggtctggttctcgtccagccactcgagggcctccttgagggcctcctccaccttctccttctcctcgctctccagcttgtccgccagcttgtccttgtcgccgacggtgttcttcatgttgtacacgtaggtctcgagctggttgcgggcgtcgatccgctccttcaccttcttgtcctcctccgcaaactcctccgcctcgcgcaccatccggtcgatctcctcctggctcaggcgccccttctcgttcgtgatcgtgatcttctccgacttgccggtgcccttgtcctcagccttcacgttcaggatgccgttggcgtccacctcgaaggtcacctcaatctggggggtgcccctgcaagtttaaccaacagatatcaggcgctggattcatttatccatttgagtaagctaacatttttttctggacatgagcaaaccttggtgctgctggaatgccagataggtcgaacttgccgagaagacggcagtccttggtcatgctgcgctcaccctcaaagacctacaccacaaggcgagattcagaggcgttaggtggtctgagctgaaattttctgaccaggatgtaatgtcaggactcaaagaagaaagtttgcttatgtctgttacctggatggagacggttgtctgctgatcctggtaggtggtgaacacctgggacttcttggtggggatgacggtgttcctggggatcaacttggtcatgactccaccgacagtctcgataccgagggtaaggggtgccacatccaggagaaggatatctgcgtaccaaaatcaaagcacgataagtatatgcaagacagatgatcgcagttgttaccaacccaaaggactatgtatgtgatcaaggtcgaacctttggtttcgtcaccgccctcgccgctgagaatgcttccctgaaccgcagcaccataggcaacagcctcatcagggttgacacccttgttgggctccttgccctcgaagtagtctctgaggagctgctgaaccttgggaatcctggtgctaccaccgacaagaacaatctcatgaatctggctcttctcaaggccagcatcgtccatagccttcttgacaggtcccatggtcttgcggaacagatcattgttcaactcctcaaatctggcacgggtcagcggctccgagaaatcggtcccgtcaaagagggactcaatctcaacacggacctggtgctggttgctgagggccctcttggcacgctcagcttccctcctcagctttccaagagcacggttgtccttgctgatgtccttgctgtacttcttcttgatcaacttgatgaagtactccatgattctctggtcaaagtcctcacctgaagagatgagacagttcagtcaaatatgaatcacagtgcactatccagataatcaagacgaccaactaactacaaaaggcatgtcattagtttaaaagcaaatgaatagtgccaatcttctaaaagacagcgtgcctttactgaaaagtctaatgagaatgtgcaggtataagataaccaatttaccatgatgtgttgcatgaaaatcattgaatcaaactacagtactctacaactgtgatgttgtacagaagcagatatttagtacctaagggcaaataaaagcagtcatacctccaagatgagtgtcaccattggtggccaacacctcaaacacaccgttgtcaatggtcaagatactgacatcgaatgtcccaccaccaaggtcaaagacaaggatgttcttctcaccacccttcttgtccaaaccgtacgcaatagcagcagcagttggctcattgatgatcctagcaacattcaggccagcaatgacaccggcatccttggttgcctgcctctgcgcgtcattgaagtacgctgaaaacatgaaagagcagaagtgagcaatggcttccacagaatcaccgcttgagttaactaagcacatgaatgtcttgtcattactaaccaggaacagtcacgacagcatcgttgatcttcttgccaaggtatgcctcagcagtctccttcatctttccaaggatcatagcactgacctcctcagggctgaagaccttgttctctccatccttgatcttgacctgaatgtagggcttaccgtccttgttcacaatcttgtaggggacaagtttcatgtccctctgaacttccttgtcttcaaacctgcaagaataattatacaggtcagatcaggcagcagtgatcaacaacaggaaataagagcgagcatagggtaaagtgccattactttcttccaatgagacgtttgacatcgaagatggtcctctctgggttcacagctgcctggttcttggcagcctcaccgatgagcctctcgctatcggtgaatgcaacccatgagggtgtgatacggttaccctggtcattggcgataatctcgacatgaccattcttgtacacaccgacacacgagtaggttgtaccaagatcaataccgatcacggtaccgagcttcttggtctcctccttcgcaacagaaaatgcaaacagggatcctgcaaacagaggagcagtggcagtatgtaagctacatgttctatcaattcaccatttatcgtgtattggcacacatatacacaggcatataattcatgtgattttaaaacagtaacatgaattatgagaccaagtaagtttctaaggtgaaaatctaggcagcccgtttcattcatgccattctagcacattttgcgcctctaaactattcagtgttgccctagaaatattttactactagcatattcagcataattgtgaaggtaaaaactctaccgctaccaatgcacaggacagatcatggcatcactgcaattaaaccagtatctaacaaacgaattccaacaaaatcactgagcactactaggataaatcataaataaaccccagatcacatatttcttggagtcgccagactcgccgccttcacctattggtggcatctaagtttaatcgcacctcaatttgtgaagtagtacaaaaaaaacaaatatcaaatatctcctaactaactaccacgatccatacgatccatcagtgtcactctaaaaccatttaccggaccatctcgttgagaaaaaaaaaaactactcccggatccgtgatccagtggaacgaacattcacagcccatcttagatcgaactccagcacaacatcaaatagacaaatctaagcgcgcgcaagcacagatccaaacgaggaacggggagatcgcacctgcgagcaggacgccgagcaggaacgcgcatccgcgaacccgatccatcgccgccaacaccaccaccaccacgcgctcgtctcctcctccacctctctctcgaagcttctcttctcttctcccttgtgcgagtttgggttgcgatccgaaaaccttcaagtgagtttgagttttatgggttcgtgggcgatttataaggggagatgacttgaacgggccgagatctagttgcgcccccgtcgcgttggccgggacgtcatgagtctgacctggaccagtccgagcacgacacgtggatgccccaaccaatcgcggtggtctctgtgctgggggagttgcggccgtccgtgggatcgatccgacggcggagatcgtcccacggcgtgaagtggtgggattggttgggtggcgtggctccccgctcgcggctggtcgggacccgtttactgggcgtggcctccccggcagctgacatgtggacctacttttttaatcggcccaattagatactcctagtttggcattagtttgaaccggtttcgtggatttgccatcacaaataaagggttgttcagattactgttaaaatcaagttagtaatattgtcaatttggtaaattaggattatgtgttgttgccaaaattttcaatgcaataatatatttgtcaattttaccgaacaatgttatgtcttaaaattgcaacaatctcaacaggcccaatgtgtaattgcatatctccatcaaaaacggttgaaacccattatacttgctattgaactgacagattagacgaataccattagaaaattggtttttattaagattagggcaaagatgcctttttgttgacgaaaaaatcgcacactgacctgggagatctgcttagctcctgtgcaggtacaaatcttgatgagatgtgggcgttccagtcaatttgatcctgcaactaacaagatatgcaaatagtagatcaaaacagccgatcggctaacaagccgatggagtagttatagctaatcgccaataatagccgatgctgataccagccgatagcgatagggtttagagcaatcggctatatgtccaatgtagattctaacactttagtaaataatgttatataggcaatcggctactgataataaaatataacaataatatagtccagtataaaccaatcggctagcattgatatgataaataagcatcgatccgaaggttaaagcatatatcggctggaggtccgatgtcatgaaatccacaagattatattaaacagtgaaacctctgttgtcatcggctaaatccaacttatatgtatatacaatcattatgagccgatgcaacgtccagataactcatcggctcaaaccccgatgaaacccttattggcagtcaaaaagcaggctagagattatggttctaaacacgacttagtagatcaaactcaactgatgcagcactaagtatgaaaagaaacataatatctagacaatcaagccgttgactaagttttcagagtggtagatgtctaagctaatctaatctagcaacacgatttagccgataccggcagaaaccctaaaacgagaagcaaccgatagagctaaattgatatgctaagactagattaacagagacatatgataaataggtaggcaaatatatcatcgaaaccagagcaatccaagaggtcgaatgtactgatgcagccttgaacgacgccgatatagatgagacaattgcttgggccgacggaacattggacttaccccttcgctggagatcgaacatcgatgcagccccgcgtcaggtgccaagtcccgccggacaataaaataaagtagaaaaggtaaaaggggtggcaatgcgacgaattgtattgatcgtgaggatagattacataggccccgggtgtacatatttatacccgtgggttgatacaagtccttgtcggacaagaaagaaactaacctaaagataaaaggaaaacataaagtccttattggacactaaacacactttcctaaagataaaaggaaactaacaaactatttctaattaatagataacttgccacgccgcatcctctttaaactcggtcacttagggataagcttcctttaatagattgatttccttaaccgaatatagcaggaatccgactattggcgacttgataactcccatcggctgattccgagatgctgcagccgataatgattctaagccgatgacgtctttgccgattaccaaatttcactgttaacacctttcccatgaaattgaaagattaacacaacttatccaaaatctagctattgacaaccttgactacacaatacaacattgatagaaggttacaaccatcttcctcctcctcctgcaggtgatgtagtatggctttgttgttgttgcctccttttttaatcctattaagcatatcactaatttattggtagtggattctaaattctcgatggatatcctcttgttgtttgcatgtcacctaaatggttacgagaaaaaaatataaaaaatcaacaagatagattaatatatgaaaaatcacttcacaaatatgtaagttaaaatttaacttctacaagttgcaacggaaaaaaaattaaattgtggctagttaatgtatattcgcagtcaaatttgtttttcgttgcaacctgtagaagttaattttgacattgcatgtttgtggagcgatttatcacatattaatcaatcttgttgattttttttaaaaaaatcataactatttaggtgacatgcaaataacgaggggatgtcccctcaagagtttaaaatagtttcccttttatcttatactaggagaaattttgaaatatcacacttataactttattactatcaaatgggtcaaattatactaaccttcgtataaaaatatgagctagaaatgtctgaaaaagttatattctggtacagatgtggtaacattttttaattggaagaaatttcacccaagaaactcattcgactgaataaattgaggttgacaatgtccatcggacagtagtacaagacgcaagtttaagcagacatgtgttgacggatacagtcccaatttgtcattacgccttcagaaaatgtgactcttcttttgaccatccaacaagatactacttccaaacaaaaacatgctcatgatagtggttgattctttttggacagagggagtagttatttttgcacaagtagggataatttaaacaaaacagttgcttcaggtacgaccttgtcaaaaagaaaaaagcacttgccatcacatcatttttgcatggattcaacaaatcttacactatggagagcagatttaaaagagagaatgtctagtggaaactgcaacctacgtggaaacatataaactacagttggatagaaaatgtacatcccatatatgtccacgtcgtccaagttaaaatattcagaaaaaacatcacctgattctgacatttagcatctcagtccccacatcaagcagtatcctgattcaaaagacatatccccaaatatgatgatgtggtagtgagggcaagggttgcggcgcgggggtggccactcatggaaaggagatggcagtggtcgctagcagcgccaccatttcacgcaagtcacagcaacacgaatcaatccccattatgctccggtgatgtcgaggcatctaccaacggggttgcctagtatttgtcgtttgctcctccaacattaggtcattatctcctcttaatccttgctatagtgaatgcatgttctttcatgggatatgcttcttgttgatttggacaccttcccaatttcaaatgagctagggtttcaatgccgccggcactcccaatttcatatgaactattgatgctgccaagacagctacaacttccatcgcatgtccttccctctatcttggaatattccctcattggtagaccagaaatttgctcccacacaaaaggtattaatggtgttcctctatattgttgatgttcgttgagtttgtgatgagctagtcttgacactcttctatgaatccatctctctcacaaacaagatgggatcagtttgtgttgatgtcttggttgctttgagccccccattttgttgtgactttcttgcttggggaaaaagcatattattttcattaagaaaacctgaaatgttttcttttcttcttttctttgctagtaaaatccaagtactttgttgggttgttatactttcctaataagtgaaattaattgcagtttattattgtttcggtgcatcaatagattccatatgtatggatgaccctctaacattcttcttggaatgggttgttagcattatatatggaaaagtaattatatatggaaaagtagggaaaaagaaggaaccattgtgttttggaaacactttgggcgttgggtaaatggtgtatatgaaaaatgtacacaacatgatgaggagagtattttgtaaaatgtatcgtggggatggcggggctgacaagtcttcatacaggctgcacattttggatccaatgatccacgatcgaatttacaattttccatgtaggttgcaatttccactaaatacatatttttcctagatcttacaggcactcttcaatctaacttctcatttatgttatagactatttttcctagatcttaccggcactcttcaatctagcttctcatttatgttatggactatttttctaccaagtacaacacacgggtagcaatgtctgggtgatttcaacaacaacattaaattcgctggtataatctacctccatgtatgcctttccttgatgctccaccaggtcacttatccgttctgcaactgatatttcacaaacaataacaacaaatcaaacaaagacgacaaaacaaggaaacaataacaacaaatcaaacaaagatggcaaaacaacgaaacaataacaacaaatcaaacaaacaaagagggcaaaacaaggtatgacttactgaattttttcgtaagttgcgatgctgatcctgctaacgatagcctatatattagctttgttgctcaattcatactcaatttttttcagaacaacatcaataaatgtccttggatgggttgcaagataatcagcaattaagagttgctcacgcggtttatacagtgttttatcctataacctcataagtaatagtaggtcaccgaccccctttgttatgtctcattgtgtagtacccattaatagacccatgcacatttgaattgtctgtccacacaactaagttgtcaattcccatatcttcacatgttatgaaaccaaattcaactccataagctcatgagtatttttacatgaaatatctctaaagaacttggcaagttggaacttctcctcaaaccatatggtaatttaaattgttgttttcccaatatttcccgcttctccatcacgaaacaatgcatcaactaataatttatgaaatcctttaattccatggtcaaaactcagtctcacaattgcctaatttatgaaatcctttaattccatggtcaaaacgtagtctcacaattgctgatgttattcaagaagtgatcccactcggcacagtccacgtaatagcagagaaagacattactcaacattgtaatagctaacaataatcaagcaaaagaactcgcgcatacatatgcggtggcatgtacggtggtatgcttatcgatgagctaaagtaagaaaatgttcacgataaaattaaatacataccacctaaacctcgtgatgtagaaactgcaaccacctgaaactcatactaatttttacctatctaattccagcagtaatgtgcaagaaaatttgaaaacttattcagcatgaaggcttaacatacattggataaactaatcaatgtataaatgtcataaatgagctaaaactattgcagaaatgctgctgagataacatgaacagcctcttaaatccaatgttgagacatgttttttttcttctggttttcagttgtactcgcttttcagttggagactaattagaattttaactgatcccaaactaaactaaacatatcagttttgtcatcgtttatggcttcaccaaaataatgctattttgttctgcaatagattaacaagcaccaaggaaccagaaacacgcaatataaatgatcaaagccagagaaaaccattgaaatgcaaactagtacaaaataaaggtgcaaagtcatgtcccctatttaatatattgctatatcactacgcatagagcttatgtaatttatcccgggttgtggagatgcttggggccctcttctcaggccccctaccccctcttatataggatgagggggagggtttacaaggaaaatatctagttgattgcaactagatctccttattctatttataaaagatatgcatgatccttgggatttatatcttatcctgggaatatctcttacttaatttacaagtagcctagggctcttggcccaccctatgccacgtggcccaagggcctctccttggttacccgggtaccgtgtaccccacaaatttagaatatgatttttttttactagtgcgagaaatttcatcctgctagctattgctgcaacttattgaaatctttgtgttcttttttagtgttagaaagtatgacgtaatttgttgccttcatttgcaagaaaatcaaacaaaacaaatcaggtgcatttagatgctattgtccatttttcttaatattgtatgaaatccattgcatttgtaaaaactgaaattcgaattattgaataaccaaagattcaatttaaatacatgagtgcgttgtgattcatgatccataccttttgatgcttctagattccagttcagaaagccgagacaaggcatacttcatgaaacccaatacgcttccattcgatgtgattgtaaccctgtaactatgttagcaaactgttctattgcctaccaagtaccaactcgtatggtattgtcacaattttctttaaattcattcttttcaccctctcctggaaaccattggttatatgatgaatgatattgcatgatatattaaatgtgtctatatgatatatgtattgaattctcccgtttcctttttcatttatcttatacaaaggcataaatgtcatgcagttcccaatgtcgaggtccttgagcatgtttcatctattcttaaggattttgggttttgcctcactagagaaggcattgatgcgagaaacctgtattgctctttttttttgcaatgattctgcatttagttttcttgatcatgtattattctttctcttattcttgaagccgtccctatgactgcaattttacaaaacatctgatagagagttacatgataaaggtttgtgttacttatttctacctttactttttgttacttttgtgaagcgatttggtatgtgggcggcttttcacataaacagttcccagtggctctataagaaagtcattaagttaagagaattatatattatatatttacaatccatgtggatcaaattccaaaattatataaatggatagaagaaaaaaaggtaaattacatatatcgacaagggcattttgctagtattaaaaagaaagatgctagaagtatgctttctcattgaaaacatttatatttacgtcatcctttttcactttcttggtgcttgtgggaaagatgtttctgccatgctctgtctgatttatcatcttgatatgttagcaagaaaaaagcaagcagcaagtaattgtcaaacaacaaggcccttcggtactgctgcattcatgggcaatggatattctcgtaatccaaatcataatcttttgttggaaagagtttggaaaccaacaagtaatcatcaatcaagtaggctctttggtactgtcacaccccgaagttctcctcccaagcctaaatttaatttataaatgaccctaagaaaataccggtgcaaagcaagagtaaaccccttttaaatcaatgcaagtaataatcggaatgggaatgtggaatttttcttgagttctacatgtcgaaattcactaacagaatttttagtgaaattttcagagccctagaaataattttaaccaattaaaattgagcaagcaatattttaattccagggaaaatcctttttttcctttttctttttctttttccctccctttttcgaatgggccgctggcccattctctcctttcctccccctcctccctgctgggccggccgcaggccgaggcccagccaggccgccccgccgccctcctctcccgaggtcgccgacaggtggggcccacctgtcgggtcctcccccaacctcccgtcccctccctccagccggcgccgccgcgcccatgcctccgccttctccgggccacgtcagccacgtccgcgtgtgcgccgcatctcccgcgcccactcccctctctctcgcgcccgcgcccgcgcccgagatggccgggattcgattttcgaatcccgcctctctctcctcccccactcccccacgtcggccagcgattcccgcctctcccggccacgtccggccccctctctccctatttaagctcctccgtcgccccctctcgctttttccccatttcgccgaactctcccgagcctcccatcgctcccgcgccgtgcaacctcttgccgccgccgtttccgccactccggccgccgctagccgccgctagggtcgccgccgcaccgcgccgtcgcagtcgtcgggttcgcgaggctaagctccaccccggccgccccttcctcgtcgagtttcgtcaccggaattcgcatcccctcgcgctccggtgagttcaaccgctgccgccgccttcggccatgaatgccggtcgccgtggttcatcttcccccctctaatctctctcttctccttccttagggcaccccgaagctcgtccgccggttgccgtcgtcctcccgtggcttgccgtcgccgttcgccatcgtcttcctccgcgccggccaccctcggtgaggcatccctcccctcttttccctttcctctcctcctagtgccgcgccgccgcttcaagtcgcgcgccgtcgccttcggccgccgccaccgcctcccatgccgccggtcgccgccgtcgtcggccgcgtgccgtcaccgctagccctggccggccggtcggctttgatgccgagccgagcccggcggccgcctccatcgccgcccgtccgatcggccccgagggcgatctgggccgtcggttccgtggaccggcggtggaccacccgcgtggtcctggtccacggtgaaccgccctcccccttgagtcgctgaccggtgggccccgcgtgccggcgccccttcctccctctcccgagccgctgaccggtgggccccgcatgtcggcgccgctttcccccgtgctgacgtcagccctggaaaatattgcgcaataaattatttaaggattttgttatagtaataaacacagtgaatcttctaaaattcataactaattcatccgagctccgtttcagcccattcaagtctcagtaaatcaagaaaaatgtgtagaatccattaaaaatggttttgttccctgtttcagtagtcttatagcctgtttgcaatgtttgctttgtatgtcgctagattccggttcctccgacgctccggtgtacttcgaaatagtcgccgaggttcctccagcagcagagcaaggcaagtcatgcttgtcacttgaacatgttgatcctatattgcaaatgctctattgttttctttcaaatactgcattgttttataatgtttctaggggatgtttacctattgtcatagccatgctattgttgtaccttgtccctttgtcagcttggggttataacatgattagagtttggactagggattgcttagccatgcttagttcaactagttcaatggggaagatcttattaatgtttagactgttggttctaatggttttgttggattagtgccaccgctttggtgctggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaaaggtcctgtcatggcctctttccggtatgtcgtggtggcatgtcggcgcacggaaacgtgtcgtggggctgtgtcttgtgggtacagttgtacacctctgatcagagtaaaactattcgaatagtcgtgcccgcggttatgggcggtcaaccagattcaccgtgattagtctcaccctagtgtaatcttttgaatttggatagtttgggtggatggttgggcctgttgcaacgtgggatggcgttggacagtggatagtcaatactaattaattattacaactgtttaaatctttcaacttctgtttataaatgctcgttttatgcaaatgaaccactctagctcttctttgataattccctgcatcatacccctattccggtatgacttgctgagtacagtgggtagtactcagtcttgctctatttttcccaaccccagagcacgagtatgtgtcagatgaaggtttctccgaggagtaggcttcgtccgtgccgtcgaggatgcctgtggagtggtgttcccgctacagttctagtcaaggcttagctcctgttgtctttcgtttttccgctgcatttatgtaagacttttatgatgtttgtaagacgtggatctgaatgtcaacattgtcgtttgtgtaccccggccggtcctggacggggattttaatgcacattctgcttgaattctattcaggaatttctgggcgtgacaggtaccgaacgaattgaggtcgacattgcccatcgaacagcagtacacgacgcaagtttaagtagacatctgtcgacccaatttgtcattacgacttcagaaaatgtgactcttcttttgaccatccaacaagatattacttccaaacaaaaacatgctcatgacaaatacagttatttttgcacaagtcggaacaattgcttcaggtacaaccttttcaagaagaaccaaaacttgtaatcacatcattttttgcattcaacaagtcaaataattttgaggttccaagaacagtggtcaaaacagtaaagaatcaaaatacttacaactcacaactcaaactgcgccattatgctacaaatatatactactagtaggcttcctctaaaactgctgcactttctaaattcagaccaactacttacaacaaaaacaccacggccatctaactaccaacgtgagtgggctagcacacccctttacgacaaagcattgagccattgacaccatgaccatcacaatcagatgcaaagatgatacggctaatgagtttggctcgaatcatcatccccaccagaaagcaaccagcgcaggtactcagttccattgtccaacgacgaagcgtcgccgtgcatggtcaccctcttgcgcgtaagagtttcgacagtcacagctttcctcttccgtccacctctcggacacgagagtaactgctcgtccatctccgtgaagtttgcctggatgtggttaaagcttgtcagtttgtcactcaaatgatttgggcaagcacaagacgcgcgcagaagagctaaagatcggttagcaaaactcacctgagtgtatacatgagcgctggatttctcatggttgtccctgacatgcttgtatggaaacaccttttcacaccccgtgaatcgacatgcgaaaggttttacttgatcatgggacgcctttatatgtttggttaaatttgatttctgcaataggagggacaggtaacaagtttcaatccacaccagatacgactaaagctacagttcaagaggaagacaacaaacaatgcatcagaacatttggggataatagacttacattggaaaaagagcattcacagccctcaaaactgcattttatcctttcagtagatggcacctcctcatgggctcgtaggtgccttttaatgttcttcttcaggtgtttttccccacagatatcacactgaacatattgatggcaagcctgattatgagccctcaaacattcaacatttgtgaatgtcttcatgcagcctggttcacagcagactacttccacgtagtccaatttcactgccagaacagcacaaattaatttaattctggggataccattagcatgattaattatataatgcatggattgagctgcagttttttagttctgaaatttacaaggcagcgcctgatctactataagtaactgaggagataccatgtgattcttcatgtttcttcatctttgaagcatacttgaaaaccttgttacagccctcctccttgcaaacaaactgccggttgcttttagtagcagtttcatcctcatggatttcctttacatgcctttgcatatttgcctttatactgaacttcctaccacaaccatccatagagcaggtaaacaacttcccttgatgcttaagcatatgacggttcaagtgatctttcctaatgtagctgaaagggcagtcttcaagtgggcaaatgaacgatctctacagtcaagaagggaacgagtcaaaactgaagctgctgtaagcttacacatttctttcatacttataaattatctaaaataaattatctagtaaactggttaacggaatatgcaacgaatacctaaatgttcagtgttttccattaagatgatagagataaaagggagtataatcaccatagcgagctgagaaccaatgatgaatagtcctagctttctgaggtgacattttgatgttggatcctctcacctcttctcaaagctcccaaaaggagatccaaagaaatagtaggatgaatgaaggatatttgctaaccttattctccaaaggatccataacctattctattcaatgcctactccctccgtttcaggttataagaagttttgactttagtcaaagtcagactacttcaagtttgaataattttataggcaaatatagtaatatttataataccaaattagtttcattaaatcaataatttaatatattttcataataaatttgtcttgggttgaaaatgttattatttttttctacaaactaagtcaaacctaaagcagtttgactttgaccaaagtcaaaacatcttataacctgaaatagaagtagtactatttatcagcaaaaagttgtgcacaggtgtttatcagctaaaacaattcatatataatttgcaacggaacatattgtagttttgtatatgatggagatatcaacaccatagcgagctaaatgaacctattacagaaggccctagctttctgagatggtattttgatcttggatcccctctttgttccaactaaggacctccaaaaccaggttccagaagcccaaagagagtgagagagaacattagaacaaaggagaagataacctcccaaattcactgcatggatccatttcacaagatttgcaatatcaaaaaaatgtaaaatagccagcaactagtcaataattaagcagtaatcagttttcaccatttatgcatgctgtaaaaaaacactatttatgtatatgtatgctgtaaaaaaccttgttactaataaaaattaaagatatcatgtatagcataccacaaggcaaattgataaacaatgaattccagcacatgtgcatacaacaaaggagacattagtacttaattggaaacaaggagatgcaggctatcccatgaagttgaataataatcaaaatagtaaaaaagaaaagaactaatacaagcaaggacaaacctcctgaaagagcgtgaggaggcaatcctgttggagcttcacaggtggtcatcccaacctgttactagtccagacaagattaaatatgcctcatcgcattttggagttctttgggatccaatgcttcacacagttaagaatctatatcctgcaaaacacttgtttttagcaaattgaagtagataagaacaatttctttgacaaccagatcagcggacggagaaaaaccatacaagaatgttatgtttaaatgtttccaaaaaaactaatcccagcaccattccaacaaaaaagcaatatcatgttgtatgcacatatgagaaatgccaacctcatcagagtgactttgcatatgctgcttcagatgagctggcttctggaaagaagcaccacactcttggcaggtgtggtcaccttcatgaacaaccttttccccatttgacttgtagatttccgatttgtccagttcttcctatagataaatttgaagtgagggcatcagatattcatataatgattcaaatggataagagcagaaggaattgacaaaagcacaaatatattgattgatggacctaaactccaatcagagaaccataacggtcaaataactcaatttaattaatacagtccacattgtctttaaaacataaggcataatatggcccatattcctaaaatatctaagtagttttataccttatgatgagcaaccatgtgagctcggatgagacattttttggacctaacaaccgtgcaaaattcacacttgtagcgccttatatccctgtgttgtgttgcttcaaccctcatgtctccatcaatatcatctccagagcacatctaatagtaggcaaatcagatagttagaaattcggcacacataaataagtcatttatatataaaaaaaagtaaacaagtaaaacattcagaggtagcgatgtagtcagcaagatagctgtaaaatgaggagaagtccataacatgaactgggacgcattgcagtctttactctttttttgacagagtgaccaaacaaaatacaggtatagcatatctgcaggtcgacatctaaaataaatctctacaattctgcattttcaatgaaataacatcagtgtgttacaactggctatcactaattggttaatcaaacaaatcaaaacaaaactatggtgccttgtcactaacaaaaagaaaaaaatatcagcatatcatcctcagttcggttagaggtcatcaaaggaaagaaaaaaaaaggacaatatgtgtttctagagcatgtgttctccatcagttaacactaatggagatggtatgggatccatcttgagatgcctagccatgatttccaaggtgacataaatttcccttctagcatcatgtgtcttgtcctctaccaaaaattcatggacgacaccatcaacttcaatccaactgcaacccggttttttgtatattttcctactcaacatctgcttcctcatatccaaagcttctttccatctgtttgataaggcatacatgttccaaagaagcacataaaccccatcatccccaggttctctctttataatttccattccagcaatctcagctaatctatcattgccatgagctaggcatgcactaagaagtgacctccaaataacaatatcaggctcgacatccatatgatctatcagagcttctgcttcttctagaagtccaccccgtcctaacagatcaaccatgcatccatagtgctcaagccggggatcaatatggtagacttcacgcattttatcaaataactctctgccttcttgtattaacccagcatggctgcatgctgacaaaactgagacgaatgtcacactgtttggaagtatcccagaccttagcatatcccaaaagagctcaacagctttcctcccattaccctggacagtgaaacttgaaatcatagttgtccatgtgaatgcgtccttcatctgaacttcttcaaatacagaaaatgcactagcaatgcttccactctttgcatacatatccatcagagcatttgtaacaattatattggtggtggcattagatttgcttccatatccatgaatggcacgtccaagatccaaagcaccaatatcagcacaagctgatagcacccctacaattgtaatatggttaggacggtggccctccaaaagcatcttaccaaatagctcaagagcttggataggctgcttgtcttgaacatgaccagtgatcagtgctgtccaagaaacagtgctcttcataggcatctgataaaagaatgacaaagctgaatccacaccaacacacttcatgtaaccatacagcatgctaccccaagtgacctcatcttttacaagcattctatcaaatacagtccgtgcaggctcaaacttgccacatcgacaatacatatcaaccaaagcattacaaacgaccaactcagagtccaatccacaccgaaaaatcaggccatgcaccacgctaccaatacgctgatcccctaatccaccagaggccgagagggcaccgacagcagcaaagccatcagggcggtggccagaagcaatggcgtgagagaacacggatatagctttccagtggtgatctaacttgagatgaagggacatgaggctggtgaaggagataatgtcagggtgggggatttcatcaaacaacctgcctgcgtcagccggtcggccaaactcggcataggaccggaagattttgcaggagatggactgctggttggggtggaggccgtgtgtgagggcctgggcgtggattctttggagctctcttatggttttgcactgggtgagaaggtggtggcaaacgcttctattcatcccccctctcctcaacgcaagaagctctcccgaacagcacaacctggaattagagctaaaattactaggaaaaaaagctacaattaactcatacgacatccacactgcttagactattaacaatttcgtgctgtttcaacgaacactgaccacaagcccagaatctaaacgcacagatcaggatcgatttggttaatactatctcatgcttttaactgctcaaatcgaaagcgaagaattaccaacgcgataaccaaatcgaagaaacatattcctaactcctaagtaggcatcggttttgggcatggtggttgtgtttgcaagcgaggattggatgcccaccttggaatctttgatgcgtttggactggaggagatcttggctgcgacgaggtgtgatttcccgcgcttctccgtgaggaggatggagcggcggcggcggcggcggggagtgaggactggggctcttggttcctcctcgccttcataagcggtcgcgccgaaaccctagagcctgggtgggtgggctttttcgcaggccgaaaatgggccgagcaatttttaagttgggcctgtactgatgggctgacattgctggcccactcgtgacgctcttctcctctggctcgatgacaggtggcccccacacgcggacacgcctcctccttgttgctttccgccggcgatgccattctcgccggagttcgcacgacggcgaggcggcggcgtgcgcacaggcagcggtgaggaaacctctatctccctatctatctatcgccgccgtgcgtttcggctcctgtttgttactgccattgttgatgtttacagtagcttggtggatctagctctagtagttagggatggaaagcaacaagggacactcaaaatgcagccttaaaatttcctctccggcgttgggtagtgttgggatccagcagtggcatggctatggtgcagtagaccttggtgatttgtgttgtacttgtcatagcttcctgtaggactagggttatcatggttgaatctgtagagaacccagaaatttacagggttgatagatgcaacctaccacctggggtgtgatgtggattgtagaaacttccaattacctcgccatttccaccagttatatcaagaacccaagtatcacggtgcctgtcaagttagacaatcttggtatattagaacatagtggttcagatatgtgatgccagcaccattggcattgtaaaaggctatgaagagggccaacacatcagcgatgatgatttacttattctttacctggttatgcatagtgactgctgttatttccttatgtgcggaaccatgattctgagccaccggggttctataatactgttgtctttgttggttcttctttttttttaagctatgtattttaagctccaaaagtttggagttagggccatgagttcttgtttcagtgagctctcttcatttgaactaaaataaatgtttaactcacttttatttcagacgataaactctatattttgcactaattcaagagttggggggcttggagctatgtaacaaaacttaattctttcaaccacacaagcaagttttcaaattgtcaaagttatttgcgaacttaaaaaaagcttgacatctagtagttgattagaataacggtagcctaatgcatacatagacccactacatagctatataattagctaattggttaactgaccaaatatatatgttaagctgtggtattggtggtggactgactacgccaaagcccctagcaactactgggaaacgggcttactatttctgataccaattgaattatgtaattaattttcaaataaatgaactatgctcgtaagttgctgcagttcaacacgctggggctagtaagctttggctgctagggtcactgcatatagaatactggtgaacacactaggtcggctggagggcatcgaggtcatctgaccccggtgatactactgtagatctgcccctcttgtactcgtagtgaaacaagctatttgtgttcatctattcaccacttgatgcttgcataggcaactatacatgtttggaactttgatgatggtgctctgctagcagatgaaaggcctcttgaacacattgaattgttgtagcctcggtgttcatatcttgaggaagaagaggctcagcatggcttgctgggatgttcaacgatgccgccatctcagacatgaatacgggattcatattaatgatgactggtagcgccttgccaccaccaactgcacggtgatcttctccgtctatgatggaattggttccccttcaaatgcatgctctgtcaatgaactctctatcagatcactcgctgactccaagctttttcccctttgcagttgtgcccttatcatctctcttgtagatcaccctggtaacgtgttcaagaaattgatctttagtctgaaattggacaagaatgatgaggtttgtagggatgaagaagctacatgtttggtgtgtgcgctattggtcaagaatcagaaccagtcacttttgtaacaggtaatttatggacattgcaaggtggatggtagagttttttcagtttcactctatttcttctttactactatttttagttccacaacactcatttccttttctttgcgtgagctcattgctctttatttggttcatggtactattaataaacatctgcatgtgcatgttatagattaaacactgaaaaaataaaacattgacaaaattaagaccagacaaataaactatatttggaaagaattggctggtaactgactgcctagctctctataaaaggcctccccaagtcccttcttccattgctgccagcattttgattctgtgtgtgtgtcttggttgcaaaaaccaagacatacacacagaatcaaataataacaaaggtttcctagcctcaaaggatacatatatatagtttccctacaatacaatggagcctgtcaatgatttccaggaaggcatttcaacagagcatgcctttgaggcagagcctgtgccatcattgtcggaaacaataacgccacgatcaatggtggtgagcttcatccttagtgtaactctcagcatcgtcgccatgaaggtcaccttgagctctggcttcattccgtcgttcagcatcccagccggcctcctcggtttttgtgtatcccgtgcgtcgatccgcattcttgactacttcgcagtggcacaactaccattcacacgccaagagaacaccatcatccagacctgtgtcgtcgcatgcacctcgatcacattcaccggtatatagacaatctgaaaatagtagttgatagaattgtgtgcactattttatgtttatctttactataaccgtacttccttacataggtggctttgggacatatattcttgcaatgggaaagaaagcagctgtaggggatgtcaatgcccaaaataacgttgaggagccaagctttgccaggatgatcaccttcctcttccttatcagctttgctggcatgttcatcatcatgcccttcaggaaggtcatgatcattaggcaccggttgacattccccagcggcacagcaacggcgcacctcatcaatagcttccatacacctcaaggtgtcaagcaagcaaggtatcatcaattaaactttacatggaaatgtttctgttggatcaagtactattcgaagccttagattacacaatcaaattgactatttgtgtttgcaggaagcaagtgacattattgtttaaatcgtttggaggaaccatcgcatggtcgctcttccagtggttcttcgcctctgggccgggctgtggcttcaaattcttccccacatttggcctcgaggcatataaacacgggtacgcaatcagacatgcatggatggaattcatcagctagcgtagtggttgattgggaaactaattttgttcccttttatcagattcttcttcgatttcaccatggccaatgtcggcattggcatgatgtgcccgtacatgatcgtgttctccgttttcattggcaccatcatctcgtgcggtgtaatttggccgtacatcgagtcaaaggagggcatctggtacccaagcaaccttgggcccaacagccttaacggcatcagaggttacaaggtgttcatcggcttgtccatgataatggctgactgcctcttcgtcttcctctgcatcatggtccggacaacatgtgccatgatcaagcggcgtcggcaggcaatgcaaggtggtggcggtaatgcgcagccattccagggtatcgacatcgccgatcagccggtgaagagcttcgatgatcgccgcagggcgcaggtgttcctccgggacgagataccggactcggtcaccattggctgctatgtcctcctgtcgatcatctccatcgccgccatccctcacctctacccacagatgaggtacagccatgttgcgctcatctacctcgccgcgcccgtcttcgccttctgcaacgcctacggcttcggcgtcaccgacatgaacctggctagcacctattgcaagatcgccatgttcgcgttcggctcgtgggtcggcatcaagagcggcggcgtggtcgccgccctggtcgccggcgggatcaccatgtcgatcctgggcaacgcggccgacgtcgcgcaggacctcaagacgggctacctgacgctgacgtcgccgcgcgccgtgttcatcagcgaggcgatcggcacggcgctgggatgcgtcgtcaaccccaccgtgttctgggtgttctacagggtgtacaagatgggcagcggcgacatgggcgacatgccctacgccaagctctaccgcggcttcgccatgctcagcgtcggcgacggcgagcaaggcctgcccaggcacagcatgctcctcttcaaggtcttcttcgtgctcgccctggcgctcagcgtgttccgggaggtggcgagccggaaggagtggcgcatccggcgctacatcccgagcaccatcggcatggccatcaccttcttcatgccgccgcgcgtgcccgtcggcatgtgcatcggcagcctggtggcgtacctgtgggagaagatggacgccggccgcgggcggatgctctcgccggcgctggcgtcggggctcatctgcggcgacggcgtcggctcgatcttgctgtccatgctgacactcatgggtgccagggcgcccatctgcatcaagttcttgtctcgaggtgacaatgtcaagttggacgccttcttggcaacactccatgacatgagatagctactagctagctatccatgtagggaaactagatcattttctcaggtgtcaaaacttttgtacatatgtatccacgtcataggggcttgagttaggagtcgtggcaaactgtataatcaagtttcagttcagtctataaacacagtttgatctcctctatcaacagttgcctcactgagtccatggttcaatatgagaatgcgtgcactgattttggcagaacccagaagtttgctttgataaactggagtccacatagattactagtactgtaactgttaaataaacctgataaaatgttaatttctagctacagtacaggaacattgcagagagtttcacaactgaccagtcagtcagacagacaacgaatatgcaagcacgcatgctacccatcttttttacatggacagacatcaaacgccttatttatacatttaattgtatcaagaaacaaatgaatgaatttaagggcatgtttagatcaatttgctgtggcagaattttttggcaaaagtttttgtggcaaaaattttggtattgaagttttgctagttggtgtttagatgcatgtgtcattttactagtaaagagagagagcacggctcccaacgcactatttagcaaaatttgctactctagactcccaaatgacaaatgccaaattaccaacttttgctaccagtatttagatccattttgaccaaaagtgcttctaaaacagaaaacttttgctattttggaggatctaaacagggcctaagaatcaaaggagggaaaacacttttaatcacttgagtggttgttcactcattcattgcatgtcaattcattagttataaaaaacttcaaaaatattgaaaaaatagattattagtatgattttttttctaatcaaactttattaagtttgaccaagtttatagaaaaaattagtagacatctaaaatattaaattagttttattaaatctaacattgaatatattttaacaatatatttgttttgtgttgaaaatagtactatattttttatatataacttgatcaaactcaaagaagtttgactagaaaaaaaatgacttataatgtaaaacggagagagtatgtaacatatcactccacaaattcaaattcgactatttatattgtaaaaaaaattaaaattgactttgaatatgctatttacatattaatctatcttgtcattcttttaaaaagattataacaatttatttgacatgcaataaacgagtgaagtcagtgtcccacttccatttgccattgcagttggtctcacaattgatcatgaatatgcaaagcacgcatgctatcaatcttttacatggacatatatccatccaaggccttaatttgtacatgtgaagtataacaaatgaatttaagaaccaatcagtaaagagagagagagagagtacatatgtatgctacaccagctgcttctcttctacacttacattacaaggctaatatatataaaccaatcgacaattaattaattaagtataatcactaaagaactaattaatcaacctacacgtacgcgtggcaagatcgatggaaggctagcttgagcttgaagtggatggatggatcatggcggcgtgggcagcgtcctgaggaagagctggaccttgtcgttggtggcggtggagaagacgcgcatgcacatgggcgggttgacgttggcgagcgagaggatggaggagggcagcgaccagatgccgtcgccgcagatgaggccggaggcgacggcgggggcgaaggtgtgggcgcggacggggtcgctgcgggaccagaggaagaggacgaggctgccgacgcacatgtcgatggtgaagaaggagccgaggaagaaagggacggccatgccgagggcgctggggatgaagtcctggatccaccacccgcgctgcttggccacctccttgagggcgcagatggcgatggcgaggaggaagaaggcgaggcagaagcggaggcagtagcgggggagctggtcccacccgttcacgcccaggagggcgatcccccggtagatcttggcgtacggcgccgggaacccttcctccatcccgatgttgttcgccttgtagaacatccagaacaccatcgggcttattatgcatcccatccccgtccccagcacctaatcatcatcacacaccttaaacttaaaacaagtattggttggtgcatgcaacttaatgtacaggatacgataaaattcgttcgttgcaacgcatgatagtacttacataaaacttattatgatacaacttaaaattgattagtacatgcagcacaatatattgtacatgatacaataaagttcgtatttgacaatgcatgatacacacttacatgaaaattatttgctacagctaggtgcaattacacctaaatgtgtacacatgcggtttaaatgtttatataaaaaggtcatagaatttgacaagatatattatgatagtataagacaccacaaaaacatacatgtcttgattcggtctacacataaaaaacaaaaataacaaaatttacctgcattgtataagtactattcattatctgatttcgttagttgtaaattaaatttagtcttgcatgtttatttatacacttacattattgcacttgatattactattcttttaagaaaatctatagtaattttaagtcgcaaacaaataacgggtgccatataggagtagaattaaaattttgtccggtagtacttacctggctgacgaacatggagcggggtgaggtgagcgtgaggtatccggtcttgaagtcctggacgaggtcggaggcggtggagacgatgcccatcatgaggccgcaggcggcgaggcccgcgacgacgccgccgtccttggcgccgatgttcgcgccgaagatgaagatggcgagcttgccgtagctgctggagagggaccaatcggtgaggcccgtgccgtaggcgttgcagaaggcgaagagcggcgccaccacgtacgcccacaccacgtgcttgggccgcagctgccggaagatgtgcgggatggcgaccaccgagatggcggcgaggagcacgtacgccgccgcggcgatcgtcgtcgggatctggtccttgaggaacacctgcgtccgcctccggtcgtcgaagctgagcacctgccgctccgtccccgtggcgccggcgaacggcgtctcctgcggctgcttgctggcgccgccgcggcgcttcaggtagaggtcgtaggcggtgcggagcacgatggagaagaagttgaagagcccgtctccgacgatcatggcgatggagatgaacacctggtacccgttcagcccatggaggctgctcttgggtaaccccgcgtcgtaccagctccccttcttgctctcgatgtacggccacatgatcccccacgacaccacggagccgatgagcagcgagaagttgataatgtaggggcagatcatgccgacgccgacgtaggtcgccgagaaatcgaagtagaatcggcggctgtacgccaccatcccgaacgtcgggaacgagctgaacccgcacccggggccggcggcgtagaaccactggaacagcgaccagaggaagctcccgacgaacgacttgaagaggatggacacctggtgcttcgcctggatcgcgccctgcggcgtgtggaagctgttgatgaggtgcgcggtggcggagccgctgggataggtgagcttgtagctgataatcatgatcttgcggagcggcacgatggagaagaggccgacgaagctgacgaggaagaggaaggcgatgaggcggcccagcgacggctcctcgacgttgatgctggtcttggcctccgcctcgtcgaagccctcggcgatcttcttgctcatgccgaggatgtaggtgccgaatccgccggagaaggcgatgctggagcaggagatgacgcaggtctggacgacggtgttctcctgccgggtgaacggcttggggaacacgccgcaccgctcgagcgcgctggtccacgtcttcatgaggaagaaggcgaggagccccgcggagacgttgagggaggggacgatgcccgaggtgaggttgagcttcatgacgatgaagctgaggaacgtgcccagcaccgcgctcaccaccagcgacctcaccgtgatctgctccgaccacgccggcagcgccttcccctcgaacgccttctccgtcgacaccgatatcacctcccgcgtcacctccgcctccccttccccagccgccgccgccatcatcttgattgattgattggttggttggttgattgattgagtcctcgacgacgatggcggcggcggcggcggcgagggctagcttcttccctgggtcgatctctgtccggccccggagacccggagatgggggagatgacgcaaacttgtgtgattagtggctgtgagtaattaaagtgtctacttttttgaaaaaattgttaattactcaactatactagagtaatgccaaaaaatgattgattaaaatggccatcagtagtaatgatgttttgttattctgttgtttcttcttctttcattcattttttccttttttaaaaaaaataacttggaattttttcttgcggtcatgatgtggggtgagtagtggacggttgtcatgcaacatgcaatctcgtgccatttgcagacggctaatttgggccagctaattttggcagtgtgatactttggaattagagttactctgattttcaatcaagtactagagttaaaaaaatagaataaaatatttaatatcaattggtgtcgtggtatagtaggttattacgtcagtctaaggtctcttttcttcaacttcaaacttcaacttcttgttttccgttaacacgttttttaaaactgttaaattttttgtgctacggcgattgaaagaatgtcaaccaaagtagaggaaagatcaagatggacgtttctaaatcggtcgataaaattagtaataagaagtctttaaaaagtgcgcattcatcatagaaaacgaggatgtaatagggttgctgatgaacttactcaacttgctaaacggaccgcatattgcgcggtttggcgtgaccatgcttcgtcttgtgtgatgcaggctctgaagtaagattgtaatattattacataatcaataaagcactcatttccctcaaaaaaattgtttgtgttttggcaaaagaaatctatatataaattgtttaaaaaattcaagtaaatctatttttcaagtttataattattaatatttaattaattacgtgctaatgaactttctcattttacgtagctaaaaacctcactccaagttgagagaaagaacgcagcctaatgcacttaaggtctcctgttcgagtctgggtaacaccatttttactgatgttcttttattttgtttttctttgccaaatcttaaattagcaaagtccactaaatttagtttgcatttcttttcatttttttaacagccaaacattttttcctattttttcttgtagcgaagtccactaaatttaatctacatttttttcttttattttttaacagccaaatccactagattttaatatgcttcgtcatggaccacgaaattaaattagtaaagtccactaaatttaatttgtattttttttctttttttttaacagccaaatatgctccatcatggaccactaaatttaatgttcagtcctatgtacagtaccatccattgttttcgttttttaaggctctaatccattgctttctttcttgttcactctgaacgagactggccaaagaaatcaattgagcagtggctagtggtgtactggtggtcattgtcatttgtttttcaccttaacaaaagatgaactacaaaaagcttttctacaaatccacatgtatcactgctctctcgtcccataaaaaactaatttaaaataagaaatgacatttttcagttaataaatctagatacgaacatattcagatgaaatacttgtaaataaaaaggaaaaaaaaggaaggaatttgaaaggaatcatattgcggtgatagaggagagacaaaagtgcacagctaagctgttttagtttagtagtgcagcagttgcagatctcccctcatctccagcttctcctcgtcgccggagctcgagatggccggcggtgacctgcgccagcgccgggcggtggcggcggctgacggggagggggacggcaagatggggtcagggggagaggaggcggaggtgaaggggaaggggcaggggaggaaggaggcgctggggtggctggagtgggggcgggggtggatgggaatcgtgggggagttcctcttccagcgcatcgccgccagcaacctctccaacccgctcgagcttcccccgctcgacggcgtctccttcgtcgtcaccggcgccaccagcggcatcggcctcgagatcgccaggtccaatctcttatcccttctacttcttctacttctactgctgctcttgccttgcccttagagatgatgggtggttcaattcgggcatgcgaagattctctggatggatgccatcaactcaagatttatcgatagcctttttggtttctgaattccaaataattcgtagtgttctcgacaatatagtgtgtgtaatgtgggcacccactggtacgaggtttagctcttcttttcttctcctgactttaaatgtcatgtcagtttatccaagcctcgctggttggtttgtagtaggcagatacggtagagttagtgaagttcttatttttactatttgatgaatcgttttgggatggcaatactatggtgaaaatagatttatatgtgctaacctgaaatttttggggcttttaactatttgccacttttagatttggcaagtaactatttgccacccctatatcaatgacatgtgggtcctggcaaaaagttaattgccacatctaaatgtggcaaatggttaaatatctcgaaatttttcgaaacaaaataataggggtactctcatacatgttacagtaatgaattggtccttgactgcacttcatcttgttacttcacaagtaaaactgtcaaaaatattcatctggcttcatcaatttggggagcatctttgataggtttccaatcaagaaacatgaaatctatcaagctaatttgccagatatcactttttattcagcgatatttcttattgggaagctgagtcatattattggttcctatataattgtatatgtgaattttgtaaagacttttgtttggttcaatagatttggtgttacatcttctaatgtagaaaagtattacaaatttgaaaatgcctaatcttcttataaatttcacatctctggaactaatacaagtgtatatttgcccttgtgctctggaacaaaatactaggggtactcatacatgttactgaattggtccttgactgcagttcatcttgttacttcataagtaaaactgtcaaaagtcttcatttggcttcctctatttggagagtgccttgataggattccaatcaataaacatgaaatctatcaggctaatttgccagacctcactttttagtcaacggcatttcttatcggagctgagtcatatcgttggttcttatgtaattgtatctgtaaaatttgtaaagacttatgttcggttcaatagatttggtgttgcatcttctaatgtcgaaaagtattacaaatttgaaaacgtgtaaacttcttataaatctcacatctttccctataactaatataagtgtatatttgcccttgtggtcaattcagacaacttgcactggcaggaggtcatgttgtgatggctgttaggagaaccaaattggcgcaggagctcattcagaaatggcagaatgataattcagagataggaaagccccttaatgctgaggtaatcatgaagacactatctacaggctgtacacaattgttgtctcatggcattttactagtttgtcttgtttaacacacataaatttgaatttctggccttatatgctcaaatcgaattccaactttcaagtaaatactatagtgtgtccttcacatctagcttttctaatcaattggaagatatctgttgcgaatgcatatcttaattggtaaagacaaagacatgtttctccaacatttatgtggtttagctgcagatcatttgacaattttttaatatattactctttaaggtgatggagcttgacctactctctctagattcagttgtaaaatttgccgatgcctggaatgctcgtatggcacccctacacgtattgatcaacaacgctggcattttctctataggaggtctgtatgcttcgacgataatctgtttcttttgtttttggtctatcaaatcaatccaacttgcattttactcggtaaagaattcaaattgtaccagacataactaactctttcattttctgtagaaccccagcgtttctcaaaggatgggtatgaagaacacatgcaagtgaaccatcttgcaccggctttattggcagtgttgcttctaccttcccttcttcgtggttctcctagcagaattgtaaacgttaattcagttgtgagtctctactcttacctgtgctgtgactgcctacttaggaattgttggaaagtgaccacggtttccttatcatgtataaaattggttattaatcctaacctcaatattttgaaaaacttgtctgaattcattattttaatgacaattaagaatcatttctgtgtaaaatttacaaatacctccagatacacttctgccatctaacaagcttgtctgcaatttcagatgcacacagtaggttttgtagatgctgaagatatgaacttgacatctggaaaacggaaatttacaagtttgatgggatactcaaatagcaagttagcacaggtatcacagaggtgttagattgctaattagcagttgttccctttgcaacgttaatttccttattgtactttgtattgttttcattctgctttattgcaagggaacaatcagtatctaaactgtccatgcacttttttcatgctatgtaggtctgatttattcttgtttcacttgcagataaaatttagcagcatgcttcacaggaggattccggcagaggctgaaattaatgttatttgtgcctctcctgggattgttcatacaaatgttgtgagttccgtttccccctgtccaatgtttgccctgtgaaacatgctatttcataggaattaaagaaccagaagtttgtggtattagttttgcatatgcctctagccagaccaacccctttcgggtgttaccataaagagaaaagaaacacatgcactattggggaaaaaatggaagccaaagaattttgtagtaacttaatgcaaggacagttgaaaagaaataccacaacctaaggctacatattttccgagaggattagtcatgtctatttttagttcaactcagcaaagaatctctcttgagcatcctaatgaacctctattaatctgtgctctgaataaacctggccaaatggaccgtgccaagccgggccggcccgagcacggcagtactgtagccggcccaggcccggcacggcacgccagcctgtgggccgtgccggcacggcccgttatcccgtgccgtgtttgggccgatgcctcagcccgtgggctggcacggcacggcacgtttactgtagcgtaccggcacggcacggcccaggcatggcacggcccaccggcccatttattttcctacgattttctaatttttcccatatatttctcatattttttatttttttccacattttatcctatttgtaccatatattttatgatatatttcctaaattttcctcacatttatcctatatttatcattttttcctttatattatgttttttctgccttttttctttttttcccctcaaatttcaatttttatgggccacatgtactagtgggccggctaccagcccacgtgccactacagtagccgtgccggcccggcacggcccagcaccttcttgggccgtgcttgggccgtggccttggcacgtgggccggcacggcacggcccgctataggagccgtgcctaacgggccgtgccctagtgggccgtgccgtcggcgtgccgtgtcgtgctgggccgggccgcccgtttggcctgctatagctctgaatatattggcaaacttattctcatttccttctgttagtttattatttgtatgttgatctaataatgcccataaatggtgcaggcaagggatctccccaagcttgttgtagctgcatatcatttgattccgtacttcatattcgatgctcaagaaggtgatgtacaggacctttcagacgttgctatctatcaattgacaactctccaccttctgacatgcacaatatcttgttactgatctaatgcaggttcaagaagtacactgttcgcagcttctgatccccaagttccagattactgcgagatgctcaagtctgaagactggcctgtttgtgcttgcatctcatatgactgtaatccaatgaatgcatctgaagaatcacataacctcgagacgtcgcagctagtatgggagaagacattagagatgattggcctcccaccagatgccgtggacaagttcatcgaaggggaatcggttcagtgtcgttatggacaacagaaggcagaataggctatttcgtagacagcaaatatgtgataatttcgaatgttcgatccatttcatcatgcgattagtttgccagtggttttgttccagtactttgtaatagtacatctgtcatacccttttttttgtttcatatggttggtaaatctaactgcgtcaaatagaagtatgacaaaacaaagttcgttacaatttatctttgccccttgttaaatggcaaaacgtttgtagagttttgagttgtaaaagcatagtcccttcattctttggggataatcaagatatttattattgtttgggggaattaaccgaaacattttcagtttgtagcctgttctgctgtgcctcaaaacgctgcacttacataggtgtggcaacgctgtcctgaataccaaaactgacgatacaagaaggatggataaattttcaacatcacaagcaaatactaccatatatcagctctgaatttgaggataatgtaatgaactaatttagaacatactatattgctatgcatgtgctcacatgcgaaactcttgctagaaacagaacaagtactgccaagccaatgctaaaataatagcacagtcacaacttccacacttgaacaaactcatgcgagggacatgagagtttgtggagcattcaccaggcaagagggttacgatccagattaattacaggcatcgcccctcaataggacgagttaaaaacagaactccaataaaagaacagtttaccacgtaatggacagcatcgcggactattttactctccaggaagaccgaacacattttgatctgccaatggatgaatagcagcatagctagtctgcacctaattaagcatttggtggccaaagctttggatcttgagttgtgtccacagcagttggaggcaaccactgccacattgccatcccttggaatgctgcgggcgtaggagcatttttgttgcccagagcttgataaggtggtataaatggagggaatgcagcgggatggaatgcagctggatgagggagatgaggaacaaatcctgtaggagcaacactcaatgctttaacttgctgttccagcctctccttctctgccttcagagtaactttctcatcacggagttcattcttctccacctgaaaaataatagagccataaaacatacatgtttggtcagatcaagacttctcgtagatgcatgggaggtctgaccaatgaattccggacttgccattagtgaaggtagtgaacctagtaattattatctggtgaaccaaccaacaattgcacagaaatcaaactcggcgcactttagaaaagttttctttgttgtgtctgcttgaactctgttcctgggaacagtgcatgcgatatatcattttaggacacaggacatgactgtggagggcatcaggcattctaatccaggggtagaaggtaaaaaattgtgagaacaaaataccttaaggtccttgattgtttctcgtagcttctcattagattctttaagcttttctgcctcgcctctgagttctgccaacagacgagctgcatcactcaagatatttgctttatccaacttagcttgcttgtcaggattgataacggaagataactcaaggaacctgcgattgagaaaaatagatcacagctgagacatatgtggaaaatcatgtatgcatgtgtgagtgcattcatcttttctacatggagggatggcgaagaggcacgttgttaattcccacacctgtcattcagtctatccctccgaattttctcacggcaagctttggactttggaccagatgatgatgattcatctctacctctgcacaaaatcagaaccattacaaatgaaaatcaaatatggtcccagcaataaaatgaataatatgtctaaatactgtgttaaatttgttcatggtaataccgtaatggttgaaaagttataactatcagtaacagttcaaggtatgtaagcaaagatacttagaaaatcataagaaagtaagattcagaaactagtgacagaccttttccctaaaacagattggtcaaggcaacaagtatctccactgacatcatcaatcccaagtctgcaataattacaaagtaagcgccaagtgaataacagttgatgggaacaaaaattattcaagcaaggtatagctgctcaggtaggcaacaaaagattctgccatacatatttccattagcaagtgcttcaaagctaacattttacattcagaatcatacttgtgtagatatttcagagagcaaagaacaatgtaacatatcctatggcaagtagttggcaactaggtgtttatcacgcaggcgcccacttttccaataagggcgcaatcaaattgctaattgatttcaataagctcgattggaatggtaccaacagcaccagaactactagtacacgctattgtaatttacggtttttgccctccaatcgatgggtactgtagcagcatttgctgaacccgcctataaatcagctagcaatcacaattcttcgttcatatactactataacctaatcgatcaatcaatcaaccaactagacggtgtacatgtgaaaatccccctctttttctcaagaaaaaaaatactcctaagtagtatcaaacatcaccgcaatttttttaagcaacaaacctgcagcgacaaggacagcaaacactacaaaacgcatgcaacaaaccccaattcgagctcaatttactcctcaaaaagaaacagaagcggatcaagcgtaccctccatcgcagggcagcgtcggcacaccgtcgcagaagacgccgaggtcgccgtcctcgccgccgccgccgatgaggaactcgtcaacggggtctccgcctccgtccatcgcccgcggcgggtgcgggagatcgggcctagggttcggggattctcgctcctcctccgcgagcgagaggtcggggaagaattggggatttggggatgagacttttgcagattgcaccctggatataactgtaatgtctaacgagtcctcgcttagtagtttttagctgtggtggagaggggtgatgttgtgattttatacttttttggaggggttgggtgtaaaagtgagaataggttggtggctgaggaagatgctgggaaaaaaggggagataagatgatgagcgtgtatagcacaggatgtggtcctgttcatcatgtttttttgtgttttttttatttttggatttgtgtttcatgtgatcaacttgatcagtgtcatctactggctactgcatctgttctcgatttgtttactctgattaggtttagaaaagtttgtttcatgtcaattagcctaacataaagagagtggtgtgactcgtgatttaataatataaacatagagttgactagttgagtatgcgttttgtagagttgttagcacaattcttttttgtgtgagtgtgtagaccatatacctcaagttttttttttaaaataaaacaaatgctcccaagctcgtcgtttgctctataactgataagatgtgaaaaaagattgaagtatggaaaaaattatgagtaaaatttttatatatgtataaacttagtcatttaaaagtcgatgcaaaagataactataaaactaaaactaagtttcaaaatttaaattttactcgcggctgataatcctcaagcaaatgatggcagtgttatacttcaaatttcaaggttggtgtacctggagcaatgttactgaagagaagatccaatccaagtacaaatccagccacagatgctcagcccactgggctcctttcgtatgcctgagcccatgatcccctctggtgtttcaagcctggccttataaccaatgaatgggtctcaaatgtaaactactaaagccttggccctcttggcttctcttcttcatgcacagaatcaagaacagcaaaatcttggctttgttctaaaaaaataaactcgtggctttacttttcctttattacgattacagaatagaaccaaattaaaaattacactatagagaaagagagactgttctttgtagataattattctgaccaagtaaaaacaaaagaaaggccagttttttctgcagaatatgactatccgaattccgaatatttttcactttttgtgtgaatgcataaaaacttctatatcctccttggagaatggcagcacgaataagtggagggccatatttggagaagcaagtatgatcatgtgataggtaaaaagaagatagatcagcaacttcctccttcagaaaaaagcttcaagatgttttctccacttgaggcctgtctactacatacacacactagacagatggatgctgctccacttaaggcctggcattcattcatttcattcatgcatggcattcagattcagtcattcagggccatcagaagcaacagcaagtgctgcaatttcttttctacctctcctttatgccccttccacaaagcaatggatggattccatttccattccattccattcctttttatcaccaccaacaacaaaaatagtgcatgggtttgcaaacacctggaaatgtgccatcctctagtttattgttttttgccatttgtatatatttgtgtgctagctagctagctgatccaccactacggcctcattgcatctctgatcactaccagaaggaaaaaaggtattgaaattggacattatagtgtggttcaatattatgtgtcaaactaggagtgctctgtgggaagcttaggcttcaagtgtggctatcagtaggtgctagacactctagtcacttattgggggtaaaatgatgattcttggaaggtgattaattgacatttgtgcgaactagctagctgtcatgtctgtcaatggattttatgcatcctatcttttctgaaaataagagactgtcaacttcaaggctaacaaagtggcatgtttgctcatctagtagattaacaaactggatattgctgaagacataattcgcattatctttcttgtgataggcagagaattcgttggtcctcaagtttttgtattattacatactagttacatgcccgtactttgcaacgggattgggtgatagaaatatgattaaatttccttctatgccgggttttcacgatgcattatgttttgaggtctttttggagtgtttttttaagggaaaggaatggttttttagaggaaggaagttttttttttggaggggaggaaggaggacgacgaagtagttaagagatatgggtatacattatatgtgtaaaatcctagagttacatttgtgtacaaatgtaagttcttttttttcgccgggaataagttctttttttttgtaaaatgtatcaactagaagtaaaaaatatatataggtgtggaaaggagactatatatgaagtggcaaagaagatttccaacaccctttgatatctctgcctctcaacatgtggattccaccatcctccacaccaacatattttatacctgaacaaaatagttgacatgctgtgagccgttccttccgatccaatgctcatcatgagattaaagaaagttaattccagatgcaaagcaaaaggcagcaccataacatctcctaatatgcccaaaaaggaagaattagagatatattagcacactaaaaaaacatccatttgatttgcctcagctctaccctggcaatagtagtgttgtctctctgaccataaaaatcatgctgttagtttatcatatcctcaaggaacatctttcggtgtcttgcactctggcatttgtcatttgatgatgctgactttgcaaatgcacatctattactagaatactagaaaggtgagtggaaaaattgtgttagtggaaaagaaagctggtgttgatgtgtgtaattgaaaatacagtgcttaattaaagattgcaactatatgcaaccatcttgtgaccaaatggtaagtaacaggccactttgcatctgatcaggtggtcagctgcaaagtatgccttttcttcagagtagtcatgaagcatgccttttggtcttgtgatccaagagaacactgaaatcagagtttttctttaaattgacttatactagcagctggtaaagaaagccattggagtatacccgaaggctgttcatttgatttagcattttttgtttttatataattagcaaagttgatcttgaaattttacattttggaacaatccgtcgcagattcgtcgcaaaaaggggcctgcccaatggtcaccaagtattgtatgagcctgaaaaacctacatgagttagtatggtttacattgtaatgttgcaatttactgttgatcatggataaatagctcattcaggtaatcatatatcacaagtaatgcgtgtcaatccagccaagttaagacgttgaaatccttttttattttaatgttggaatgattgcagtaatccaacaactgttctttttgttatcaacaaccttatttttttatcatgaatgcactcggttgcttcctcctgaaattctctttaagcagagtcagaagcattacgtaatctgtgactgattatattttaatcaagtaaatgatagtaataataattattttcatgggtgaaggtacttgtggtgaaactgttctaagggctcaatcactatgtgaacattacatcatttattctttcatatagggacatgattaaccaataatccaggatatatagtccacagcaaaatgcaacaaataaattacccccattagtttgctaatttttttaagcagacaagataactacctagtatattaattaacaaacaaggggatttatttatagtacataaactgaaccccattaaattcattgtagtacatttgtacctatatatatgtttccttgctgttcagaggtcaaccatatcctaaactaatctcgggttgttacctgaaccagaagtgcttggcttaaatctcacataagtactcgtaggtttggatgacaaatcaaggtactagtagaccaaagagacttctgactttgcagatagatgcgtgtatgaacagacaaaggaagctgataatcctatgtaggagtaatctttaagccatcagtgtcggctgttttctgcaaaagacagagaaaactgatttcttaggaatgcacaggacgtagacttgaattatttgccagtagatttttgctgttttttatgctacttgtcttttcttttttccttcacttgaacagagtgttatgacagggagagcactgttataatgctctgtttacttttgacagtgaaagagtttgataactccgagctaggttcgatcactgatcaatatgtgttaacttctttattttgttgaaaaatagagtttgtcaccggttacccttacccatggcatgatccactcccattccttcgaccattattaagacaaattttacagtagtgcctactagtattagaattaatcgctgtgtatctgcctgtctagaagttagtaatgaattgaaatccaacctcatctgttgtatctgcacttctcagttattacttattacgtattaccgtctctgaaatgtgtaactctcgtctctgtttaaatcaagcagagacaaatattcctttttagcaaggcgaactgatttttttttgttatttcacttaatctgttgcaacacactgtattttgctagcactaagaaatgtacagagtaactccactgacggattaagcgataaaaaattcagtaattctacatgtattcctgttttatctagaacatttgactagactgattctaaaacagctgaataaaggaagaaattgccacgaagaacaagttacaaacaacttgccactagtatgttttgctactaattaacaactttattgatttcttcttgacaccggaacgtacgggagattgggcgacttactaccatctgatcatcttatgttgacctgtgctaatccctccagtgcaatcgccaaatggaggccatccatttcacagattaattatagctgttaattaatctctgctactgacactagtgtcatccactcacatccgctgacttattccctaaatcaccgcctgctaaaaggtctcctctcctccatctctattgcccactaaactaagctccatcatgatgtactataacattagcaggaaaatgacatgaaacaaaatgtatatccttgttgtgcttcctaatggatccaagaaaataagccaaacttactaacaaaataacttaatccctggtttcataattcttgatattttgaataagattaagatcaagacaataagaactttgactatcaacaaattttaaattatttaatttaaaaacactaaaacacgatgtatagattattctcgaaaagaaatttaacaaaatcaaacatttttacttattttttatgtgttataatagaaaatcatagttaaagatatattttagaaaccatgtagatatccaaaacctgaagaactatggaaatggagagagtactctgatacagagactacgtctgaacgcaacaatttcacatgaaacaaagagttagatttactccatcatcttaaaatataaaaagaaatagtttggtccctcttcctagttcatttggtctatagagttacatgacctagaaaatgaaaagacacgtcagtaagcaaacaggctttgaaaacaattaacctggagaaataggagtttaggacagctcatgaagctagtatcaaacttaaccaaagagtcaaaccccagacatgctagtagtcagttagttaaccaaccttctccctcctctcttccacttcgtgcaagcatgaagcttagcaagctcaagctggatcggatcatctgatgtgaattctctctcacaccaattcaccatggatggatgcccatgaccatccttagctccaggaagaagaagaagaagtgaacagtagctatagccatgggaagcagaggaggagctttacctgttgctgtactggtgctgttgctactgctggtgctcaagaacggcgccgcccagtcgcggtgcagctccggcgacctcgccgcgctgcgtggcttctcggccggtctcgacggcggcgtcgacgggtggccggcgggggtcggcaacgcgtcgtcgtcgtcgacatcggacggtggcgactgctgcgcgtggcgcggcgtggcgtgcgacgaggcgggggaggtcgtcggcgtggtcctgcccaacgcgacgctccggggagtggtggccgagtcgctcgccggcctcgccgcgctccgggtgttgaacctgtcgagtaacgcgctccgtggcgcgctcccggcggggctcctccggctgcgggcgctccaggtgctcgacgtcagcgtcaacgcgctggagggggcggtggcggcggcggccgtcgtcgacctcccggcgatgcgcgagttcaatgtctcgtacaacgcgttcaacggcagccaccccgtgctcgccggcgccggcaggctcacgtcgtacgacgtctccgggaacagcttcgccggccacgtcgacgccgccgccctgtgcggcgcgtcgccggggttgcggacactacggctctcgatgaacggcttctccggcgatttccccgtggggttcgggcaatgccggtcgctcgtggagctctcgctcgacggcaacgccatcgccggggctctccccgacgacgtgttcggcctgacgtcgctgcaggtcctcagcctccacaccaactcgctctccggccacctgccgcccagcctgcgcaacctcagcagcctcgtccgcctcgacgtctccttcaacaacttcaccggcgacctccccgatgtgttcgacgcggtccccggtctccaggagctctcggcgccgtccaacctgctcaccggcgtactccccgccacgctgtcgcgatgctcccgcctccgcatcctcaacctgcggaacaactcgctcgccggagacatcggcctcgacttccgcgccctccagagcctcgtgtacctcgacctcggcgtcaaccgcttcacggggccaatcccggcgagcctcccggagtgcagggccatgacggcgctaaacctcggccggaacaacctcaccggcgagataccggcgacgttcgccgcgttcacgtcgctgtccttcctctccctcaccgggaacagcttctccaacgtctcgtcggcgctgcggactctgcagggtttacccaacctgacgagcctggtgctcactaagaacttccacggcggcgaggcgatgccgaccgacatcgccgggttcgccggcatcgaggtgctcgtcatcgccaacggcgagctgcatggcgccataccggcgtggctcgcaggcctcagcaagctcaaggtgctcgacctgtcgtggaaccacctcgccggcccgatcccgccatggctcggcgagctcgaccgcctcttctacctcgacgtatcgaacaactccctccacggcgagatacctctcaagctggcgtggatgccggcgctcatggccggcggcgatggcagcgacgaggcgcacgtgcagaacttccccttcttcatacgccccaactcgtcggcgagggggaggcagtacaaccaggtgagccggttcccgccgtcgctggtgctggcgcggaacaacctcaccggcggcgtcccggcggcgctcggggcgttgaccagggtgcacgtcgttgacctgagctggaacgcgctgtcggggccgatcccgccggagctgtcgggcatgtcgagcgtcgagtcgctcgacgtgtcgcacaacgcgctctccggcgccatcccgccgtcgctggcgcggctcagcttcctctcccacttcgacgtcgcgtacaacaacctctccggcgaggtccccgtcggcgggcagttctccacgttctcccgcgccgacttcgacggcaaccccttgctctgcggcatccacgcggcgcggtgcgcgccgcaggccgtggacggcggcggcggcggcgggcgcaaggaccggagcgccaatgccggcgtcgtggcggcgataatcgtcggcacggtgctgctgctcgcggtggccgcggtcgcgacgtggcgggcgtggtcgaggtggcaggaggacaacgccagggtggcggccgacgacgagagcggcagcctcgagtcggcggcgaggtcaacgctggtgctcctcttcgccaacgacgacgacaatggcaatggcgacgacggcgagaggacgatgacgctggacgacgtgctgaaggcgacgggcaacttcgacgagacccgcatcgtggggtgcggcgggttcgggatggtgtaccgcgcgactctcgccgacgggcgggaggtggcggtgaagcggctctccggcgacttctggcagatggagcgcgagttccgcgccgaggtggagaccctctcccgcgtccgccaccgcaacctcgtcacgctgcagggctactgccgcgtcggcaaggaccgcctcctcatctacccctacatggagaacggcagcctcgaccactggctgcacgagcgcgccgatgtcgagggcggcggcgcgctgccatggccggcgcggctgagcatcgcgcgcggcgcggcgcgcgggctggcgcacctgcacgcgacgtcggagccgcgcgtcctccaccgcgacatcaagtcgagcaacatcctcctcgacgcccgcctggagccgcgcctcgccgacttcggcctcgcgcggctggtgcgcgcgcacgacgacacgcacgtcaccaccgacctcgtcggcacgctgggctacatcccgccggagtacggccactcgtcggtggccacctaccgcggcgacgtctacagcctcggcgtcgtgctgctcgagctggtgaccgggcggcggcccgtcgacatggcgaggcccgccggcggcggccgcgacgtgacgtcgtgggcgctccgcatgcggcgggaggcgcggggcgacgaggtggtcgacgccagcgtcggcgagaggcggcaccgcgacgaggcctgcagggtgctcgacgtcgcgtgcgcctgcgtcagcgacaaccccaagtcacggccgacggcgcagcagctggtggagtggctggacgccatcgccgccgccgccgccgactgacacgaagcagcacggcgttagtatatgaacaaaaaaaaaagaaaaaaaaaagacgagctgatgattccagtgttctgcattgctgaaagttttgcagtaaacagagtagattattgtgcagtcgcaaaggcacggtacagtaaacacatggtaattactactagtaattgacagtgtaacagtatacatgtatagtgagtggtgtgttgttagtttacacttgtgacttgtgtgtgtgtgtgaataatagcatctgcagttctgcactgcaagctcaaagttgggctgtgcagcgttcgagtgaatcagaactgctaatttttaaccatgtacttcttcttcatttcgaggatctgatctgggattactgctgatttggcagtaacaacatgaaacaagaatgcacgtatcatgtcaccatctgttgctgactaggagtaattttctctgttttgtttcgggttggtgatatggtcagttagctaccttgtctgtactgaatttgcaagtagatataccgtgctgatgttctatctagagcactattggttggcccaataagccaaagtaaaaaaaaatcaatatttgaattttggagttgatcttaatatattttcaatgtaattctttttagcattagtttttaagttgatatgaacaaatatataaaagttttacgtataaaatattttttattctccaataaactgttttgacttattagaaaatatggacatgacgaatgagattctcagtttttagtgaactttgactggcttgtttgggaaagagggacttattccaaatccctgtcacatcgaatgtttggacactaatttagagtattaaacatacacaaattacaaaatccatttcataaccttagactaattcgcaagacaaaacttttgagtctaattacgccatgatttgacaatgtgatgctacaataaacttttcataattataaattaattaggcttaaaaaattcgtctagcagattagctctcatttataaaattagtttttttattagtctatatttaatactttaaattagcttacatccattggatgtgtactaaaaagattctcgacggcacattggcatggcgctgaatcttcatggcagtggatgccatgcagctgaatccatgttattactgcggttaagtttctgtcctggatggctgcattgcagatatggattaacacgtgcgagattagcagtaaactaacatcggaatcgacaggagtattcctattcctatcttgttaatctgctagattttagtactatactctgatgctttaatttcactacgtagtatagtactcccttcatccttgaatgtttgacaccattaacttttttaaatatatttaattattcgtcttgttaaaaaaatataagtaattattaattcttttcctatcatttgattcattgttaaatatacttttatgtatatatatatagttttagggcctgttcactatgatgccaaaaaaaaccttagcaaattttgacattgttaaaattttggcaacttgccaaaactttggaaggatttcttatatagttatcaaaatttggcatcaaactaaacgtggctacttttttagcaactttaccaaaatttggtaaggttgaaaatgacatcaaagtgaacaggcccttacatatttcataaaatttttagaataagtcaaacggccaaacatgtttagaaaagtcagggtgtgaaacatttagagaactagggagtagtgcactagtactccactatcaggttttgtctgaacatcatcaattcctcatccattgccatggcggcatggcgccgctgccgctgcccccaggctttgatgatccatggtccacatgagcaagaacaaaacaacactcattctgctcttaattaatgtgcaaacagtttgctctgctctaattaatcacagaatcccgagccgacgtgcactccccaacagtaattaccatttacccatgctcatgccggacccgagcaccgggcccacctgtcatcgacgccatgccctttctgagcccaccccactcacatgctggggggctcgggagtcgggaggaggaggaagaaggacacggcatgattgggacgtgggccccacctgcagcgactgttagtccaacgtggcactattcatacgcacccctcggatcgcggcaggggaggtgggacccaccggtacaacctggcatggaggtctacccacaccccaccgacatgtgggccctgagtgaggggggccggggtgtacagtggcgtggggtagaactgagatgggtgagaatgtgatttttaacatacgtgactcggcgcaaggaccaatggggtactcgagggtgagaaaaaaaagagagagagaaagtgccgttgccggtgaggtaatcccacatcatcctcccgcggatttaccattttgtccagttttccgatgggtggacctacatgtcggtgacacagatatcagtggcatagaacgtaattgtttgtaaatggagggggtaaaggggtaatttggtgtccgtcaaagtgcagtcaaagcgcacacactcccgagcttagcttagcttttaactgctcgtctcatcactctccacctctctccctctctctctcttcctcgcgctcccacgccacgcagcagccgcagatctccacccgcctccggcgagcccgccgccgccgccgccgccatggagtacgagcgcatcgagaagccgttccccacccaggtacgtgagtggccaccctccgccggcgccgccgctgcccccatttttgcctctccgggcggggcgtgttgccactgctcggtacctgtttggagtaatgcgtggtcggctgctgtgctgttcttttggatttagggcggtgggttctcgccgaagcggctgcgcgcgatgttgctgggggtggagaagcggcggaaggggcaggaggaggaggaggagggggacgccggggaggtggacgacgagtacggcgcggtgcccaagtcctctgtcagatccgacgccgactccgatgcgcgcagtgagtactcttgcccccccgctgcccaaccattctgacttttgcattttggggttctggtggcttcgttggtaatgcttcaatcttgggagggtttggtcgcctgcattgcacgatttggaccagctgctctaatatggagatgaccaatcctcttctgttcaagtgggttaatgacatgagaaaaagggagatatatctgtatttggcttgctggcaatggttggtgaattgtggttctatagacattgaaatgttttcctttttgtcttttgtcatcatgggggaatttgaagggcaccgaagtccaacctccttctaagtcttgtaccttcgcattgaataatttcaggtagaaagtgcgatggtattgtttttagtgggcagctgaactgaaagtgacagaccatgattgctttgaatcttcagatgatttcagtgtcctcaaactgtgactgatttattttctttgatgtaggaggaggtagcatgtgcgaagaatacaaggatgtagatgtggtgagcaccatctcagaatcttcatcctcgttggagacagggagtgggcaccgatcgcgtgacacccactccatgggttcacgagtaagggtgcctgaggaggactcctgtgactctgagagtgtggcttcaaactttgagttccataaggagcgaggggcctctgctcggtctgtgacggcggcaatcgttcctccattctcaaagcctgcaccatcaaagtgggacgatgcccagaaatggatcgccagcccgacaacaaaccgtcctggtagggctggtggagtgccacagaggaagatggaaaaaactagctttggtggcgggaggctgccggctacgaaggttgtgttggaggccacagaggagatagatactaagagggttgatccaagccaagagaaaagggaaattgggtggcaaaaagcggtgaattgggccccacctgatccatatccagaagttgagacttgtgcaaagtctgcacttgctgaagaaattacagtagctgattcagctggtaaggagtgctgcagtctttatgtcatcatgcctcaggttcttcggtttttctactttccataaagtagtttgtggtacaatatatagtgttattaatccttccactaagagtctgattgatcttctgttgccattagttgagtggagcattatgccatggagggctccgcacattatgaatcactaactcaccatcaccgctgtctcattcacaatggcaatactctgcatttgacaatgtgcagagctttatttccctttcaacagtttagttacaacagttgcatagatgaatttatacagtttgcatgtttgttcctttagatagctgatagtcaacaggagaaccactaatgcaggcaagatttccttttccaaaactttatgtaacacggtttcatcagttttccatgatccactctgttaatacgtcctgcgtgtaaagtatttatccttatttttaaaagtgaacagtaatatttgcatcattttctaatgttccttcaaagaaatggcacaaattttgccttttctaattagaaaatgaacaaaatcatatatggctaaaattttgaatttgtggctttgggcagttacttttagtcgccatgattcatctgccacgcttcagagcgcgacaacatgcatacctcccccaccaacagtccgatcagtgtcaatgagagacatgggtacagaaatgacccctattgcgagccaggagccatcccgaacaggaacaccggtgagagcaacgagtccagattgttctcgcccaactactccacgaaaaacaataggccccaatgcaatcggtgctgttattggccatggtgaatgtagcaacgtggaattaagtgaacaagaattgcaaatgaagactaggagggagataatgctcctcggcactcagcttggtaaaaccaacattgctgcatgggcaagcaacaaggaagaggaaaaagatgcatcactttcgcttaaaggagtgcccatggaccaatctacacagaaggtaacagaaattcgtgcagcagcgtgggaggaggcagagaaggctaaatatttagcaaggttcttcactaaactctatttctcttgttgcaaaaaaaaaggattgtctttgtatgtttttgctaaattgtcccattgatcggtgagtcactctattgcattccagatttaaacgagaagagattaagatccaagcatgggaagatcatcagagagcaaaaatcgaagctgaaatgagaaaaattgaggtaagctttctgtcatccaatagaagcattgtaataatgcattgtagtatcatcttaactgagatgtttttgattctattttgactttatttccatgtttacatgcacattaaataatatgggatttgttcttctgattatgggcttatggctgttggctgatgatcttgtggacttttggtactgttaagaatgcacatcatgccattgacataggaagctaaatatattactgctgttgggagtttagtagctgatcaccttttacagtgttatctgaattcactgtccttccctcttacaattatgtttcaatctgcttatcacagatttgttccacacacagccaataagtatcatatggttacggttgtgaggctgtactgtttattaagatattatattgccttaagagaagagtagtagaacaatgccttcgtctcagactaaaacatagcttgggattatacctagcatcacttgatcaatttttcctgtcacatcggcatgatgcttggtgttttaccataaacttccatcaatttggatattgcatagcaatttaagtatcaattcttctttttttttttgaaacaacctgcaccagtgggacgtttcaagtatcaattcttccattcagatgcatcatactttgttaagagtgaacaatccgatttgctttacttgtccatctctgtacaagtacaattgttcttgtacgatcaatttgggaaactacactgcccgtggctaatggatgtttccatggcttctgtttctccaggtcgacgtggaaaggatgcgagcccgtgcgcaggacaagctgatgagccagctcgcatcggcgagacacactgccgacgagaagcgggccgcggcggagctgaaacggagccgtgcggctgcaaagacggcggagcaggcagaccacatcaggagaaccggcaggatgccgtcctccattggctgctggaactggtgctcgtagtagcgtagctaagctcaagcaactgaagcaagcaaaaagctctcctcactatgtctcgcaagacttgaagcgccatcatctgtttttaccgtgatcttgtagaatattgtcttttgattggtttcagtagatataagtcagaagaagacgagtcacttgtaagtaactatggagcagtatataagatgcaagcttcttgcctttttctgtgctgtgtgcttgttatcttgtacttggatgtcaatctgtcacagtgagctacaagcagctccaccatgctgaggaggtgttgaggctcaattcggattcccggatcaccagtgcagtacagagtatatgtgtgccgatgttcatcactgatgtgagatagaagaacaaagtttttacggaaattcttacccctttagtcctttttactcgtagcgattacagtggaatcatgtttggtcttcacatgtcaataaaactacacaaaaattagtacaccattcaattgttgcaaatacgtggtaaggtaacctctttttaaaccaaacagaacaaagaaaatctggctgggttgtttcctggacaattttttcttcatcctgtgcaacggtttcaatcaataacatactggtaaaatcctttttttaaaatcacacatgaataactgatagtaaaatggaaacatcactcccagagatcatacataacagaaagacaaacataagataaaaggagtgattatatgaatcagtactccaattcacctcctttttcttttcaaaagtcactagatagatattgacttaatctcggttttcatgatctcactacattcctcctgaaggtgatacactgatacacagcagaactttggatcgatttgatatcgaacaaacctcaacgagcattcaaatcaaatgagccctaattatgattcaccttctctcaagaagataacacagatattaattagacagttcaccagcaaatctgataagctacagtcctactactcgaacttcttgataagggagaggtcgttgagcatcttgtcgatcttctcgctgccggggtcgccgacgaacctgccgccggagcggagggaggggacgagggcggaggcctcgtcgctggtgtcggggcagaggttgccgagggtgcagagctcgaactcggcgaggccgtagcggctcagcgtctccctcacctgcctcaccgcgtccgggttcttgtaccggctgaaccgcttcacgtactgcagcgatttctcgaacacctgcgacacctgcgacgacgggtccccgtccgacatgtgctggatctgctcgtacttgtgctccaggattatcgccacctcgcagttcatcaggcacttggccttcaagaactctgcaacccatcaaaccctaggtatcaaatcaaatcaaaccgatacctctactcgattccgattcggacggactcaccttccccgatcttgagctccgccgcgttctcctcctcctcgccggacatctcggcgcgctctctctcccctctcggtggctcacctcaacctcggcggctatggcgttggcgatgcggctgcgggcggagtctggactcgggaggggaaaagaaaccaaggcggcgagaggcgcctcttaacgggctggactcacgatccgattcgctaacaggctaggcccattaacgcattgggccggctcgatctgcacgagcgtgttcctttcggggtgatctggaccgtccatccgtttactactcgacggcggcggcgagtggtcggcgacaaggacggcgggcgtgtcgtcttccccggcgacggcggggatatgaaggggctcgattcccgaggagatcagcatcgggggtgtagctcatatggtagagcgctcgcttcgcatgcgagaggcacggggttcgattccccgcacctccacctcacttctctcttttttttaatttatttttggtggatttatccggtgcggtggtgcgggctccacgtggcagtgaggcaggtggtggcctcgaggcgcccgcgtggattgcagtggcgctgctcgtcacttcgtctcctcctctccaccactcgtcgtcgtcggcggcgtggccatggcgacacccgcgccgctctccggcctccgcccgcgcgctcccgctcccgctcccgcggcgcgcagtcgcctgtgcggccagtcgccgccggtcgtggccccgcggctcggggcgttcccgcggcggcgtggtggggcggcacggtgctcgccgcgcgccgaggccggggacgtggaggcgcttagggcgggggtgtcggtgtacaagccgcggtcctacgacgtgctcgtctccgacgccgcccgctccctcgcctgcgccatggacgagggcaagacccgcctcgagatcgagttcccgtacgcccgcgacctattcattccctttcctccatagattcgcgccaccatctcgcctaatcttttacttagttggttattaataatgcttgcattatctcatcctccttgtctcatttttttttttggtggtggtgcttgtgaaaaggcctctgccgagcaacatctcttcttacaaggtatactttgcatttctatctcaagctcgtctcataactcacactcattgttctagtttcttgctttgttatgagtgaattctgtaacaatgcaaagactaatcttgatgtatattatatagactgctctagtttcagtttgaatgctgctgctacctctgtataatgttgtttcaaagcagaatctctctttttccttggcttcaagttaaaaagggtttagcttttgttgccacatacgtgtgatgaacgcttgtttctaaccatcctaccctgctttgcttcgttttcaagggttcctcggacgagttcatcgacgccaacatccagcttgctcttgctgttgccagaaaacttaaggaactcaaggggactagatcttgtattgtaagttcaagtttcatgccttgtcctgctccagaatcattctggcatttgtgggcatatgcaaatcttttctcataaattatcttctagttgattccaggtgtttcctgacctaccagaaaagcgcagggcatcccagttgttcgggactgctctagactcggtaaataatgcctcatgaaacaaaatatcttaagaggatgcaaaaaattgttttttcccctcatgacggtaggagcttatttggttacatttctctgttttctttttccacctcttgtagattgagactgcaactatcagttccctggatgaggtatctaccggacctgttaataccttcttcagatcaatgagagataccctggattttgactttgctgacgatgttgaaggtgaattgaccaatagctttgtctagtatggtaggagtactacattaaactattaagaaaacagaatttatatttatatgactccaagaggctgtcacgtccaagctagatgaatcctttatcgctagcattttatcagaattttcttatgtctgacctcacttcaatgttcaagccttctctatagaggagataccttggagaaccattagcctgtgatacatgataaataaaattgatttggtaaaaacatctttgtaaatttcctaaaaatgtacaagtatctcttttcgtacaaatggcaaagtctttaagttgctacttggcacagttcaaaattttaaaatagagtggaaggacatggttgatcagtgggtaattattcatatataagcattatggataattattcggtggtatattattgtgtcagattttcagcagatatttcaagtaacaaccatcagtaaaagttgaacattatcaatatgagacagatttcttataagcatccttggaaaagaaaatcataactacctggctactgtgggtacagatcgatggaaatctgatgaaccaccatcgctatatatcttcatcaattgcagcacacgtgacctttcaactatagagaagtatgtggtatgtctaaaatgatgctttgtttcttgccaacatgtatgcaaatgtactttttggaatgcttggtttgcattgttgtgttttggccatcatttggccagttaggtatttattattctactgttaataaacgatcatgttctgagcttgatggatatcactatgaatagaaactgaagaaagaaagttgaggaaggcatgcacagctgcaaataagccttatatgattgccacacgatttactattctactatctctatcccataatataaggcgtgcacacattccaagattcaactttaaaaacatttgaccaacaattattataatataaattaaattttatttgttaaaattaatatcattggattgacatttaaatttactttaagatgattataattttgttgcaataaaccttataatatatgagaaattttaagtcaaagattacttttgaagactgcaccaagtttgaccatgccttatattatgggatggagggagtatatcaagtgcctgatatctaagaaaatgcaaggaattttgaatcaacaccacaacctacagagtttctctttcattttccattcacttgtatattgtagttctttttccctggaacaagaatgaaaattttcaaccttcgatggtggaaaatgtagaatattctttgtagtttgtcacacgtaacgtaaggaaatagcatgcaacacaaggttttgaggaataatgcattaattgtttgtttagcagttgtgttagtttgtgcatttgtttgattcattacccatcactttgctattgttcaggaacaatttgcctcatctgtcccagcccttctctttaatcttgaactagataccttgcggtatgtgtcttatatcccacctgatggcttgttccttctaaactctattgatcgccttaggataacttatgatctttatcctccagctctgacttggggcttctgggattcccaccaaaagatttgcattacagatttctttctcagtttaccccagtattttatatcaggcagcgtgactactctaaggtatccatttgttttacttttacaaacttaaccattccttttgtgtatctgaaccatctatgattagtatttctccctatactttgtagacaattgcagtcactccatatatcgtgaactacagtggtgctgtattccgtcaatacccaggtaatactttagtagaaagtatcaccagcagtacaaaattttgtttggcagtatatgtccgcttcaaaaagatcataaatttgtgcctttcaatccatcatgatatttttgtaacagaaccaaactaaatactaacatatgagaggtgcgattctgggttggcaatcgacatcatccttctcatcatccctattaggtactgatttgagtaaattatttttgtgttcagggccctggcaggtcatgcttaagcaagccgatggttcttatgcatgtgttgcagagagtgcagctcggttcactttgggacaggtcatacaaaattttgcttgcatgaattagttatgtcattttggagttgtggtgtatgatgttccgtgtttttcattcaggctaaggaagaactgttaagagttcttggtttgcaagaagaacaaggaagctcactagaatttctcagaagaggatacaaggtttgcatctttgtctcactttaattgtaaaatgcaaaaatgattagcataatcagcttcatatcatcatgctgatttcaaatgattcgttcgatgtacttctatccctgccacctcatgtgcaaactccaaattcaatatgaaagtttaaacttcattatcgtagcaggctagcagcctgtctcaaaataaaactttaagctctattatggttgcacctccaaagtaccttttgcaaatctgcatttcgtcaagagctagcattgttttaccatctaaagagttaacctgtaataatgcagaatgctacttggtgggaagagaatgttgatcaggagaaatcgtcagcatggcgaacttgaggttgaggccctgctgctgccttgtctgggtgctgatctgattggcggcgagtgcagacaggaacagaagaaaaaaatggttgtctgaaattgcagagcccaggcgacaaggatgcaaattgcctgtgctgcaattgtacattttgtgattgtaacatgttactgtgtgagtaacaggcattagagttttgagaggattttcctttctttttcgatgattatatatgtgttggactctgcttctttgaagcatgaagcaacttcacattttaaatggaaattcgtgttcatccaattgtactttctccccctccctaaaaagcaatatgaatggaaattatccttacaaaaaattgtttcggccactctggagattattctttttcatgctaaaatatgattatgattatttttattttttatcaagacaacattttttttcctttgtgatgttctcaaacacgataagccgtaggaaaataaacaaagcaataagaatagttcattaataaaagtgaatgctggaaaatagaactatcataaaaaaatcccctaaaattaccttgaaaataaagttttaaaattcgaattttgactttaactggtaagctaatatggtaaatatggtaaggttatgctcgttaagtattttagctttaaaaacttgaaaaattgattaatatgatctttttacaacgaaaaattcgcaaaaatgcactatttaatattttgggaaatttatgcgtcaaaaatgaggaattagaagttcgaatctagtaataagtattggcaataactctcagaactccagaagcttctattagtagggacctgtataaagatgcgtgagagctcaaggtcccatctgcaaaaacaccaccgcgacgaacgagcgaagaagtgggaacaagacttcaagagagagaggagagagatcgcggccggggacggagacgatggagacgcgacgagcaacctacagatccgccgcgctcctactcctcgccgccatcctcgcctccgccgcctccgcctcctccatcggcgacaagtgcgccgcctgcaaggccgttgccgtcagttcccgtattcttttctttctttttttttttgcccctctcgtcagttcatacgcgcacaattcactcatcctttggagcaccttgaagcaatttagttcgtattaaaatcgttttataccaggatgggaagaaattagcattccatattttccactccttgtgaaggagatcgaggcgtactgtcctagatctccaaacatttcctcggacattgtagaatttccaaagcgcatcgtttcactgatatggagtgcgcattgtagagatctgatgtatctgttgatcttgtttgcaggcagagctagagattggaatttcaagtgtgagtgaactctttttctgtctgcttttatttaactattctgtcataatttaaaatgctgatttggagtttatgtgtattggaaaatagctctgcaagtttcaaaatgattcaatatatttctttctgtaaaacagcagttcccataaacataatagcataggttcttctactgtccttgttattgtcactattggcaaattattaacttccaagagttctctaatgcaggagaaaccaagaaatcacttggacttgcgcaaccgcttaaattcaaaaggtcagcgtgaagggaaggtcattgattacaggtatgctaaccagcatgatcccttctctgctcaatcatcaggggcaacattcctatgtgttacaacattgttatcatttcatgtttcaacctatttgaatcctaattgtttggaaaccctttgccgcatcctttgttctatttacttgagggagagcgacgtcgtgtctgtcgtcccctatctctcattcgcacgagatttttctcaagggtgagcgtcacgagcgcatgtgagcgccaggagcacgtgtgagagggaggaaaacgggaaaatctggtgttagtttaacagaagtgcccacttttagttttgggatattttaggctttctcttggagagatcaattttttcgctacctattttcacttcaataagccaaaaaagaaatctttgggggaagattatacataatctcctagtgatgttcttagggactctttgaaatacagggttccaataatctaggtgattttagtgccacattttccggaatttgggttatcccaggatcggatcctatatcccttattaacactcccgataatctgggtgattttagtgccacattttccggaatttgggttatcccaggatccgatcctatatccctaattaacactcccggcgattctacccaactaggattaaaaaaacgcgaatattagggaaggacctaatatcaaataattagaaggggtgaggcttcgaacccaggtcgtctattccaccaccttgtggagctagtcggaagactacttgagtgtttctcaaaagagggatgcaacaaaggactttctaggaggtcacctatcctagtactctaggattacttatgattcttgaaaatccaactaattaacattctttgaactaaatacaccctataagtgtacatatataaataaaaaacaaatctataaattaaatgttgtgtcgtttaaattccaattatatcttgaaccacatgaaaaactcacgttacctcttgggtcacttgatgacatgcaaaaagaacaaattttaagacaataaggcctggtttagttcctaactttttctttaaatttttaacttttccatcacatcaaagctttcctacacatacaaatttccaatttttccgtttcatcgttccaatttcaatcaaactttcaattttgtcgtgaactaaacacatcctaattggaaataaatgatgtgaaacccaatgcgtatttcttagtatttattgggaaaagaaaatacttcctccgtcctctaatataagggattttgatattttgtttttaccattcatcttattaaaaatttgttcaaatataaaaaaatgaaaagttgtacttaaaatactttggttaataaagtaagtcacaaataaaataattaatatttttttaaaaaaattattaagacgaatagttaaaccgtacgaatagttaagaggacagagcctacttttgtcaacgagttggagttcgacgtggagcagcaatgaatagccacaaagtacggtagcttttcccatccacgtcacacttcacgctgtcacgtcgcgatctgctctctcttcccactgcagtgctgccgcgtgagcgtgaccgcgtcgtcgtccacggcgagctcgacaccatggccgccgccacggagcagccgcagcagatcaccgagatcgagcacgcccacctccccgtgcgtgggctcagacatctgcttctatttttcaattgcagtatgggcataagctcatgataatctgccatatttacatatgcatacatgttttttggggagaaatttgtattgatcattgttactttaacactaaatgtagagtctctttgtcattttaagtttcatttggtttcacacatacttgcttaatagatgtacaaaacttaccatatattttgtattggtatgtctttaactctgtttatgtggtgcagagtaagtgagcttcgagttgttgagcttctggatggcctatgtgataagatgcaagattataccctgcagaaggtagaaattccatccaattgttttagcattttttttactgcatactatgtccgcatttttgaattttgagactgaccttttcagttcactttttatattaagttgtaatataggtatctgaacttgttgatctggtgctattgtatatgatgcctgcatctgtccaagcattttagccatctaacaaattttgctgtatgcagttggaatcaggagaaaaaggatgggtgaaagtagcagattggaacagttttaaaactggtaatcttggacatttttatcactcgtaaccgcaaaataaatctggagccctgatctgtacattcttgtactcaatatgttaattcgcttatcctgtttaatagcactcttacacgaccatctcaggcaatggtgcaagcacttgatttagactgtacatccggagactatagcctgctttgttattttgagcattgttaatatgctcaccatgataatacaatatacaaacaagttttgcatacattattgagacggtattcatcccatacgtggaaatgaactcaatggaatatatttatgctaaatgagaagcaaacaacaggtgctgtggtttttgcaatgaacttatcacaatagaatcactgaaatagtatccaaaattgctagctacctgtgtttctgtattgcatttgtctcagtgaaagtaataaaacagtatttccaaatactaactgtggactactcacttcattgttcttttgtagaaaagaaggccgcagcacgagcacactccaaaaatttatcctcattctgtggaaggtatgacaaacaatatctatttcctccctaacccttcttgattttttatttgttttttggatttaaaagttgttttattgcatatctgacctcttattacaattttttaatagcacttcttgttgcaaacactttggaacggtgtagtttctggcaggtgtcattttccatagataaaagggcctctattctcacaaataaatttcattatgttgaacttaaattagattatttatttttaggtgcatcgtacacaaacataatttcataaaaaaaatgagtacatatctgtccacataggccttttctggttactaatattttttttccttactggctaatgttttttttattgttgacctgatttatccaggatgaataaactcttaataatctatatgctttgaaagtgagaagttattgcttgtctaaaaataaccttttacacctttacttcttttggtttctaatttagactgttgtgtactgaggggatgaactgacaaagttcactcatggtgcaggttactggaggaaactgaggatgaggtaggctgcttctcttggatgacatttatacattactttttttatactagcaaatatcgtctgaattttcccgtttcttgacagctgtgttttgttatgaactatacagatctatcataatttagttaaaaatagggcctcatctagagctttttttggttgcagctttctgagtggataaaaacgagctccgcagaatcaggaaatgtcagcagagcactttgtgaagatattagcaaacactgtcagtctacaaggtatgtgctatgaatatgaatcgaacattttgtcatcatgaaataagagattgctgtactcgcagaattttctttgcagacctctagttcactaacaatcctttccctctgtttccagtgctaccatcgagatcgacgacgaactataacaccaaagcattctggtgccatctttatctcacaaagcaaagcaggcgaagacctggaaagcgtagaggaacaaactcaaatagtttctgatttcatatgttgtatcactgcaattcatgtccttaaaatgggagaattgcaattcgttccatatagtgtctgtctatctggactaatctgttgagaacattcgaacatgagacaaattttgcatactaaaattacggttgaaagcaacacagttaactgattcagggggacttttgcaaaacgcctatttctgatgcaatcatggtttgcaataacgattggttttttgcgaaaatcacttggttttcgtgaagttgctggggataggtttgtaaaaactgagttttttttagccaattattttattatgggcttgaccgaaagtcattggtttttatcgggtttcattcggtttgcggcacaccgacagaagtataactagatcttgttctgttttcagatatagtttacacgaaggtttcccagtgtttaagaaatcattcaagttctgcactgaagaatttccacattccaaatgggctccatgaaccaaaattgtttttcattggaggtgtagtgtataactacgacgcattcctttcgcatgtacccatgcatactatcttgtgaaatgctcgttgaatcaccaaattatcctccattaattaaaaacccaaacgatctcgtagtaattcctattaaattcatgtaatattccaacagagcccatagtaattttgagtgcaaatgcagcaatactttgttatgtactaccaataaaaattccaacttgcaaaaaaggaaaaaaaaacagagaaaagttacaactttgaaatccgagaccaagagcacgcggaagttgactttgaaattcatcaatttgagtcctccgatttttccgaggggcaatatgcaaatcgcacaaaaaaaatgaaatttatcaactcgatttcccctcatttattgactgctactagtagtaccactatagaaaaagatcaggtcagaattattattacagtaaataaaaaagaaaataaatgcaaagatagaagagaatagtagtagtatagtgagtctcgtcgcagtgagagagagagaggagtcgagtagatagatagatagatcggcgtgggagaagacgacatcgccggcgacgagaccagatcgatcgccgaggtatcgcctccctccccgaccgagcagggtcgccgccgttcgttcctcttgctgcttccgccgcatccatcctggtgagcacatcctcccgccaccgccgccgatccccatccatcgcgcgagcgagtcagggtcgccgtcgttcgcccttctgcttccgccgcatccgttttgcgttagcccacgcacttttttttcctcagatttgcgttaaccctagctctagctgctcctgttctagaaatttgccttggccataatactaatagcagtttgtttgttcccaaaaaggcccatgtcccatgttagatccgccgccactgtgctactgatcttctccgaattgtataatttaacgcatatgctcttttgtatctcagcggggactaaaccttgaagcatctgggctgttgtttcaccattgtagtggattccacttcggaactgaacttttctagttgtttccgtgacaatgaaaactcacgagagagctgctaatttggcccttgcaggtatacatttgtattcggctgagtcatcacagcattggttctgtttattaccattttctagtcctttgaacaaactgggtatttgctgagctgcagttctatgtattctaacattgtacgcaggtttgagcttggcaccccttgtggttaaagtagagccaaatgtgaacgtcatattgacagcatgtcttgctgtctatgtgggctgttaccgttctgtcaagccgactccaccctctgtaagcaatatgcttcagtttgttttgttatctaccgagccatctgctgggtgctaatgtgataggttgttcacaaaattttctgcatatggctagaataacttgattcctgcatttgttcttatgtaggagacaatgtccaaggagcatgctatgcggtttcctttggtgggaagtgctatgcttctctctctgttccttctattcaagtttctctcgaaagacttggtcaatgctgttctcactgcctactttttcatccttggcattgccgctctctggtaagtccaaactctccttggaagagctttttcattcatgtaactacttaatactgtatctgtgcaattaagattgttcatgtgcttattttttttctgatgcagtgcaacattgctgccttccataaaacgattccttccaaaagaatggaatgataatgccatcgtttggtgtgctccatttttccactgtatgtctgtaggacccaaacctcttcttttttttttttttgctcaactcattggttcaattgtgtatcatatgccagattgttgcatctgtgtatctgtcagattggtgcaattatgaatcatgttacaagctcatgtcttggtggcctttttaagttcattaatttcttatttcagcgctctcagtggagtttaccaagtctcaagttgttgcatcaatcccaggatttttcttttgcatatggtatgctgcgaagaagcattggctagcaaacaatgttttggggatttctttctgcattcaggtatgcttttgtgttattttgagatataaggttaatatgcattattgaaataactatggttcaagagcttcacaaatatgttctgttttcctcccaaactttacttggagagaaacctacttgattctctttatcttacagggaattgagatgctatcacttggatcattcaaaactggtgctattctcttggtatgggctgtttgtactgaactgaaacttatattttctggcagaaatcttattactttttttcaccattcttccattaaagccattacttagtagagcatgtcaatacaatttgaattatctgacactgtagaatttatgtttgtctttcatttgcctatgaaattaaaatcctgttatatttgtagaaactattgcactgcttgctgtactttgtaaatcactattaagttgtaacgcttatgtatcacgggatttcctttttgattcaggctggcctctttttctatgatattttctgggttttcttcactcctgttatggtcagtgttgcaaaatcatttgatgcaccgataaaggttagtgttctttataagtgattttgactcttgttttgatacaaaatgtctttttctttttacaaaaaaaggctaatctggttatccccttttttctgcatagcttctatttccaacaggagatgctgcacgcccattctctatgcttgggcttggtgacattgtgatacctggttagtaatgaaatctttagaatgtttagtgctattttttttctggtctatgatttctgattggataccgatgactgatgaatgccatatgagagtgacaacttgtttgaagtcatgatccatagcaagttgttagaactggattatttgataaaaaaatatccaatttaaaaattgtatatgtttaccatatcatttgagtacctttttctgtggttctaaatgtagatatagttagggttctttttgctgatacaaggagtgtaggttcaagtcttgcagaaaataattttaacttaaactactttgttatccagatgagtgcaacaagattagcttcaaagttcgaactacttggttgttgtataatgagggtatatgttgatattacttggttatagttgactttgaagccctggcaatgattcgtcatttttattccagtgataatttatgttagttgggaggtgtgtgtgcatgccttttttgaatgatgcgttgaactcattgttatctttagtagcactgaagtgggagtaacatttgatgctagtcgccacagataattcatcttctcttagcattctctgcaattcttcatccttcatgattgaagatcatgaaattctcacatatttctgcaagcagcaactcttctattaacaaataatactcacttctacttttgtttccaggtatatttgttgcgctagcactgcggtttgatgtctcaagaggaattaagaaccgctacttcaatagtgcatttttgggttatacggtgggtttgaccgtgacgataattgtgatgaactggtttcaagccgcacaggtgagtcatgttacttgggattcttgccatcatgtttcctccactcattttcaaggcacatcataagagtgagtttagttcgtagattatttaaacaaaatgaattgttatacatacattaattaaacaaaggtaattgtggtggtgaatttgcaaccatgtaacctccacacattttttacgaatcatccccaatatttcatcaggaacatgcttgaggaccttttttttttcatttttgtctgtagcaaattcatgcattttgtgagtagcacaaagaaaactataaacctataaaccttatgaagggaaaaataaaaaaaaaagaaaacaagaaaattacatcaggatccaactgttactcttgttactccaattataaaaaggagaaagttgcatctgatttgtgtcatctctgaaatattaacgcactctttgtttttgcagcctgccctcttgtacattgttcctggtgtgattggttttgttgctgttcactgtttatggaatggagaagtcaagccagtaagtctgttaccactgaacatggttgttcccacttgtccattactctgaaccttgagagtagctcaatgaataccattgtcgagcgtgttgcgtgtacatagtagtatttattctgttgaagggcccctttttgtgcttaattactgaagactcgagagtaataacctttggtgcatgctccttaaatgctaccataagacatgggagcacctgtctttgacatgcaagaaagagggttctatatatatgataatatatacaaattcttagtggaatggcactgcatgttcaagatgttatatatcacttgcagctaaacctttctatttcctaagcctgaagcaatgaccataccgtttatacaatcatttggccttgtggtggtggttgttacagaatatgtgatttaggtgctgaaaggcccagaacactttatgatctctagaacacagatggaatactttggtgccaacataaaaaaaaaacatcttttctttctttatattatatattgtgatttgtgactataaatatgtttgaaaatgctatactaactgacattttattacattgccagctcctggagtacaacgagtcaaaggctgaagaggaagatgctgttgaagaagatactgatagcaaacagaacaaaaaggaggagtagcactctaacagcagggcaagaaaaggcagaaatttcatgtaaggtcgtcggcagctaagtaggctggatgacctctcggataccagctcacttaagaacttagaaatgattcgcatgatagaaacccttttttgatttaagaattgtttggtctggtgattagaagagaagagagtagattcttaagaggcctgccaatatggtccagtggcttgactttacccggtaccccttttgctttagtactgacttataatggtggtacaaaggatttacctgaatttttggtctggcaaatagcggtttgtgatatctttcttggtaccttctcttgtttgattgacaaaaccatgcagatgcatcccatcttccgtttggaactatggaagtttcttttatgaggaattgcactctttctcgcaaaaggcttgaaagaccaaattatttgcatcctccagtgtttcaaaattttactgaattaggatttactcttttctgattgaattatgtaacaggctaacagtgtgtcactgcattttgtatggttgtatttgaatgttcatgaacagagtttactttagcttccttcaaagagaatatttcctctagttaccacttttgcaaaaggaagggaagcttgagtgcagaaggaactaacagtgtctcacttagtcaagagtgcgatgcgactgaaagaatcgaacccaattcatcgctgacatccaaagtcacgcctggaaatagatatgcatctctttcactttcctactactttttcttcttgccctatagagttcaacaaatgcatgttccaatggtcctatcttgggacatctacctgtctcgagtgtttttactcttggactcaacttggaacctataccattctgcctataaaggccaggaaccattcctaaaaaacttggaccatcgtgttattaccaagacatgtcgcatgtgggcacacaccactacattacatttacgcctgggattgttttgactattagtagtacatataatattcgtctttatatagcaacctgatactaaatcataacctagtccacattctagattcgtaggatatgtcatatttaatatcaaattgccatatgtttaatagatgaaaaatgttgaataggactgggtcctatgtcagttgatatttgttgttgaataagctacaatagtaaagcaatagaaatatgaattacctcggtcccagatgacatattctaatactataaaacatttgataaagagagagacagagcattaagctgagctttaaaacccattacaatgagagagagagagagagagaagagaaatcatttatttatttctcttcgctatgctatgtagtaacaccatggccttgatatttgctactcctaaatgtttactttttattccctctattccaaattgatctacatatagtttttttaggttatttttaaatgatctacatatttgtgttcatttattgagtctattcgttatttgtgcattggagtaaatgaacattgatgcatgcattcataaacacaagtatttataacccacatgcaatatcttgatttgctattggctagaaaatattggggatggtgtatgcattgagtttgttgctagagtaaatatagtatgagcaaaatattgaggatggtgcatgcattgagtttgttgctagagtaaatatagtatgagagagctattagcttttcttggtcttgtgtacctatgaaatatgtagatcaatttagaatggaaggagtacttctaaatgtttataacccagtaataagcctttatttactgctttctgtctatctttggaccaaattgaagatgtccatataaatggactatgaagctcacgtatttctcaagacattgagaaggtcttatcaattaaatttccatttacacgggtaaagagaaaacacgtttgcataaataagatttaacacatcaattgatgaagtagtatactcccttcgtcccaaaataaatttgttttccactcatcccatgcatactaataaaaaccaaaagactagaatactccatattttatcaaatcctaatgcaattatttctctcttttatcaactctcaatgcacttattcactactccctctgcctcataatataagggattttggagagatgcgacatatcctaggactatgaatctggacggaaaaatcccttatatgttacatccctagtatatgttacatccctccaaaatcccttatattttaggatggagggagtatttttatgaactccggtgcaatattgttcgaaagtgattttattttgagataaatgagggagataaaaaataatattattttgagacaaggagtattagttactttacccctccaccgctaagccaaagaatttaacacaccaatggataaagtcgtatgctttactcaaattatagtcacaagctagaaccaaggctgctagttcagtgcagtgattggtcacgcacttagatctacgcaaatatggaatcatattttttcaattactagtactttctagttcatgtgcattacagttttactactatctatttattcttttctcttttcttagcagtgaacaaccgaaagttagcttatcaactttctgattgccatgcagtacataatataccacataaagcccaaaatcaactagctttgtggtatctataaattaaaatacaatatatagacacaccatagacctgtgcttccagctttgtgagatgccaaactaatgttcgttgatatatatgtatgttcatacgcatttgcacatcgatttcaagtgtaaattaattaatttatccggggaattttccggcagaaggatcagatgctagctaatcatatctggacttactgtcagtctcgatatatagtagtaccaagcaagtcttcctccctttaaatggagtcttatattccgacgtgctcaaagggggaaaggaaagaaaagaaagctactggcatgcatatatgcagatataccctgaatcgacagctcaaaaaaaatattctcagagtattgctttgcaaaatggaatataaatatactccctccgtccaaaaaaaaaacccaattctgggtttgaatctggactcactatgtccagattcaaacccaggattaggttttttttgagacggaggaagtatattttagataatagaatatttaattgagtaataaaacattaggttcatgaacacataaaaaaaaacttcctccgtactcgtaaaggaagtcgtttaagacaatgtttaagtcaaaccttggaaatataaatcataaataactatcaagttgttaagtttaaaaatgtaaaaattatatgaatatatttgtcttagaaaatactttcataaaagtatacatatatcacttttcaataaatatttttttatagaaacatgaagtcaaagttgtattttggagatcgtgtcgttgttcaaaacgacttactttgcgagtacggagggagtatcagagaacataaacatatcatgttgtctcacaacaacctaacactactacaaccgtcaacttcaaggcatataaagtctatgaagtactcttgagaatgtgttcaagaaggtccatcgtttttctgtcggtatcgtccacttaaagtcggtgctatgcagtaagctggactaattaacaagatgcaattaatcccccgaccagctttgctcatataaggtgaagcaacagggacaattaaagctagttttcaaaaataaaaaaaggacaattaaagctgtaagttccctaactttttttttcctgaaaactgtaatctccctgaccagataggatatatatgatgcctagcttgtaatggcgatgaagcataagaaaaagacttgcgcttacactacatatatgggttatgtttattcgatcgatcgtcgtcaatcagatgcatgtgctcaattcacgtgaaaaaactaaagtttttgaaagaatctaaaggagttctgacaaagtctcaagttggtcgaactgacatattttaattaaggtttagtttagttcccaactttttttttcaaactttcaacttgaccatcacatccaaatttttacacacataaacttccaacttttctgtcacatcgttccaattttaattaaagtttcaattttaacgtgaactaaacacaccctaaattattgttcatctcaacccctaattactggagtaattagtcccggtcactccactagagtatgacgagcaacaacccccatcaatctctttttactacacaatcatgctacaacctctatccgttgatttttataaagcatatgcttattttaaaaaagttttcaaggttcactactttgaccattatttttttataagatatatattcttacaaactttgaaaccaatattgtttgaactctctttaaagtatgatttaattggtgtaatttttacaccgaatgtatacttgtagttttactaattgttgatcaacatctacaaagttcgaaattttttaaaacaaaatatatcctataagaatcctaaactaaattaaataatccatgacgtaaaaaataatcaaacataatcaagctaggttgctaaaaaataaaccccatgtgagaaacaggatcaatataccatgcagctactatcataaactggactcttcaggacatatatatgcatagatagaggaggaaataaaataaatgtgtgaactggaagagtcattgtgtgactcatgagaacggctcaactaatttgctacaccacaagtctacaactacactaatcaattaactagactgtccatgcatgcaggatgaacgatgtgtcaactttgacatcatcgatcactacgtggtgtagactcgtgatacacgcttgatttgtttttttcatgctagctaacaagctagttttgcacggtttgttcttccatatatactaccttcttcatatttttatccaacgtttgaccattcgtcttatttaaaaaatttatataattatcatttattttattgtgacttgattcatcatcaaatgttttttaagcatgacataaatattttcatatttgcataaaaattttgaataagacgaatggtcaaacgttgaataaaaagtcaatggcgtcatacattaaaatacggagggagtatatattttaccttaccctaaaattgagatactaccggtggaaatcaccacaaaattcatatatatactggtttctaatttctactagtacctttcatctattttcattcaatatacgatatttcacttatactgtcaactcaatcactagtaataaaatagaaataattggtcaataaaatgagtaaaagaccttgcaaatcaacaattcaaattatatatatatatatatatatatatatatatatatatatatatatatatatatatatatatatatatatatatatatatatatctactggaggccaccatataaaagtaattttttttggatctacccactgtggtgcctcagcttgctttaattaatttactacagcaagccatgcaattggcatacatataaatatacaaattataggccaattggtcatttatattgatattgttaattagctagtataccttttattgaaaatgagataagtacttgcaaatgagccaatccagtcgcttacacaaactagcactttttttctttaagctccagcactttatttattgaaaacgactggaagttcggatttccatgcgtcacttatatatcctgtattttgtcagtctctgaaaatacaaaaagagaagagacatgatactccaatattttcaagtgacaaaattccaaccgagattttccatgtatattattctcagagcaattatagatatctggggcctaatttcataccaaaacgtacttacgagagtgacaggtatacagagaatatcagatgtatgctgattgagaccgtacctgacccattcctaacttcctactctctccgtccaaaaaaaaaaaaaggcaaaccctggttttctgtgtccaattttgactgtccgtcttatatgaaatttttttataattcgtattttcattattgttagatgataaaacatgattaatattttatacgtgacttgtctttttaatttttttcataatttttttaaataagacggataatcaaacgttgggtacggaaaccagggtttatctttttttggacggaatgagtatatatgatcctatatctgatgcaagaagaatatatacccatcctgcacaccaatttattctgaaatctgttaatctaaccaaacatcaactgggccacataatattccagtcacagtagaatgatcttaagttcagaagtaaaaagaaatgtgtggatattcctttctttgtccaatcacgcactctagtctcaaggttgcatgctaccacagcaatggcgaggtggacagcaatagtgatatggtggtggatatgcagagatggaccatgaggaaggccttggcgttagagctggtccaccacgtgtatcttgtattcttgtagaccgctgcttaattttctccatccacgtatccaactttggtccgcagcttattataagccgtaacacctattatagattttaaaatataattacaaataaaattttatatatgtctactacttagcaactcaaaagtcgatgtaaaaaataatctacaataaaataacatcaaaatcaattaaatttcgaattttagatattccttaggttttttaattcttttgagagaggttttttttaatattcagagtctagaggtggagcgacagatgttaaacaattttggtttcaagctcggtgctaggttaaaacttagaagaagatctctagttgttttcatcgttacacgtgacttgcaaggcacgtcataagcggggtaaagggaccatcggggttttctttcggttacgtagtgagaaatttaaaatacgccaggttgtctctagagtcgagtttttaatagttactccctccgtttcacaatgtaagactttctagtattgctcacatacatatatatgttaatgaatctaaacacatacatatgtctagattcattaacatctaaatgaatgtgggtaatgctagaaagtcttacattgtgaaacagagggagtaatatttaattagtcacgcattaattataaaagcttctcagataagataggcagttaattatctgaaacactccttcgagcgggccatctgactacaaatatgtgcacaaagaggaatccaattcttcatcacaagtttttaccaaatgccatttatagtaattatgaatttaggaatactaggagatggtatataccatcgaaacatcgtaaatatgatacctaagatatcaggcctgataccgaactatattagacctgatacacaagtaataacagacaaactgttccaattttgctatgaagaattggggctcatggatgatgtggcagatcatgtcctcttttcacagggttcttcacttcttcctggccagggaagcatttgttcctatcaaaaactaaaaaaaaaaggaagcatttgctatcatgggtcccaccagccatgtaccatcttcctcctctgtcccatcccctctctataatacccaagcaccagaaaatgtgctgaaaatgagcttcgcgaaagctcacgcggtcttcttcagagagaggggtccctactccgtgtcgagctgagcagcagcagcagcagcagcccgcgagcccaaagatttcctctttcgtgggggagacacgccaaatccaatccgtaagttgattttctctctctcagattgatggatgctaccgcttagcaaagaatgtcgcatctttgtaccgtttctcgttcttggctccgaatctcatctttttcctcctgccaatgcgtacgcattcgtgttttttttcttgggctagttcccctcccctactggttgttgattgatcctaagtaataatggttcctgacattcttggggatatgtccatgcgttgagttcttgtaggttcaatccgttcatttttcagtggtagataacaagcacaaaacacatgaaaggttgagttttttttttcctgtttaggtcgtttggttacttgccattccagacttccactcactgtttcctgcaggtctaaaagtctcaggggagcattgtgcagtagtatgtttttttttaaggaaatgcagtagtatgtttgttttgtttgtttattgatgtctgattgacacaggggatagaataaatacttccatgggttcttatgcctagtgcaatggaaggattagcactgcaactttcgttcttttcacagacaaagtgtatggaatatgtggagtccacaactccacattgcttcttggtttgttgtgcagagtccgtatgaacaaagctggcaccgaatcacgcttgcccaatgaaactcggatgtgccttacctttcttttagcctgatgctcatcactgttgtgatttgttctgggatcgcccttctgtgaagaaatcggatagcttgcatcagtcattacattgtgtaagcaatagcataccagaaatgagtgtttccataattcgattcgtcatgtatcgagtttaatcatctgcatttgttatgtcacgttgtttttcttgcaatatatgggatgaatctgtcgattttgttctcataattacttccttcacattggcatctgttttgtcactttggtgtgttccttttctttgttatttttttcctttcaacttttgtactgaagattcaaatgttgatagaaatttacatggggtatgctagtttcggaagaaaaaaaaatgatttacgcgttgttatctcaatgacaaatactctctatcttctttgtggcaggagttctccaactcatcaataatctgcaagatgtgaataagtctcaagtagactttgcaccatttgagacacaatgaagataggtctgctcatgttgcttgttctcttcctggtcatgtcccctgatgggatccgcaggagcttagccgcgaggccttctattgtgaatattggggccattcttcgatttaactccaccattggaggtgtttcgatgattgctatccaggcagccttggaggatattaattctgattcaacaattctaaatggaacaactttaaaagttgacatgagggatacaaattgtgatgatggtttccttgggatggttgaaggtaggctagctgttacactcctttcattttgtttgcattgttaaatagaatgtgctttgtgttgtggagttctgatgatactacattctttgtatcagctttgcagttcatggagactgatgtgattgcaattattggcccacagtgctcaacaattgcacatatcgtttcatatgtagcaaatgagctccgagtccctcttatgtcctttgcatctgatgcaactttgtcatcaattcagttcccattctttgttcgaactgctcccagtgatctctatcaaatggatgctgtagctgcaatagttgactactaccgttggaagatagtgactgctatatatattgatgatgattatggccgaaatggaatagccacattggatgatgcacttactcaaaggcgctgcaaaatctcctacaagattgcatttcctgcaaatgctagaaagagcgacctcataaatttattggtcagcgttagttatatggagtctcgtgttatcatcctccatactggtgctggacctggactcaagattttctctctggcgaaccaactaagcatgatgggcaatggctatgtatggattgcaactgattggctttctgcttatctcgatgctaattcatcggttcctgatgagactatgtatggcatgcaaggagttctcactttacgcccacacattcctgaatcaaagatgaagagtaatttgatctccaagtggagcaggttaagcaagaagtacagttatagttatctccgcacaagttcatatgctttttatgtttatgatagtgtatgggcagtagctcgggctttggatgctttctttgatgatggtgggaagatttccttttcaaatgattcaaggctgcgtgatgaaactggaggtactcttcaccttgaagcaatgagtatttttgatatgggaaataacttgttggagaagattagaaaggcaaacttcactggggtgtctgggcaagtgcaatttgatgctactggtgacctcattcatcctgcttatgatgtcataaatataattggaaatggcatgcggacagttggctattggtcaaattattctagcttgctgtcgactgtccttccggaggttctctattcagagcctcctaacaattctctagctaatcaacatctatatgatgttatttggcctgggcagactgcacaaacgcctcgaggctgggtttttccttctaatgctaaggagttgaaaattggtgtccccaacagatttagcttcagagaatttgtcacaaaagataatgttactggatcaatgaagggctattgcattgatgtctttactcaggcattggctttgcttccttatcctgttacatacaagtttataccatttgggggtggtaatgaaaatccacattatgacaaactcgtacaaatggttgaggataacgtaagtatggacaagtgatgcttttcttcttctgcactttctatcacaggtgatattgatcagaattttcctatcctgcaggagtttgacgcagcaataggggatattgcaattacaatgagcaggactgtaactactgatttcacccagcccttcattgaatctggcttggttatcttggctccagttaaaaaacatattgttaattcctgggcattcttgcagccattcactcttcagatgtggtgtgttactggattattctttcttgttgtgggtgcagttgtttgggttcttgaacatcgaataaatgacgaattccgtggctcaccgcgagaacaaataattactattttctggtatggagctgatttgaacattttgtatcatctgcccacttgtcaatcaatctacagatattaagatacaaaaaaaccttttttgcaatacattgcacatagctagcaccttaaaaatcctgtttctatatttctacacagccaagtcctccaatttgcatgtgtaaatgaggtattgatgagcaatgcacctaaaccttgttttacgtattctctgcatatgcagaatctattgcatatgatagtatgatgcattacttgcacattgcttgcttgatggtgtgcatctttgctaccaaatttgtgaccttaatctcaatttttatattctacaggttcagcttttcaaccttgttttttgcacacagtgagtaaaccaaccttctattatatgttttttggggcaaaagtaatatttcagtctgacacattgctttcatctctatctgctccaggagaaaataccatgagtaccttaggacgtggtgtcttgatcatatggctatttgttgttttaatcattcaatccagctatactgcaagtcttacttccatcctgactgttcaacaactcgatacttctataagaggaattgatgacctgaaaaatagtgatggtcctattggtttccaagttggttcttttgcagaagaatacatggtcagggagctgaacatctcacggtcgaggctgagagctcttggttctccagaagaatacgctgaagcgcttaagcatggccctaagagaggaggtgtcatggccattgtagatgagcgcccctacgttgaactgtttttgtcaacttattgcaagattgcagttgctggttcggatttcaccagcagaggatggggctttgtaagtacatttaaacttgattttctttaacatggattagaaaaacaaagagaaaacaactagacacaaaatataacaacttagcttatgaagtactacttgtttctcatcattaaaacatagtgcttaataaagttcactcttatcaggcatttccaagagactcccctttgcaaattgacctatcgactgcgatcctgtcactgtcggagaacggggaactgcagaggatccatgacaaatggctcaagactagcgagtgctcagccgacaacaccgagtttgtcgactcggatcagctccgccttgagagcttctggggcctgttcctcatttgtggtatcgcatgtgtcatcgcgctgctcatctactttttcaccaccgtacgcaaattcctcaggcatgaacctccagaagatccaacacctcgtccaggcggatcaacaactcttccagacgaacgaacacccccaaagaacggacaagagaaatgcaactgcagaaatttcatctcatttcttgatcacaaggagccaccaaagaagaagcggtccttgagtttgacgccgacaacgccattgagcaactttactgcccttgaaatagaaggacctgtgaggacagtcaggaatggtagtgtcgttgacatatagaactagtgtgtgtaaaaagctgagatgttatatattttggatctgagatatgccatctttcggtcaatctcctcaattttagttgagagaaaatataatcagaggctgcataagatgctatctgtagatttcaagcaaatccggtgatgggaaaaattcatttgaggccagtttggcaactgaaaaactgtatagaaagttattcttgtccttgatggtattttgaatggaggaaatatatacgtctgtttgattaattttttcatgaactttctcttgtcatgcttgatgtgtaccttgtccctgaatctatgtgagcagtcaagtcttcaacttttctgtctaaaccatatgaaatcgcaggtgtctcgattttgaaatgctaaaggaatctgttgtgcacttgtgattgcttgaggtgtactgcacataagagaactataaagcactggatgcagaagtcctttgctgctgggaaaagctcccatttttttgaactgaatttgcaggctatatgtttcaaaaaagaaaaaaaaaggaatttgcaggctcataatacataatccattctagttaaatgtatcagaataaaacaggtcactaacaagttttgtagttgcaacttagcacttattattagtttgagtaattagctgcaatacattatgacatataagaaaatcaagttaacaacgaaataataacaattggaaaaatataaaaaaaaggggggagatggcttttttatttttttttttgaatggaaatggaatattctgaatttctgaattattctcggtagacaggtagcatctttatggatatgatatgcgcgccatttcggctcttctcctccgtccccttcctccgctggattcctccatggcttcctcttccctcccttctagaaccttctaccgccactcgcttccctcctccgcacctccacctccttcgagaggggcctgcgccgccgcatgctgctgcctccgcgcggccgtctcccggcggcgggcagccgcgcagctgctctccgccgccggattcttgatcgccgtctcgccgccttcgctagccgcgcggaggggccgcatggtcgtgtcgctggaggactacgtcacttcacgtacgctcttggtttttttttggtttctgattttgccatcagatttgggataaagcgtgtatttcttgtcaagaacaaaagaaaaggaagaaaaaggcagtaaccacatctaacttgtgctgcaaaagaatcttggatatccaagaaatttcagcttttctagataatctggtggcatgattttatactgtaaatgcagcgtgcttttagatcaatagcattcctgaattctcactgtaaacatcaataacatctgaatttagtttttttccccgagtggtttggttgatttcaaaatgtttgggcacagctgatggcctgaagtactatgatcttgttgaagggaagggtccaactgctgaaaagggctcaactgtgcaggtaatttctcccacctgcacacaattccccattctttcattcctaactgaagtgaaactaatggctatattctcttctcaaggtccattttgattgcatataccgtggcatcaccgctgtgtcaagccgcgaagccaaactactggcagggaaccggagtattgcgcaggttatgaggcaaatcactcctgaagtttgaatgctagtacttttgctctaggacaataagaactaacatgtctgcatctcttcttctagtagccttatgagttcagtgtcggatcgctgcccgggaaagagcgaaagcgggaatttgtagacagtgccaatgggttatactcagcacaggcgtcaccgaaacctcctgccgcaatgtacacaataactgaagggatgaaagtggggggaaaggtatgtacaaggcaaatagccaaagggttgtactcagtggcaggctaagaatgtagcctttgtatctttactttattattgacttggtcatctgttgttctgtattctggtaatgcagaggagagtaattgtccctccagagctcggatatgggaaaaaggggatgaatgagataccggtaacatttcagaatattgaaacagtttctcatgtagtttgatttagtatttaagcacatccaggtactgaagtggtgtagtttgaatccatgcttgtttgcagcctgatgctccttttgaactcgatatagagcttttggaagttgtccctcctgcagagaaatgaccatttttgtttgcaatggatggggaactttcatgaggtattaataggaagtttcacaggttttagtgacaaacgttaatggaattataacattttgttttcttgctgattgttgaacagatatgtaaccaaatatgttcatatgatattttgccgggacatgacttgtttgcccactcacaaggagaaaatagaacaagaagcaaagtcaagtaggtaaaagacatgtactaattttgttattccttatgccgaagcaatattggatcaaaaatattctccacaatgtcgtggagcttgattgattatatggaatggtgatatgatctctctttgtgaactctgcatcctttcgctcaaaggtcctcggggccattgatatcctgaaatgagagaatacattttgtttgagatatatgtttatatttcaaataaaatagtgtttcagtggatgaatagaatgctaaaatttagctcctcatgtaagattgtattgctgtgaattatctacaaattatcctgactgataaatagttatatgtttttctatggccatcccagataaacagtcatatgtgccaaagttagatcatacgatatctgtttttaaactgcaaatttctacatcaatgatattgtgcttcttgggagaaaaagtaccttgttctcgatcactgctccatctgggatttccagtttgacaccaggttgggctgtgatggtcaccttgccctttaaaagataaagagaaaaatatgatttcattgtttaaacactgatcaatgagaagtgaagctgtactctgaattaagattgtgtaaacacagcatataaaaggttgcatacagatatgcagtatttcaaaaatacatgaaaaatagtccaaatattttctgtaagaactataactacaagaaagactataattttaagcaactttggcaaaagtaccttcaatgtgatgctagagccaaaccaaacatcaccggaaaccttcaaggtgtcaagctcaacaatgctggggattgacttgaagcgaccaaggaaacacccgacctgccattacgcgaagaaggatcagttaatttcatttgaactcatgaactaaattaaagcttttgcatgaggaaataatgttggaaggaactataccttcttgaactctggacccagttcaattgagggattcgatgggtttgttctggccgggttgcgtgtaacaaagccatcaaccaaggtatatagatcagactgcaagggtgaaacagttaagttagaatgagtgttaccctaaaaagtttactcagagtgtcatacagacctgtactagctgcaaatctgatgttgccttcactggtaggaaccgggaccttggaacattgataccaattgcgtgatcaaagaactggtacacaaaaatatgacttatcatctttgtatgttaggaaaaagaatgatgatggttatgtagtaatttgttagtaccctgattgctgcaccagctgctgtttccaactgaagaactttaactccatccacttcctgaaattatatgttgcacatgtcagttgtttgtttaattcttctcaaatcattggacagtaatagtgcattgttaccttagggtttggaatgatctccatctttagtgcatcagcctcaacaaggcgcttgatagccttcaagttcacccatctaccaaaaccggcagcaacattagataacattgggacaatctcatctaaaatggaataaagactatatatgaatccacttacagattgttcgtgttgaagatcttgaatttctcgatggatttgaattcattcacctatgtttcagaaaagtgtgaaagcaacctcagataagttctataatatatttagtctaatttgatgtcacaacttaattacattacttacatgtgcatcaggaacttgtgcaatctccaggagctggaaagcaaaaatattatcgtcaccaaaacagcagttacataatggttgaaaattatcctccaaagaaactcaagtctagcacagcaacttgtttatatgttcagtactccaagtaattaaattgcatcattgcggttggtaaaacaaggaagaaccaaagtttacctgaaccttgtcttcatatgagatcagtgtgccacctttaacatcagccagagttttcggggtaacctaaaaatggattttaaaactttactaaccaactatatgtgtagtatcttactcattcgataccacgcaatcacatacctccatgcaatattcattctgtttgtggatcaaatggttcagtatctctgttcaatagttaagtacattcccaaaaagctctcctttcttaaccagaaagtctgtaaagctaatatggtgaattaatggaataactaagaactatatatataaggatactcatgtccactatagcacccaagttatctgagtttgcaatgaacacatactcctttccctgcaataggataaaaagggtgatattacatgcatgcatgaaaactttgtatgaaatgtgggagctgatagtattcctagatgacaatcacaaacctgtgaaagtaacaaatcaagcttgccactgttcatcagggatgggaagatatcaccatggccaggagggtacctgaaaaaatgtgtaatgcaaaggttgtaaaaaattcaaattattcgcctagttcatcttgctgatgtagcgatctatgaagaatggcttaccagccatccttgcaggtcttccccttggaaggccatggcaagaactcatcggctaccacacgaggatactggctctgcattggatcaaatttgttttggtgtcagtagcattttgtaaaacttggcgaaaacaaggaaattcagcagacatgcctgattgaaagtatggacttcaatgttcgaattggtgtatttctcaacaatctgcaggaaaagcgtgccggttagtactctgaaatttgttcagtcagaaaaggttttgtcaggtaagaagagattgccttcaaggtgtcttcatgggtgttgaatgagttcatcagaagcagtgggacattgctgccatacttcttgttgagggactgcaaaagaaagccatgtcaccgaatgccataatgcagtttgcagcaagatgaatcaacaatggatgaatcttgcgtgaagtttttaggaacccacctcgatctggatcacaatcaagtcgaggaatgtgaatccgttgcgcacttcgatgaccgatctgcgaggccatgagcaacattaattctatgttacattgacatgatgatgatgatgaacaatgtcttcctaataatgtccaaattgagaagagattgatgagaagaaaacacatactttggtccggtgcatcccatggtggtgccgaggccgccgttgagcttgagcacggcgagcttgttgagcagcttcttggtctcctccaagtcctccggcggcgccgccagggtgtcgtacggcaccaccacctcgtccgtcggcgtgtggatctttgcccattccacatgctcctcctcgccactttttttttcattaattttggatcatatcgattcagtaatcagttcatcgtcagatgcatacagttaagtagcagcttgatcagaaatggtcatccatggaggataggatgtgtttacctgaggtagcgggcgacgaggctgatgaacccggacttctcgttgtcactgcacgcatgcaatgatttgattcaaaacccaaaatcgatcagcagatcaaacttgagcgatcagatgaggaattaattcagaattaagagactaatataattacctgatctgcgagaggccggcgacggcttcacgcagcttggcgagcttctcgtccgccatttttgtgttcttgccgctgcttcacgctgatctgatgagacagatgaatcggatcggatcggagaaagctcgatcttgttggtttttataaataaacgagaggaaacgagaggagagctcgcatcgcatgaagaggaaacgaaagcaatggcggacaatgcgcgcgacgcggcgaaaacgcgggagcacccaacgtttttacactttcctcttttgtttgttaccttccatttccctcctttttttttttggacacaggtttcccgggcttttcttagagttatttatttattattactgctatttttaacgaggtatatgcttttgtggtgaagcagcacttctcttctgttcaagcatatcaacatttttcagaattttcttcatttcaaaacattgagcattcattcattcattcattcatcatctaattccaatccaatatcttacaccaattgatcagcacgtcaaaacgtattaagatttcagcatctgtacaaagaattaatattaatgtctaggagtcatccaagatgagaaccaagaccagatttttcctggaatgcgctctccctattgtgtttctaacatttcatctaccatccttaggctctcgttttcttgtaccgacatacacacaaatatggaggtaacattcagggttcttcaggttgttggcaacccaaaggaaaggtatgtccatgtcgacctcaatgccttgcacccttactagcttcactattttacccttgttggccacattcgcctcttgcgggctcgacgaagcagacgactctaacttctcacaacttcttggggtgacatcagaatcatcattaggggctgaatctggtgcctgaggagcagtttcggaatcgtcgggtatacgtgatgccttcgagctgaagaactcaggtagcaaagttttcaacgcatgttccagggtgatgtagcttctacctgcaccaaagaaatgtatcaggaaagcactgctgatactgcaccgtaaaacattctgaatcatagcaccacaatatcaagcataatggtgtaagcattattttttgggggataaccacaaccctttagtgaaaccaaatatttcatagcatctggatctctatccctacaccacacgtttcacaggaatgaggggaaatgaaatgtacaacaatagggcactactactgtctcgaaattataaaagagcgccactacttccaggttggtgaacgaaccctttgaagcatgcaaaaacggtatgcaaaccactcatgaaggacaagtaaacgcttgaccaaatttgttctactgtcatccaaaagatataaatgttaattacaatgctacataccttcctccctccgtacttcgaatggtcggttaatataggatatgctttcccaatcaccaacaggtagtgcatcttctaaatcataaaggtcttcttgaacactgcgcacatataatcgaacaggaaccctgcctaaccagagaataactgataagagccaggatggtagctgattcattgtaacatgttgaaatcacttattatgtgactacaagcacacagaaaatttaaaatgtgaaaactatgcaccaactagctactgtataaaaaacttgtgcatatggagtgtatgtgaatgctcaattaatagtaaaggtagacatattcaatgcagaaaagcatacatggtttgccagatccaggagattcaggctcatcagaaccttgttgaccctctactgaggaagttcgtactaagcaatcctcttcgaatggtccaagcttaagcctggtggagatattcatatacccatctaagttacctaatatcaaaataacacaattctggttaaatgatgaagatacagtattcagagaatgcaccacactcaaatagtaggcaatattagtcagagtgcttgatatgtactaatttacaaacaaccatttcataatgaacttattaagcatggctagtattcaagtgttctttctgaagagcacacctttcattactgattgccacaaagcaccttgatcagcctgagacatattcatcacattcttactgttgccagtgatgatgaaggcagcctgcacaagaaaaaagattactctcgtgatcacactccacttccttgctgcaggaacaaaggattgggtaatggcagatctcataaacaaacctctttcagggaattcatgtagctccactttacactatcttcgccatcacagagagttaaaatttcagaaggatatcccctaaaatgaacctacaattttatgatagaaaagcatcatacaagtcaagcaaggaaataaacaaataaataaatgggaaaatttaaacaactctagacttactgttagattccatggtctttctggatctgcacatagaaggtcgtaaagaactccaatgggtatatacctatagtgcaaaggtaaatcggggagttgggaatttgagagggtagttttgaagataatgttagagccaataaattcatattcataaatattcgacacacttcaacaatatgccactgactttgtcgatatccataatatgccgttgccttttccttaacctctacaatttaccatcgccgtctatagtctgttagtttgcattggagaaaaaacaagtgtgcccttagtgaagattggcagcactgagaccatgtcgtgcaaggtaccgagagttataataactgtttatttatgcaacatgattataaataattacgagcacatattttaagtattttaattatgagcaaatatctccaaggctacaggacaggagggggcagatctttgattgggtgccgatgactgttgaggagcggttgaggattgcactgacgacagaaccagcactccagcagggccagggccaccatgtccccttgcaagcgatggcggcgctgacgacggcggcggcaccagcaacagctctccggcaggggcgttgtgtccccttgtttgcgacggcagcgctaatgacgatggcagcaccaccagcagccctccaacagggacgccatctcccgttagatgtgacgacggctttgacgacaatggtcggaccgccgctgtggatggcggttgggccagcgctacggatggtgacgctggtgacggaggtcgtgccggcgctagggatggcggtgctggcgaggacatgtgagcggcggtaggcggagatgcggcgtggcgccgacgcgccgtggcggcactgggaagggtggcaatgcggcgttgggagatgcgatgctaggaagaaagggccctaggccatgcggattagatgattcaaaggatattttggtcattactaaaaaaattaacagtgcaaacagcgtgtagcttgacggcgatggtaaattgtagaggttaaggaaaaggcgatggcatattatggatatcgacaaagtcagtggcatattgttgaagtgtgtccaactcagtggtactgagtagattctctccataaatattggtaggagataacgtatgttaccattttaagggcagccctttgtattcaaaccaaacagtgtcaataccaggcgggagtgtgctgctaaaatgagcctttataattggtaccaacagtggaagatacccgattcttggccccaaagtctgttattgatgaaacagaactccataagtaaagccgataaggtaatgaagtatcataacataacgtaaattaattattaaaaaagatcactcacataaagggaaagatgagcaatgaacccaccttaacatatatggtgtgtacaaactcaaaagtataacttgcatttgttgcacttggtaaaaacaagggagaacaatgactatatatcatgcagcaactcttttctttacacataatatgtgaacaaaacaagcaagtcatcaattcaccaatcaagtccactgagtcaaaaaaggcaccccctaatattgtacatagacctacaaattcaggaatcctaattaaaactgcaatcaacaacctaagtgctagaacgattgtaatccaaacaggcagcctagtaatccagagaatctgagtactcgggatccaacaactcgtggcaaagatccaagatttggatgggagacctccaattgaagagcatagccacaggccgagaaggagaagacgatgatgggaaaagcatgaggctttaccaggaagggcggaggtggggggagggtggtgacgtcggcgtcgtggaggtggacctggagcggcacggcgccgccccagacccgccgcgccgcctccgccgaccacccggcctcgtcgtcgcgctgcgccgccattgccgccggaggagagatctgccgccgccgccgcctaatctttgatggtttttgcttgtcgcaggcagcaaacgactcggatttgatttccccttcttcctctcttcggcaccggtgctgtggctgcatccaccgtccgattctaccttgagattcgtgccaaatccgtgtgtagaaaatctgatttctgattgaactctgtatatatatatatatatatatatatatatatatataaagtgttgtaatttgtgtatggaaaggattacagaacacacacaagaaaaaatccatttaaagcatcagctcaatcaggattaaaacccaacaacgtttctttcatagctctaaactccaaagagaggagaggactggaaagtgtgaagcttcactctactgagcaattgcagtttcatcaacgtcaagtgtgcaagtacaaaatttcttcagtaagtatttaagtgtacttaacagttaactccaccatctcctatcttggttttccataagaagaaaagaattacaggcaacaagagtagctacctagctttttaatgctcctgttctaaatacagcatgccattcatcgtgtttgttcccacacaacatttacagtgcagttgccacaatggtccaagcttcagcatgtcatcaaccatttgcctgcttgaagtgatgcaagatccgtgcagccaagatgtcgacccaagtgtccggcacgccaggaaggcaccaatgcatgcagtcctgcccccatacagccaccgcgtccttctttccgagccagattgccggatgcgcatcggcacggaactcgctcatgtaggtcaggttgagcagctggatgtctgtgccaatcagggcctcctgaatcgccgaattcactagccttgcttctttgttcactcctccaaacctgggatcgaaccacaagtcgagctgcacaagattttgttacagccgcgtcatgattcagaactttaaaatgcatttctgaagcaaaaacagtctgaactcagagcgttacctcgtgttcttgtagaagccgatcagacacgcagctgccattgtgatcccattcacctccatagaagtgcctgggtgactgtgagcgccacagtttcagtgttttacttgggacctccctttcaatgtaagaggccatacttttgaggactactttcaatccatcgtagatgccaagtggcggctcaattggtttccctcctcggtagaaaacaaggggggtctcttttgggaatttatccaggccccacctgataagggacaagcatcaagcattataacaggaatggtgcacgcatggctcctaaccaacctaggaacaaattagaatttacaaagaattttatggagacgcacaagaattttatccaaagaaatttacaaagcaagatgcacaagcatgatctactatgcttagaattttatggagaagcacgcatccaggagatggcatccttggaggaaatttacaatataaaaccaaaagaacattttaaggctgtgcaagaaaggtatgacgagcccacctcccaagtgatgtccagaataaaaagtatgcaatgcttagagtcagagtatcataaggaactatgaacaatttccaaccctactttaagaaaaaggtagcgatgaaacttccactctactttgctagtagtaaacaagacgaatacaacagcaaagcatgcaataagaacttaatgctaaggaaacaattaactcaccaatgtccagtgttgaaaatgagcacatcatagaacctggtgacatttacccattcatcagcaggaatgtcaacatccactctgtaagttccctttattccatccttgtgaagctctttggaattctctacaggctgccaccttcgtatcattagttaccaccatgtgagctttatggttttatcatatgaagcaaagaaagcacaacctcatgcagtataaatgtcaaaatgccatagtcttaagttcaacaattgtagattttaagttcttgaaggaaacagccaaaacacaagaagaacggcatcagaaactgtcaatacatatctaccatatggttatatagttaacagcacaaagtaggataacatataacatatgtttgaacattatcagaacaaattttacacaacaaatagatcataatgcttgggtatttaaatacggtaaatcgtaatttcttcatcacattctatggatctccctgcttactcacccacagtcttatctctaaatcactattagtgcaatgtggataatctcatatttttcagtctggcctcctcacctcaaacctattaatctatgaaagaaagataaccaacgacataagtattgacagcattcagcagacaacatcagatacaatcacagtatgacagtaaccacaccactgcagagtgcagagcacagatactagccatgtcaatgataccaaaatcaagcacaggacatccaaacaaacaagatggaactgatccatattacaacaaaggaatatatgtgacatccatttttctcctgagaatacatccacttcctagttagcatagtggtgtgaaatcactgaattaccaagatcttcctgcaattgcctttttggtatggtataaaaaaaatcatctctatctcatgcatccaattcataagcatacaaagaaaacttaaatctctatagagtatagaccgcatcacattcaatggagaaaattgcatatctaccaatctaccatcacttacagtcttatctctaaaacatcagtactgatgcaatgtgggtaaatctcacctcacctagctacaattcatcccgataaacacatacaaagattgctcatatacacatcctgtagtctaatctaaagatgtaatggcagtctctaacaaacccggaaattaaagcagcacgatttcagcagatagcactcacgtgtacttggcgaggagaactgcgcggtggtacgcgacgatgacgtcatccctggggaagtagccgccgcgccacgcgccccgccgcttccacttgctcgcgccgccgtccgccgaccggagcgcgcacagcagcgccacgaccaggttctccgacagcgagtcccccacgagcccgatccgccgcccccgggccacggccaggaactccgcggcgtcgatcctcgggacggcgccgccgccgcagcgggcgggcgcccaggagagcgcggcgacgggtgggcggctgttgcgggggcagttccaggcgttgcggtggaaggggcaggaggaggtgtagagcggcggcggcaagggctcccgggtggggacccagcggccggcggtggcgtcggagggggcggcgccgcaggggagcggctgaggctgaggctgatgcggcggcggccgcgggggagggggagaggggaagaggaggaagagggtgagggtaatggggaggaggaggagtagagggaggcggcggcgcggcatttgggggagagaccctctccccggcgatcgatcgccggcggcgaggcaggagagcgagacggatactgagtgtgtttccacgcgaggccactgccctgcctgcctttagctttcagagtttttttttttttggcttttttcagattcagacttcttactgtactgtgcaaagtttagatcatggattcatggtatagatgttttcaacataagaaatttccaaaaatttgaagagaacaactcatggatctgaaaaacttgtagctctaccacatgaggacagtttcatgaatcaaaggactctgaatagagatttgttcgggtccaacaaaaagtatctcgaggtactggtacctcacggtaccaaatcattttcgatcgttggatctagctgggctggatatgcattgttagatccaacgatcggaaacgatttggtatcgtgaggtaccgatacctcgagatactttttgttggaccggagcaaatctcctctaaatatgtttgggaaaattcagacattcattcaggaattcagctactctgtacagaaactacagatacaatcacgaccatgaaccaaaaaatatgcatacccctcggtctaaaaaaaactcaattctaactacaaacttcgtagctagatttttttttggacagtgtaatagaggataacaagccaacaacaaaacaaatatattcataatgtaatgttctgttactacaggttaaaggcaattacgcagagcctaattttacagttcaatttctgtgcaatgtccatgctagtcagatgccaacagcaagatcagtttctttctttcagagctgagaatgctcaacccccatctcagacaagcgcgaaagcagcctcctctccagcttcacgccggccaactccgcctccctgatcagcctccggcacctgcccatcctcccctccgccgcgtagcctccgatcaggccgccgtacatgtcgccggtcgggacgaacccggcgtccttcatcctcgccaagtaccggacgcccctctcgtggtcgcgcaacgccacgcacagcttcaccagcacccggtacgccggcaggtcgaggaggccgccggcgtgccgctccatctcccacgccagggacagcgcctcccggtgccgcccgtcgcggcaccggctgtggatcaccgccgtgtacatcaccaccgtgggcctcccgccggtgtccctgaaccagccgaacaggctctccacggcggcgtaccgccggagcttcacgcacaccttcatcacggccgtgcagtcctgctgccgaacgtgcagctccggcctctcgccgagctcgtccagcagcgccgcggcgagcccgtagccctcaggcgtacggacggcctccagcatcagcttcacgtggacgctcgggctcagtgtcctcttgttgatcgtggcgaactcgaggagttttcgggcaaggcctactttacctgccctgatgaacccactgaccatggcttcaagaacagcacggctcgctgaagggacgcactgctctagcgcatcctccatcttcagctggtcgaagcgtgccaagacctcaattgtcgaagcgagaatccggtcgtcggggaagagtggcacgacagtctgcctctgagcccagcaaagtgtctgcaatgccctctctgggagccccatgtgcccaagctcccgaatggtcattgacaaggatcctttccggaggaaccgaacccaccgatcgagcacaatggacacgtcagactccggtggcagcgctgcaatctcccgggcaatcccaatgaggacctccgggttcttgcacacctggtcactgaatgaagagcgtgaagaaagtgcagcccttgctgccagcctgatatgctgctttggtgcaggagcattgggcagtcgtgtcttgtgaggcagtggcagcgggagaggtcgctgcctcaccgggtttggcggctttggtggcttctggcgcatcggccggtcaaagagtgccgagatggcatcaagctcatctttgctccactctacagcctcttcctcatcatcgtcctcatcctcagaagcagaagaattctcatggtatgtctgctcattgcggtccattacctccaactccatgacagaacccccattcgatggctctgtgcaagaaattcgacttgttgatgggagattgccatctctgcagagccaccaagctctggtcttcgccgaggccgtgcaaattccatacagtgcagggagcggccggttaaccagtgacatgcttcctgttttaagattaggcaaaatgttgttacttagaacaatattgattccagatagtagcatgataaagcaaaaggttgcaagtcagcatgtataataagcataaatatactactagtatgaattagaagttcataagagcctctcttatgttcccatcacagccacctgcacaaatatagaagtttgcctcaaaaactaacagacaacataaactactggatttagcacgaggggtgtttctaatatgcaaaccaacagttaggtcacaaagtagcgggaggattttgttgtccttactatttgtatttataattacaaaaaaacactaattggtaaattcccaagaacaacttccaactcaggttttcggcttaaaagtttcctgaaatcaggaattttctaaacatgtactggactttctttttgagcaatttccaaataaaatttcagtgcaaaaacaaattcagatttcagcttagcaaatcagtgattcctactcaggatcagaattgtttgacttcgaaacagagattttatactaaaaaaaattatagggctttcaaatcaagccagctttccaatgtgaaattttttacttttgccttgcaggtttcggaagctttgaaattgccatcatccccaccggattgcaaacatgtttataagagaggctctttgctttcgtttgaacagcgtgaagggaattgttcagaacgaatttgagatgactcgtttcaactgcagttgaaccccaaattccaaaatgaaacgcagagaacaaaacatgcaatcaagtttcatgaaatttcgccaaaaaatacgaatttttctatccgcacgttcccatatcaactcatgcagtgtgtaacttgacaggtcaagaattcctatgcatacaaattagaagcactttgggcattctattcgctcagcaatacgcttgagaacaaacagcacaaatgatgaattagaacagcactaatgatgggaaatacacacacaattagggaaccatggggggaattagagattgcttggcagagactggatttcacctgtgctttgtcgccagatggttctcttcccccgccccggcgaacggcgcgagcaagctcactggctggtataggttgctgacagctgcgctctccctggctggtctctactctgccacacgcagcggctgcagactccagcgcggcctttcttcgcgccgctctgagcagccgagtcgccggcgaggccgccacgcgtgtgcggcggcgccgacctgggctcctggatgagatgccgtcaaaaaatgcagaaatacagttcaaatcagggagcaaaatgcaaaaaatatccatattgggccctcgtggcaaaatgtcgtatcacggcccaaaaaatattgtcctagacttgggccatttgttcggcacacggcccacttaggcccaacaagtcaccctcgtcgtcttctccgatatttaattgtgcagctaattcagctgggagtagtagcctagtaggagtattaactgatcggcgatgacctgacgaaggctgtgtttagtttagcgcaaagtttgaattttggttgaaattggagatgatgtgactgaaaaatgaaaaattatgtgtgtatgataagttgatgtgataaaaaagactgaagtttggatccaaactttaaatctaaacacagccgaagaagaagacgacggaagctaagctagaatgtcacatcacgatgcgtgcttgctactcactgggcttgcctgccgtgcgccgccgtgtcaccagctgccgggcgatggtggaggaggagggccttggccttggaccaggacgcgaggaagcgaagcggagctcgacggcggcctctgggccggactcggcgaccaggaggaaggaagttggtgacgacgtggagtctgctcgccgctcactgcctgagtccgcctcggcgccatgctcggccgcgttgccctcagagccagctgccagccgtcgccgccttgaagcggatggagggatatgtattaggttagggtttttgttgttgttgatgtgtgtgtctatatatatatatatatatatatatatatatatatatatatatatatatgtatatatacatatgtatatatatgtatatgtatgtatatatatatatgtatgtatgtatgtatgtagggatggcaattttacccatgtgtccggggtattcatgtggacacgtccgtccgaaaccgaaagcgcagtgggcaaaaattgggaatcaatttttaccaacgggtaacccatgcctggcccaatagttttgacacaagcaaacttcttgtcaccgacgataattactaggtcggttttttcttggacattaattaagataaggctcgcatagcccgttatcaacgtcgcaacatgtgcaatatatatactctaggtattttttttcttggaaattaattgagattaagctcacatagccagtcatcaacgtcgcgacatgtgcaatatatatactctagatattatatcattacacatatggttctaccgagcctaaccttactagaaattacgttgagtatttcggcttagtagcaatggtacattttttttatagagctcttactaaattctatatgcaggcaatactagttaatgttttcgattttgggtccaactaaaatatgatgaagataataagctcctacattttgcatttaaagacaacggttttataaatttttatcaacctatagatgaagatttagcagtaaaattattagttgccgaatatgtttttttccggcgtctatcttttcatcatacttttttttatcatttgcatttagtttatcaaagaattttgtaataagcggctataacttctattggggttgtttgacaagcggttttactgttgctgcagtcgattgctgccctgtcctggcacggcccaagatataatcctacagactggacccacttctcgccaaatcggcccacttaggcccactcatttctttcctcttcttcctcctcagtaccgacattattattgagcgtcactcgtacgctccctttgcttgtcgtccttctcgtcttcgtcttcttctccaatcgatttaattaattaattatcaagccattaactgatcgaggatgacctgacgatgaagaagaagacggaagctaattaaggctttgtttagatctaaacttcagtcttttttatcatattaaactgtcatgtacatataacttttcaatcacatcatctccaatttcaaaagtagccagccctcagcaagaaggtcacatcacgatgcatacctggtcaaagtcaaaccaaagatggataacacagtaccgctccctccatttcattttatatcggaagtcgtttgatttttttcttattaatcaagctttattaaatttgatcatgtttattgaaaaatttagcaacatctaaaatattaaattagttatattttgataatatatttgttttgtgttaaaaaatattactatattttctataaatttagtcaaacttaaataaatttggctgagagaaaagtcaaacgacttgtaatataaaatagatggaatagtaactaaaactaattaattccaaaaggttaattagcacggttaatcaccggattaatgaagaaggaagatacagaggcagtgacagttaatagcaattaatctccacttcaatgcgtatacataatgcacagacatgttgacgatttccatggttttgacctctggtataaatcctaactccttgtcgctgacgaggtaattgttcttggatattagttgataattaagattaagatcgcatagccagtcatcgacacagcatgtgcaacatctacaaaatactagtaattcagtacacacacaatcatgacaccaaaaacctaaccttacgagtattatacaattaagaactcattttctttctttaattaatcttgatcactttagctcgatcgatcccagcatcatcaatctgcatgcgtaagcagcgttgctgacgacatatataaattagcttagattagctaagttgaaacgcaaatgtacctaccagtccaccactcatccatcaggctgcacccaatgtctgaatcaaacagtactttttttttttcatttccaagttgctggttggttgattgactttgactgacacgtaagtgatcgcaatgggtttaagaaattcaagccactgatcacacggcaggacacgttttcaccacacaaattcactctctcaatctctgaattaatgagctgtataatcagatgtaacagtttttcttctaacagctggagctagtagtaattaactgctctgccgtttgtcttgagctagctggccttctcgtcagattctgattagttagttccaagtatggggtgtaaagtttcagtttgtcacatcaaatattaattatattatatagggtgtcgcataaggtgtttaggcactaaaaaaactaattacagacttcgttagtaaactgagagacaaatttattaagcctaattaatatgttattagcaaatatttactgtagcaccatattatcaaatcatggagcaattaggctcaaaagattcgtcacgcaaattagacgcaatctgtataattagttatttttagcctatatttcatactttatgcaggtgttcaaacgttcgatatgataggtgtaaaatttttgcgtgggatgtaaaagggcctaaatcgattcttgcagctaatttacaactaataaactgttacttcttgattgtttctgcaggagaaggaacaggagacacgtagctgcgcatgcagatacgacgactagttcttcttggatagtaatccaaagggggagtatgtaaaattagttttgttcctggaatcttggcgcatttcaaattgaatacagtttgaatattttaaaacacaaagtgattcggattgtgattgattccatgcgccaactgatgaacactagcagttcttaagcttgacggttttgtttaaatttgtgtacccctagccccaatagaattagacttcaagctgtattaattcaaactggaatgcgccaagatatataacatgaactctgtttggctgttgtgcttgcgctagtgtgcttttaacttttaattgtgttgatcaattgtctcaccaactatattgttgtacctttattattgcctccgttccttttcaattgatacagttgactggtatgaaatcctttaaattgtagtgttttaataaacatctttctaagtgtttgtaatttttctagaagtcaagcggtcaaaggtcatacataaatagtacttcactcatctcatatatatatatatatatacaaggcaccatcatttatttttcgatatttcataatataagacatatatgcatgtatgcaaggaagcacctaccacccatctttaattcactttttaaaaccctacattatcaaaatattttttttgtgggatacattatcaaaatatttaattccattagatgcatgcattttattcgttagtcatccaaacgaagaggtgataatagttatattttttgtctttatgtaagtgatgcatattatatttttttctaatataattattttttcttaattaataatttttttcggccggcaatgttcagccggcgctgcgaaaataatttaaaaatgggttacttcagtactcctacatgttgtccgtaggagcaggattcaagagccacgtagctgcacatgaatatacgccagatgtgcatgtgtgtgattataaatttttttaacaggagtacagctttattcctgatatgttggcgcatttcgattttaactaatagaagattagggcttgtttggttcgatgtcaatttttaccctactaagcttttagtaagtttaatagtggcaaatacatatttagtttggtaccaaattttcatacgatggttcaaatttaatactgttaatattttggtagcgtaaaaacttgtcagtacagtctaagattaaaaattggctccaaaccgaataaacccataatataattacagtacagtccaaaactcaaccttcaatttttttttggggaaaccttcaattgattatagccttttttttattatagcttttttttctaggtatggattttctctcaacaaaacgcggtgttttgatcaagtaaacatcataataatttggtctatgccctaattgaaatcgatcgctgtctgcgaataaaatcaagtcgactggatcgatatcatgcattgttaactgttaagtgaagtccaagtaacgtacttaggacaatctcatctgctgcctcctttatcagtttatggccaggctggatgcctggatccatatatatgtgcatgcatgcacagtgatacagaaacatgcatggtcaaagataaaatcagaccgtgttaattaatttgcgatgtcatcattaaagaacaattggtttagacgcattcgctgcagcacgtgtttgacattctgcagatgttcagtgtagctatctgtatccaactatttattggttgagtacgttcctttcccccaaaatttgcaggtaatttcagttaatataatccacaacgtgtgatatactacttaagagatatgtcactgttatgaccttccaaaaaaaaaccaggagactatggattttcaactagtgttggagtttcagctgaacatggaatgccatttttatcatcttctaatgatactgtacatcaaatgaagattttttgtgttcttcatgcgtgttgtagcttctagaagttcagtctaaaatatcctttatctcgtgtgtttaactgctcatataaattatataatatacccaaaacccaaccatgcgcgtacatatatactcaggggaggaaattaattagaagaccttaaaaatatcagaaatcagaaagcccgttgatcacttcagttgactgcatttttttttcataaacatgtgctggtgctgttgttttgagttgacccagtgctataattctacaattaactgccgtcctgttaattgcccccaccgaagtctaaaaccttccaaaacactatggcactgctacactactatcttccttttaaaatatataaagatattaaattttagacattatatttgacaattcatctttaaaatatatagtgcaaatatgccatatagtttttgataagtcgaatgaacaaatgtcttgctaaaaactaataatgtcataatatatttaaaaatggaggtaatagttgtaatttattcaccatgaaaccaattagttgtgcctaaacgatgaattcagctatacctgactagttgcagtcagatagatgtgtgtgtgaaagcaaacagcaggaccttcccaattttcttgtcctgcctgtcgcatggccacaatttggtcagcaaaacacaatagatatatagatcaattttgacaatctaacatctaattactatttactttagcttggttggcaattaatcgttctgagtagtgttggtgtgtatcgctttccttaatttcctccactgtttttttccctgaaagctactactggtttctttgatgtatccttcagatagccggccggctttccaatgatgctgcctaattactctggtctttgttcgacaaactaagcaagcgtatgcagcatgtctcatctggttgctgaaattaagtatattaatcttcgttttcaagattctaaatttcctagtaacttcttctttccaacaagaaaacaaaaggagcatagtagtgtacgcctcagatagacaatctgatgattttttgacttcagagaagcaactgagaacttcagatatggttcttcaaccttttgctttatcgcttttctgattttctttttcacctttcattttagtcttccatcttagtagcatattgtcagaaatcattgcttctgcatataaatatcaaggcctaattaacctaccttccgaggatgagaaaatccagtgaaaatgacagcttcctacatttctttaggcactgcaattgcgaaagtagatttatttctgtgcataaagtgaaaagtgaaaaaaaagggaaaagttggcattttctcagcactaccatggcatctacctgtaatccatcagtacttaagcaagtaagcatgctgatgcgatttgtggcctttctgcaagtagctcgtggttttgtcaacccaacaatcgattcggaaaaaaaaatgctaaaatgtcaagtatgtcgaaatgttttgtcaaccccacaatcgattcagaaattactatcagatttcttttcgcacttcatatgttccatcattcttttcttatatactccctccatcccacaatttgtttagaatatactattaaggtttaatacaaaagtctataataccccttattaaataatatatgatgagaagtggaatggttattgagggtaaaataggaaaacttttgacaagtattctgggatggaggtagtacttatcatcgtaaaaatcatgcacataaatatatagatcaatggagcacttttgcaagttgtcacttttagggtaagtcaacattaagtatcagctattatatatctgtattgcaggtgatagagcactcactctagtttgctagttgccaaaaacatgcattttgtgcaacacatatagaagcattatttttcttgtgatgaatgggatttagtgcttccatcacttcaacttttatttaaaggaaatcttcatcatttaaggaatagcttttgagttgaatgggctagcttggatcaaccagtaaaaaaaattaaaatattctccacttttgctgtcagtcaattttctcagtcgttatcaaggatattttttttagataatcgttatcaaggatatgggctcatgaatgctagtttttgttgcactcatgcaaacattaggatgaacagtcacatgtaaggaattctgtactgtgtccctttttttccctgttgtaacaacttttttttttgagaaacccctgttgtaataactttgatcggcaggaaaccgtacaaatcctgaagagagtttttttcttcaaccaaagattggaattctcatacaccaattttgaaccggcaaacctgataaattagcggaccacggagtaatatttgctttgcatcatggctatcaaatatttcctgatattatattgttttgaacaataaagtggaagagctctctgacaaaaaaatatgtgataaaaacaagattagtagaaattagtgacataataaaaatacaatcaccagtcttttgtttgtataccatccaagtgcccttttttcagaacgttatcatcctctttatagcacggagttgaatctctttcaattgacttgataaggcttgcacccattttaatggtatcctagtaggaagctaagtcaaaagttgtactttattagagcaaaagtccataattaaatcctctttcaagtttcaacaatatgaatgcgaatacatgagcaagaaatgagaaccatagttctttttggttcatgatggaaacatgcatggttttagatttgtctatactcttggaccaacagggtcacagtacttcactttgacacttctgataaaatcaacaaaatgcaatactttgacatagtctagcaccacatccacaccaaggacaaggagtgctactattgtcaatttcaaagatctcatgcatcagtccatctcctgattaatcactgtcctgctccataaaaaggactgttgcaagaacaataaatcatctattccatttatacataaaataaatctattataaagggagccctggttagcttgcctggtcaaacaaaccaccagcatagatagtgccttggagccttggaccaattccaggcacatcccaacaaaccaaagtcgttaacaattgtcttcttctataaacattgttgttttttttaaacacctgtaatgaaatcattatcccttttatttgaattatttttctttcagaatatcaaagtagacccaatattcttgtaatcacttcttttggaatgatgctcctttataagctaagctttctaaccatatttaatagttcgtatattcttatatttacatgcctatgaaaactgtattttacttttatgcataagtaaaaaaaagtatttttagagaaaatgaaattcttttattgtatacatacactattcatgaaaggacaacgaattgaacctaggctgtgtttagtttgcccaaattctcaactttccatcacatcatatcccatcgaaaatttttctacacacataaactaccaactttctctcaacttcccaacttttccaccatctaaacacagccctacttatattcgcatacatatatatttttagggcaaaaatactgttaacaatgaaaaattgccaatacaggtagtagtattactctaataaatacatggaaagttgtaaagaaatttgcatttggaaggaaaggtgagagctgaattcagtcagagataggccagccacatgcagaaagaaaccggagacttttttttttttgcagcttcttctcctcctcttcctccatgagctctgcagtctgcttacttataatccccccttgacttgccattcccctccccctactcttcttcctcctccctttcttggcctctctcctccacaacccacccttccttcctcccttcctccccttggtgcgttcttgattgctgcagagagggaaagagagagagagagggagagatggggaacatctgtggtggttcagggaaggctcatgtatcgggggattgcaggccgcctagctcaggtgagattctgtccgcttcaagaactcggtttctttcctcttctttatttgcgatcctataagttgggcctgtcctgggtgaagatttcttggtttctgatcgagcgtttggtcttttctctcaagtctgatcaatacacttgaggtttctgaggggcggaaataaagtttttttttttaaaaaataatctcagttattctagctcaagatcatgtttaggggcggtagctgtaagagaatcagggcaacttgttaagttttccaagttctaagtttttttttttgtttttacataatcagtgctgacatggtagcagagactagagaaggaattaaacgaattactgtgactaacacttagttgtttaagatcaatactttcttagttttcttcttcaaatttacatctttaattagcaggttagaatttatcaccaaaaagtagtttcccccctttcctgaatcacacaggcttcatcaacaatataacccctcgtgcaatcctaactattaccttagtaaatggggaaaaaaggactccaactttggctgaattctccatttttctccacatatttctgtcatagccaaacttactgcaagaaggtaacgtgagctgtttgttctacagggacaatgacccccaaaacaagcagcagcgtcacaaccagcaatagcacaactgggaagctctcctctgttggcagcagcttcatggcgtcttccggaagcggcggcacgagcagcggattcgacgacggggtgtacccagagggccagatcctggaggcaccaaacctcaggacattcacattcattgagctcaggacagccaccaagaacttcaggccggatagtgttcttggggagggaggctttgggagggtgtacaaaggatgggtggatgagaagacgatgaacccggtgaagggcggcaccggcatggttgttgctgtcaagaagctcaactcagagagcatgcaaggttatgaggaatggcaggtaaaaatcaggttctttgtttagaaagaaagaaaagaaatacttgaattgcaggatgccaagttggttagcatgagcataggaatcttgcatgcttatggggtttgactttagttttgattactgctgtataataaacttaacaagttagaggatgggatcactttctggcattgcaccattaatggacagataaaaaatgcaccaaacttttgaagtttctcctcatggtcatctcatgcttatggttctttatgtttgtttagcttctgatgacttggctgtctgttttataagctgcaatgtcaattctttaataggcctatgtaatctgggtagtgccaaacggccaatagcccaatgctgaccagaaccatattaatgttataatactagactcttcataattcctgaccagaagcatcctataaaccacatgtttatcacaatgcagtgtttctctgggtcagttttggtattccaggcaaaatattacagctacctcccacatgcctttgcaaactttaacaagatatactactcaattaacttagtttactctaacagatgcgatttttttgtcaacattaataacatctaatcatatttctcaatgtgtaccctgcagtcagagataaactttctgggtaggctctcgcatccaaacctagtcaagctcttgggctactgctttgaggacaaggaacttttgctcgtgtatgaattcatggccaaagggagcttggagaaccatcttttcaagagtgagttcttattggtttgttgctaatcatttccatcatcttatttatatcatgaatgaagttctcttaggcatttcactgaaaatttggggtgattaccttgctcatgcacactgtatttctttccccctgcaatactttgtcttctggagtagaaaattctaaatctgcaaacatataagtgcatgatgtgagaatatctcggggcagttacttgacttgattgagaggtatactgatgatgaaactggccgcatctcttttcagaaggatgtcctccactatcatgggaactgaggctgaagatagccattggtgcagctcgaggacttgcgttcctgcatgcctcagaaaaacaagtcatctaccgtgactttaaggcttccaacattcttctagatgctgtaagctttctgctatttaatgtgcctgcaaccttctcattattgagttcaaatgctgatggtgttctttggcagaactataatgcaaagctctctgattttgggcttgctaagcttggaccaactggtagcaactcacatatcacaacaagggtcatgggcacatatggttatgcagcaccggagtatgtagccactggtatgtgtccttacgcctaccctgcagttaattatcaacacttaacactgcatgtgatagtcatagtacagctgaaatagcaatatgtgtggaatttgacctctcagtcttcatatgttcccaaatttagcgtttttgattgtcaatcatgtcacttacatttttggatgcatgctatatctcctccttctgtccaatgataaaattcggaattttagctaacagacaatataaatagtccatggatgttgaatagaagtcaagtgtgaaaatgaatattgcctaactagaaaggaagcaataccaagtcattgaatatatagaatagtgggtatgcactagctaagtccagagtctagacatgtatacgcatgtgactgtagggctccatcttggacagatatggatgagtaacatgagttagcacctactgccatccaagtggatgatccatcttaggaaaatgtgtgctaacaatcctttttatgtacggatattcgcctaatgtcactttccactcaaaaaaaagttgacacagtgcgcacccaactttcctcaactcgtaccattaatatttcagagttactagttagttttgcatcccacatgaaattcagaattcaagtttctataatacattgtcaaattattattagctctgaagtacagtttactatctgtagatactttcttagctgccggtggttattttcgctttctcactatctgctctactaaatcatgactaggtcatttatatgtcaagagtgatgtttacggtttcggagttgtgatgctggagatgatgtccggtcagcgagcactagaccccaaccgtcctaatgggcagctcagccttgtggactgggcgaagccctacttggcggaccggagaaagcttgcccgcctcatggacccccggtttgagggccagtataactccaaacaagctgttcaggcggcgcagttgacgttaaattgcctggcaggtgagcccaggagcaggccctcaatgaaggaagttcttgagacactcgaaaggatcgaatcaatgaagagccgagcaagggatgcaagaggaagcggttcatcaagggaccatagccatggtcgcaccacagcgcaccaacggtcatcgccgcgccctgatggtcgccgtggatcaaggaccaatggtcacgccacgaaggcacggtgataaacagcattggagctgatgacattcttcctgtaaatggcctaaattttgtctgatgttcagttggagatggtgatgtttatttgttgctatatcatgaaagaaggcccttgttgcccaatcatgatgagtgtaaaatgtagcaacaagaaagatataactgtaatttgtaaccactagaaatagaaggaataattcttgaaatggcttgctcaaaatagcttccccgctgtgttcaattttgtgggtcttgcaaccggagcttgactgcataagtgtgaacattagactgcatcatagtgagtaaaccttgctacttggtagaaattttggccagttgtgtgtgataagaaatcatttcttgagcaaatttgccgatttttgaaaagtgacaagcagcccttgtaacaaaaccaaggcagtagtatcttcagaattcagcaattatgtttttccggagggctaaatatggcagcccatatactctctgattgatgtgagttgtgatcctgctcttttttctaatgacaagttccaaatttccaacagctagaagtatgaatatgcaatgaattactttgcacaaaatgaatacagagagggaattattgtggccataaaatactgggaaatgtcaaaagcactaaaataccaaaattccattccatggaatggaatatatgcatacgtgttgacctgtcagtgttatgacaggctgttcatcctgacttgtgtgtggccgccgcccattttgacgtcaaaagcaacctccatttctctcatgtctccggccaaccgaccaaacatccatccttccttccgtccagctccagccattgttgattgctggacacagcccttgcttatctttgatgagaaatttaacgatatcccttaaagtttttttggtccaaagaaactacacaagaacagggcagaatctttgtacggcctccaagaaatgcactaacagagaaagaatcatcacgatgcagtgtctcagttcagggctctctgaatcatctgcattcagaagtcgctcaaatataaaagtgtagagtccttcattttctttaaaaaaaataatcagtttccacgtagagttaagaaactggaactgtctagacatctctcgtatgattttttggtatgcaaatatgagaagaagaaaatgcagccttgaagaagctggcccaatccaaagctccagcccgatatagaatgaaaccatgagcgcagcataggacgaaaccactatccaaaacagtgacttgatttgctccggtcttgaagatggggatgcgttataccggttttgcggttgagggatatgattcaatcaatagaagagttgaaggaggtaaaatagacttatttcataaataaataaggctagagacggcccaatacactaacttcactaaatgaatttttttcgtttttagattttatttttaatatttacagaaataatctatcgaccaaaaaaattgcagaaatagcccctgccgccctaatggtgggcggcaagctgacgtggcagacggtgggtcaaccgcgccgtctgccgccgtcggccaaaattgcgattaggcccttgccgcccgtacagagggcggcaaggggctaattgcaattttggccgcccataaagagcttgcggccgtactttttcatctgggtcccttgccgggccaaaagatttttctatgttatgttaataataaataaagaagtatttattggtaaaacttgttaatattgttataaaaatgtattgaagttggttgttgcgtaatttcatatgttaagtgaggtattattttgtaccttattcgacgtattagtactcggataatttatataggcctatcacagtctgggtcgtagaaacattatatggacttaaacaaggagaattatataacatgaagaaatagtagtacaatttgaacatgatacaagtatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctcttctttctcaaaccgcgcccctacgtgaggatccctcttctttctcaaaccgcgctttagtaacactgtattgctctggtagttcaagctgcataacacggctaggtggagttagaacccttctggtgtctatccattctctgtattgacatctccttggtggttcctgggagaaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaatgaagaacctgacaacgatcaccacacctgcatcttggacgggcttcccatggagggagtgccgtagttagcacccgccagtcgctctgtagttcacgacattgtcgttcataagccgcttttctctgtaagtattgctcagtactttcggatgcgaaataccagcgactttcttgtaaacaagtggttaggtcgagaatgggattttctgtatcgacccactcgatgtatgcgcaagccgtagtgcaggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgcaacgccagtttggatcctcaacacctcggcgtctagccattgacgaaagccggtcgaatttgtaatgaagcaagtggggaagagagtactgaatgtgactgagttctgaaggagtcgtgaaccgtgagtagctcaccgcacgtccatgcccggaacgtcccaagctgagccccctgcaccgcagtaaggtgagaccggtgtcggtgatctattgccgggtccaacaactgaggtgtatcctgacgtgccatctctgaaaaatatagtgtttcgtattagaacaattcaaaaaatagtactgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagttcgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgccacacttggtttctccttgtctttaggacaatgcttgtaagtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctagaaccgatccctaaaatacctgcatgtctcatgtaaaatgaactccactatgccaactagtggtagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcaatgtgtcggattattgaccttggttcatatgtgagattatcgatgacatgcgcatacatctcagatgcaacaaatgcacatgtaatgttcctgtggtatttctgaacaccaggtagaaaatatatatgcttggtaacaactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttagtccctcgccatcatccatgttcgtctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtaaatcaactctcaagcccctcattaaccatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttatcttctcctcccctctcttcttttttttttcactggaattgaggagagaagaatgagggctggggctgggcagcaggccttttataggcagcgaggcctgccgcccggccagagggcggcaaggggccgcctgcaaaatagccggccccgactggcttttttgcattcgggccccttgccgccccaccagagggcggcaagggttttcatgcaaaaaaaaccctccctccgtcaccgcccgttcctccccccgtttgccacgtcagcttgccaccccagaggtgggcggcagggtctatttttgtagtttttttttgccgatagattatttctgtaaatatttttttaaaaaaatctaaaaccgaaaaaaagtctcactaaatgcacaatatgcgaaaagccccctcgaactcttcgcaaatggcgaactgatccccgccgctcgcttcctctctctcacactcgactccggcgagagcacgggggccaaagccggcagagcgcggctagggcttcggctgctccggccatgcgggtgctccccctcgcgctcgccgccgccatcttctccggcgtcaccgccatcctcgtctacctctccggcctctcctcatgtaatgcgcgcgccttttttcttctgcttttggctttgcgtgtgtcgattctgaggtgggatggatgcgtttgtgcgtgcgtgcagatggcggcgctagggtttccgatgcggacttggcggcgctgggcgcgctgcagagcggcttcagcaagtgtgtggtacggtttcctgatctgtctccgctgttaattgatcctgttcactgtacgggcaattgggattcagttgccttgtaattgtgtgcaattagatgctacattgtgagatttggggccattagatttccacactcatggagaatcggcgtggtgattagttattgcttcgtaaattcttgatttatcgtggtaattgtttactcaaaggcatagtaattcagtagactgtcctggtatgtactttgttgtatcgatagtatcctaatatacattcacgaaggaaatttgtagtgtattcttgtttgtggtgacttgatgttcggtatataaagatcattaatgtgtactcgtgctaaaaacaatcaggatgcaaatggtctagggctgaaagcaattccaggagaggattactgtcgagttgtaatacagtatccaagcgacacagattctaagtgggtaagtgcacatgtgctgtgtaatttccttctggatgcaggccttcccatttcaaatgtagtcagctcctgacatagtttgcaaagcctcttttaattcttgctctgtacttacatcgcatcctaccttatgcttctgaaaattgccactagcgtgaacagtactcattgcatactcgtgccaccttttgtgatgcgtagggatggcaatgggtcgggtcgggcatgggtagagcaaaaccatgcctgacccgatgcccgacattgccagcccaaaccctacccactagaggtagcgggcaaaactccgtgcccggcgggcgcgggtatatctggcgggtacccaatgaatctcacatgaataataacttgaaagatatgtaatttaacaaagagaaataaaatcaataatttaccaaattatcggttatcaacaataatttgaattacatcataacttagtatcaattagcatcacaaatgaaccgagagaaatggtataagaattaagaaatgagtcaaaattagctaatacatatgtatcggattgggcatggtttacccacgggtaaaaaatgaaacccacctattacccataacgtcttcgggtctcgggcgggcgtgcccatgggtaaaaagtcacacccacgcccgtacccatcgggtcgggtatccacggatacctggacccatgggtaaaattcccatccctagtgatgcgtgtgtttgtttttcttagttcttatgcactgatatttgcagaaagatccaaaaactggagaacctgaaggtttatcatttgagttcaatctctgtgaagctgtggcttcatgggagcaggttagcattcattcaactgacatatgtatgtgtttttttgcagatgcattgaagtttaatattatatgatataatgtaaaacatggcaatcctcagtatgtaaacactgtgtccagatatttgttagatcacagtattagctatttttatggacttatggtcactcagttgcttttttcctaggttcgcaatagcacaacaatacttacaaaggagtacatcgatgcgttgccaaatggttgggaggagtatgcatggcgcaggatcaataaaggaatccatctgtgggtacacatacttgcagtttcatcaagatttgcagcatgattaactccacaaacagattattgagcatgtttagtcttgaaattgcaggaacaagtgccagaacaggactctttgcatggaaaaactttcattagttcttcctgagacaccaccatatgtacctcggcaatttggtagatgtgctgtagttggaaactctggggatcttcttaaaaccaaatttggggatgaaattgattcttatgatgtcgttattagagagaacggtgcacccatccaggtttctttaagatacttatgtttgctgctcttgtgtcgttccactcgaacataaactgacttctatttttattgaagaattatacagaatatgttgggacaaagagtacatttcgacttcttaacagaggatctgcaaaggctctagataaagttgttgagttagatggtaggtctgtcagccacctattttcccatttggtgagatactaaggcatgctaatttttatggttgcagaaacaaaaaaggaagcccttatcgttaagacaacaatacatgatatcatgaaccaaatgatccgggtaatttagctgtcctatttaagaaaaatacggtagcttgggtacatattctgtgttctcttacctgcctgctggaattcttgctatgtaggaaattccaataaccaatccagtatacctcatgctaggcacatcgtttggttcctctgctaaaggaactgggcttaaggctcttgaattcgctctgtctatgtgtgacagtgtcgacatgtatggatttacagttgacccaggatacaaggaatggttggtgcgatcgatcttacgcactaaatatgatgtatgttgatgtgcagatctgcttacagttgatgtgatgatctttcaggaccaggtacttttcggagtccagaaagggacacactccattacatgggagagcatattatcaaatgatggaatgtcttggtgtgagtttctcatttcccctaatccgaactaatcaaaccattcctacatggaaggattattacttagccacactgttatagtgtgaagagataacttactgtttttaaatataaacatgtgcagcttgtaaaaatccactcacctatgcgaggtgatcctggcagagtagtaaagtgggctccaaccaaggacaccattgaagctgctagggttgcttctgagaaactgttgaagtaagttttgtggcctacctttatttagtatggttcttgcttccattcgtcaatcactccatggcaaccccacttagatacttagttactagatattgattttcatctgcttggttctggtgcttaaattaactaaattaatcagatatgtcattatgccacatgttgtataacttgaaacttcgtcgttgcaaaatgcactataggagacctggggctggaagcgagggccctttgagctcttgcaccatgataaagaagcgcgagaaagggaagacaccaaaaagatctgttgtccgccatgctgccttgaagcatctggagtacatgagaggtgccaccaggtaccctctggagcggaatgctgggggtggttacctctgcatgatcaacgaaagatagacatatagctgcccatattctaggagtggctgaattcatggtaccatgaagcagaacactgtaccccgatgaatgaatcctacacggataaactattttgagggaacattggtgctcatttttgtacagagccggcagttgagatgattttacgcatgagtagtcacaatgtgttgtaacttacattgaaactacacaagtgttgtgtgatggaatgaacagatagcggggcagtttgctgcgcaatgcatcgggtcgccaaatttgtcacctgtaactagaagaaatcttaactatgtacatggagcctgtaattcgtttggcagtagacatgcactatttgattggcatgatggcatcacattctggaacttactatgtcttaacttgcatagatatgttgaccaacaacttgaggcaaatcattagtatacaaatgatctctctgatactatttccaatccttttcatgcttctgaattctgatgttgatgaacagtatgtattgcacttatgcaaagttctctttcgtgagctgttagtgcatgctgatgtacttctgctaccttgttcacctgcgtaagctcagttcttgcacacttccatggactagaagaaacgaaggaatggtcatggatgatacatgagaattggaaagaaacaaacagaacttaaaaaaagttgtggaaccagtaaaccagacaagtggcaaacataagctgattattattattattaccactgatcatcgttcaacactcaaaagtggactatagatctgtagtatgcattatgctagagttgatatgctcttgacagacaacagtacgaatcaatcaatcccatgatcttaaaggaacttggtgtgtagatctgggttcttggtgcagtcatctacgcaagatgcaacatcagcttgccctgtcaaggcatataagcagacacagcagtgagaattcggtgaggaatcagtcaggataatctcccaaatacgatgcacaaaagacatacacaaaatgcagattgttctagctatctgatcttaccattcaacgccatgccgcagatggcgagcaggcaaaatttgttgcagtcgccgacggccatcctcttcttgttggggctgcaatcatcgatgcatttgagcacgcagatgaaccgaggcaggctcttcctgcagtcagggtagcactgcaagtagcatctgcagaacttggacatggcagccacctgatgaagctgatcacctgacagcaggatgagaatgcagcagagagccactgctgcagctgctcccttgccctccatcgatttgagtcctcttcctctcactcataacttctgtagaagcagatggtgttaaggctgggtcagtcacttgatcagcacaaggattttgcagaagagaaatgacaaaactaatgcagatgaaatcaaaatgtgtggataccttatgagcagcttctgagaagaagagagaattcaccaattcagtcttttcagttgatgtagtagtctgttgtacttgtacatcatgccacatacttactgttttatttatggtgcgagtgctattgtgtttcttttattgttcatgccttttttcagaagctttacctgcagagattggtatcagaactgggaaatggaatctcttttttcagatgctttacgtcccaaatgtataccgataaaccaaaagaaaaaaaaacaaatttacgttctgttttctttctacattaaccaagaggattgagatgagacaaaagataagtgccggatacagataagagggctgaactgaagtagtgtactgaaatctgaagaaatgtgttgagcaccatcaataaacctacctctggctttgagattcagccaaacatgaatgaacagcataataatcgatcatatattcatgttgacgataccatcgcaagctactaagctctttggtttgatagagaccaacaggattgcgttgctgagaaaatgagagagaagaagagaaaaggaaaaaagaacatggcagagtggagtgtgggctgaaagttcaaatgggccggccatggtctaagtttgtcttggggaaaaatgggccatggttctattgaccttggggcgtcggcggcggccggcggcggcgaagacggtgcgagagggcggcgtcggcggcggcggcggctccctgcagccacacaacctgctgctgcatggcagcatagctcagtacggcattctggcttactcatgcgaagcaagcccacacttgtggggggagcattctccgctccccccaccatgcgacccctccacggaggacggagctgcatccgcctcccgcccaagttccagttgcatccgcgtcctatccttccattcacactattgaagtattcatccgtcaccatcggcgtgagaggcgaaatccccctctcaacttggccggttgatgatacgtcaggtccagctctgctctgcagtgttaaatttttttcaattccaagttgaaacctgaaatttctctatgttggttgttgatctgtccagttcgagtggagttcaacggcataatcggtatattgtaataccctcacgcagctgcctttgcgactcatatcatgtatggacggtaatccattcctgtactgttataccctcagctccaagctcgtcgatacattagattaggtaacaccgtatggtaatcctattttatattttacaagttgcattcttagctagatgagatggttactgaatcaacaccttacttttgtcgtggtttgtaggtgcttccaggaaattgctttgtactatccttacaggttactactatttagaaatgttttgttccttcgtaatgtttttcgctgccgcttgtaccacttgtattatagtaatgctgttccacgcatgaacttatctcgacagtttttttaagctaaataactggtctgtagcatcatgagctactagttttgtcaaggtcgatggatacactattattcattagcaaagataactgtgctgcataggtgcatggagccgtagacagttcactaataaactgtttaccaatgctttattgcagctgtgtactgaagaacctgcagtgtaaacctcacatcttttttatttgactctttatatgctgcatgccttgtgttatgccatccctgttgcttccataatgcatcgttgcgctccattcttctaaatccatcttcttgtgcagggcttgttctagcctccgtcgccttagttgcagtgtggataatggggttggttgccactgcaattgaggctgcaataggatgggtggttgagagcatcctcggaaatttcttcactggacagatgcaagtgtggactcgtgaagttggcctttctgaagaagtggaggagcttgagactgagatgaggagcatgcagatggtgcttgcagctgccgagagtagcaagattgacaacaggccactgtccgagtcacttgatgagctaaaagagctgctttatgatgctgaggacgtgatggacgagcttgattactaccggctccagcaacacatcgaaggtggtaacacactcatcaaccttccattccttgtttcttgcttcatgcttcttttgcatttgtgtatttgtgagcttactgtgctactaagagcagctaaataccataatccataggcaccagtcaccgcacatcagtttttatcagttaattgtgattacgttaccatcatttcaacttccattatttaccatttttaagaaaccttaattattagcagtggattgcacaagtggctttcttttgcttgtcccttaacaccaagtttttttcttatccagggaaaggttctactgctgcttcttgtactaaccctgagggaagttatgtgtcttcatccactccatcttacttccaacgagtaagcaacagcataaatcaaatattagttggcctatgcatggaaagaaaaggaaaagagaggaagaagaggagcaaactcatagcaccatgctgcctcttgagattaaacatgatatttctaagaggatcaatgaaatagtgaattgtttacgcactaggtgcaagcctgtgcaaggagttcttcagctggagattttacgccaaattgcaatgccaaagcacagtcagagtgagcccagaaagcctcgtcagacgacttctcttgcaattgaacacaaggtttatgggcgggacacagagagggacaacataatagagttgttaacaaaggtgaaatcatgtgatctaggtgttctaccattagttggtgttggtggtgttgggaaaactacacttgccagatttgtataccatgatcaaagaattaaagaccattttgatttgagaatgtgggtttgtgtatccgataatttcaatgaaaagaacctaacacatgaaatgttagagctcgtgtgtaaagatagacaaggttacaaaaatataatcagttttgatgtgctgcaaaacaccctttgggaggaaattagaggcaaaaggtttctgctcatattggacgatatgtgggaagatgggaacaggagcggatgggacaagctgttagctccattgaaatgtaatgaagtaagcggctgcatggttttagcaacaactcgaagggcatcagttgcaagaattataggaacaatgagtaaggttgaagtgaatggtttggatgaaacagtgttttggttgctcttcaaggaatgggcatttcttggtaatgagaagctggagtgcaatccaactttgcaatccattgggaaacacattgctaaagcattaaagggcaacccactggctgcccgtagtgttggtgcacttttgaataggagtgttagctttgaccactggaggaaagttcagcacaaatggaaatttcttctaaaacaggatgatgatattttagccatcttgaagttcagttatgaatttctaccggtccacctgcagcactgtttctcttactgctctctgttcccaaaggatcataaatttaatgggaaaaaattagttcgtgcttggatatcgcaaaattttgtgaagtgcgaatgccgtgctgagagacttgaggaaacagggaagcaatatttggataatttagttgattggggcttctttgaagaggttgagtcacactatgttatgcatgacctaatgcatgacttggcagaagaagtttcatcagatgagtgtgatactgtagatggattggaatccaagaaaatttcaccaggtcttcagcatttatcaataataactactgcttatgatagagaagaaccttgcaattttcctagggagaagtttgagaacatactacagagtatcgggtctttgccaaagttgagaacattaatgttcttcggtgaaaatagtataatgttattaaggtccttaaatactatatgcaaggagtcaaaaaggttacggttactaaagatttatgtgacagctgctgacatcagctctacacacaatttgttcaagccaaatcatcttcgctatcttgaatttattgttgttcccaccaataatatgtttggaagtcgaggcattgtaaatacctctattcctcaagctttgacaaaattttatcacctccaagtgttggatgttagcagtaaaggaaatcttgcagttcctactggtctaaacaatctcattaatttacggcatcttatcgctcatgagaaagtgcactcaacaattgctggccttggtaacttgacctctcttcaggaactaatcttcaaggttcaagatgctgacaattttaatataggacaacttcgagccttgaatgagcttgtaatacttggaatttctcaactcgaaaatgtgaaaactaaacaagaggccagcagtgcaagaatgatagacaaagagcatcttgaagagttgtcgttgttgtggaacgataacagcatgaaccctgaacctactgcagaaaaaacaagagatgatgtgattgagggtctcgagccgcttcaaaacctcaagcatctacaattgattcggtacagtggtgctacatccccaacttggcttgctagcagggttacctcactgcaagtacttcatctagagaactgcagacaatggcaaattgttcaatctcttgaaatgcttccactgcttagaaagctaaaattgattaggatgtggaacttgatggaagtctcaattccttcttgtttggaagagttggatttagttaatgtgccaaaattggaaaaatgtgttggcacttacgggctagatttgacttctggtctgagggtattgatagtgaaggattgccctatactaaacgagttcacgtttttccacaaggactattttcatgccgagcagaagtcatggtttccatctctcaacaaactcatcgtcggtcgttgtcatcgtataatgtagttttctcttcttcttgatcttgcttgttcagtacaattgcagaagtttcctacacttactttgttaaattatgttacagagcatggaagatccttccactggaagaaatgcaagcactcaagaagctggagttgatggatgtgcctgttgttgaagaattgtcagttccttctctggagaagttggtgttgattcaaatcccaaggctgcaaagttgcagagggataacaactgctccatctccacatttttcgacttcccaaggagatcaaagggaattggtatgtggtctccgggaactcactatcaatgattgccccagtttgttagtgcagtttcctatcccgccttcttctctgatttcgttcttatccatcaagggcctttcatcatttccaacaatggtgataaatcggagagtgctcacaatcgaatctaatgagttgagtgagctcgatggcaggatctcaccattccataatctgaagggcataacatgggtaaacctacggcgttgtccaaacttgacccgcatttcgatagacggtttcagccaaccacatgtcatgtcaaagcctgttcatgataacagtatacctattacgagttaccctgtcctcccatctgtcaattctctcagcattcagtcgtgtggcatagctggtggatggctaactctaatgcttcctcatttgcagtctcttgagaacttggagttacgagactgcccacagataaaacttttatcaacaagtcaatgtacaaaaatagaagcaccgaacagtttggcttcagcagagacaacctctgccagggacaaataccttttgcaaattccatataatctcctccgttctctaaagtggttaattatttgggcatgccgagacctggaattttctggagtcaatgaaggatttggaggattcacctctcttgtggagctacaaattagggattgccccaggctggtcccatcattggtgagtgaaaccaaggataattggttactcccaacatcatttcaatatctcactatcagtcctctcccggcaaacatgcagctcttcgcccctgagggcctaacttgcctcagagtgttaagcgtattttgcagccaatatttgaagtctgtgcagctgagatcctgtacagcattggagtgtctgcagttattggagtgtcaacagctgagtgttttggagggcctccaacaccttagctcccttgtaagtttggacatcgagatgaatcatgaactgtcaatggcatgggatcacaaactgcaggagcaagaacaaggcagcaatcaggttggactatttcccctgtcacttgtacatcttggtatcacaaatcttgaaggcagtgtccattctcgctttctgtgcctcccttctattacgaaattagacttgtggaatagtccagatttgaagtctctacagttaggatactgcacagcgctggtagatttggcaattgacagctgcaagtcgcttgcatcaatcgagggtttccagtccattagaaaccttaggtccttgagagtaggtgactcccccagcgtatacccatgtctgcagcttatgtcgcagcagcaaggggcatctgacatcttttctcaactggaaactctaacggttgatgatgcctctgtcctttccgtgcccctttgcaaacatctcacgtctctacgagtcttaggattacaccgggatggatatagtggcaagtctatggttagtctgacagaggaacaagagcgagccctccagcttctcacctcactacgacaacttaatttttacagttaccagaatctggagtttcttcctgcaaacctacgaagccttgactccctcgaagagttgcatattgttcggtgtccgagaatcctaaggctgccagagatgggcctcccaccttcgctcaaatacctccttttatgtggctgcagcgaggagctctgtatgcaatgcagaatggcagaaacagagaagctcaaggtccattttgttttttcagttatggtgcccatcaagttgaacggaccaggtgcgaactgttctggattttttgggcgatatgcaactgaagggatggatatactgtagcagaacaacgaagactcttggcaaaacctataattaaattgctaaaatgtagaagataatgcaatgatttaagcataatagcatgttatgacaccggtaagcacgttatgacaccggtgtatcaattttctagatccgccgctgactctttaagtatctctcaacattggcacataaactctcagaagaagagaccattttttaaagcatcttgaaaagttgcaagatgattctgttgcatcctagacattcaactgaaatgcgtaagaatagtctaccttgaaccacatgtacatttgtcttttacaagtaactagagtgttttcccacgcaatttcgtgcggagctagattttataagaaatggatttcacatacaactcttagattttgtttctatagatataattatattttgcatacaattgtaagtgatctataaccccacttctattactatacatacaattgtgttttgcatataatagattttaaaaagtagaattggattaatatatattttttatcttctattttcatagatataattatattttgtatagaactatatcaatcgatctacaccatcaaaacattgatataacataatctactggttaatattttttttctttttctccgtggtaatttataggcctccagagcaaatttcttgactggacagatgcaagtgtggactcgtgaagttggcctttctgaagaagtggagcttgagactgagatgaggagcatgtatgacgccgaggatgtcatggacgagcttgactactaccggctccagcaacacatcgaaggtggtgccgaatctcatcaaccttccattccatgattcttgcttcatgcttcttttgcatttgtgtactagtgagcttactgtgcagctaagagaagctgaataccatagtccataggctccagtcaccacccaatagtttatctcagttaattaagattaccttcccatcatttaaacttccgttgtttactatttttgagcttactatttttgatagccactaagatatatgtttctgtcaaacttttatgcttgggagatgttctagttgtttctttcttcttttttggctgtgtgcattttatgcagaggccgggggtgactcggtttgattgtatcatcttgatgtaattaactgagtttaaataaagcttccattatctaaaaaaattatttttaagaaaccttccttaattattaacagtagattgcacaactggttctcttttgcttgtcccataacattgggttttaaagagaattgcagagaaacaatgaagatggattaatctctcgagtggatgtccacccatttattgcatgtcaactaaatggttgtgaatttttttaaaaaaatacaagatagattaatatgtattatatcacttcacaaacatacaagttcaaattcgacttctataagttgtaacaaaaataaaaaattaaactctaactagtatacgcatattcacagttaaatttgttatttttgttacaacttgtagaaattgaatttaaacttgcatgtttgtgaaatgatatattacacattaatctattttggcaatttctttgaattttgttataaccatttagttgacatgcaagaaacgggtggacgcccacccgagtgtttaaaacagtttcacaagatagatcatactcactccgtcccaaaaaaacccaacttagtattggatgggatgtttttttagaacaacgaatctagataggagtatgtccaaattcgttgtactagaaaacataccatccaatactagattggcttttttttgggacgaagggagtaggtgacaacatgagctgattctttctattatcagtgatcatcgttcaacagtgcaagcatgcattatgctagatttcatttgatatgttgttgacagacatcagcgtgaatcaatcaatcccatgatcttaaaggaacttggtgtataggtttcggttcttggtgcaaccatctacacacgatgcaacatcagctgcccctgcaacggcaaatgcagacaccgcaatcagaattcagagaggaaacagaatctccctaatactatgcacaaagacaagctcaaattcagctaggaccctgatgattggagacttcctgatatcggatctcaccgttcgacgccgtgccgcagattgcgagctggcaaaaggtggcgcagtcgcaggcgacaaccttgttcttgttggggctgcagtcatccatgcacgcagatgaaccgaggtaggttcttcctgcactctgggtagagctccctgtagcatctgcagaacttcgacatggcaccaacttgatgcagttcatcacctgacagcaggctgatcatgcagcagagggccactgctgctgctctgttgccctccatcgatttgagtcctcttcctctctcagtcactctgataacttttgcagaagcagatgatgttaagttcagatcggtcacttgatcagcacaaggattttgcagaagagagatgataaaactaatgcagatggaatcaaatgtgtggacacctatgagcagcgcctaagaacacgagaggattatcaattgatgccatatccctactgttttatatatggtgtgagtgcttgactgcttgtgtttcttttattttggtgcatttttttgtacaagctttatgaattatatgagagcgatcagtatgcgacctgttttttttttgttcatttccatatgaaattgcttttctgtcccaattgtaccccggtcatataaaaaccccgaatcaaattagcattctgttttctttctacattaacccagaggatcgagatgagacatgcttaccagctagaggccttgtctacgaaaagaaagatgaagtgtactgcagcaatatgttgatctcaattagggtagcataaatgtataaatcgatcataccattgcaagtttttttggttttgtaaaccccaacagaatgttcaaagaacaatagaaaagaaaaggaagaggactgcaatgctgaggggcagacgggcagtgcgggcgatggaacaaaagaatttttttgaatgggccgtatataggccactcatcttcacgtattagtattgggctataaatgggccgacagacaagatgctcataaaatcctccaaaaagagctcagctcttaaataaaaattaaaagagtaaatatcataaaataacatatattatggtacaataagttgcacaaaatcatatagattttgtatagtgacatataaccacatgtattatggctctaaagtttcacaaaaccacattattaatcattttgactttaatctaccatatttgagttttataatcatatcataaatttatgagaattttatccatcatatgaatgttacatatctaaaaattttgatgtagaaggtcatggtgtttataaccataatttttttcgaactcacaaaaaaaattgcacgtcaatatattacaagaaaaaagcagccagaccggcttatgccagaagaaaggagaaaaaataaaatgaaaagctgaaaactttataaccataatatctgaagttatgtgctatctgtcaaaattgatatggttttgtgtaacctggatgataataggttacacaaaaccatatactccctccgtcccataatattaaaacctgggactggatgagacgtttcatagtacgattcattgtactatgaaacatcacatccaatcttaggttgtaatattatgggtcggagggagtaggtggagatttataaaatttactcaaattaagaagaaggagaagaaaaagaaatggaaggagagccggtgggagggagtgggcggtggtggcgctgctgccggcgaaccgcgccacggtgcggacgaggatgggggaggtcggcggggggccaaatttccaaccgcatcacgccaccaactcaccattacccgcctatgcgacgtgtgttggtgaaaggtgaaaacccccctctcaaatctctaagtcaacttagccgattagcgattgatatggagtaggtctgatccagctccgcggagtcgattttagtttttcttttttaaggcggagtaccatttgggttcttttattattattattattattattattattattattattattattattattattattattattattattattattattattattattattattattattattattattattattattgcaagtgtaagttggaataatcagtggttggttgtcagttaatttcccctcttgtaccatttcacgcataattccatggctgtgcactgcagaccgcagatcatgtttctttgattctcatctcctttgctacctgccttgttttctgcccataatcttccatccccttgttcgctcaagggctgttcttgctgctgcctactggggcgcgatggggttggttggcacggtagttgatgctgcaataggatggatggtgcaaggcatccttggaagtttcttcaccgggcagatgcaagtgtggtctcatgaagttgggcttgctaaagatgtggagatgctcgagtctgagatgaagagcgtgcagatggtgcttgctgctgctgagggaaggaggattgacaacaagccactgtctgactcattggatgagctaaaagagctgttttatgacgccgaggatgtcatggacgagcttgattactaccggctccagcaacagatcgaaggtggtgcctcactcttcccttcgtgtttcttgatttctgagataaactcatccctcagtttatctactggttaattgtgatttccctttcaagtaattttaacttttgttgttttttaaggaaaccttggctaattactaacagttctaagataatgtgcttaagtagttttctaagataatgtgcttaaggagtatcctcagtacggttgtatcatcttggtgtaattggctgagttcaataaaagcttccattatctaaaaaaaaaaagtagttttcttttgtttgtccctcataacaagtcaacaactggctatttgcctatgtagggaaatgttggaatgctgctgcttgtattaatcctgagggaagccgtgtatcttcatacagtccatctctttttcagcgagtaagtggcaagatgaatgaaattattacttgggtcattcatggcagaaaaaggaaaagagacgaggatgagccaactcatagcatcatgttacctcttgagatcaaacatgacatttctcagaggatcaatggaatagtcaactgtttacacattaggaacaagtctgtgcagggggttcttcagcttgagatctcccgccccattgtggtgccaaagcaaactcagagtgtggccaggggcgcacgcctgacaacctctattcccattgaacgcaaggtgtacgggagggatgcaatgcttttcgtcaagcctcagaggaaagaagtgctcctgatcaaagcagtcctagacctgtttggagcagcatcaggtctgaaagtcaacctcctgaaaagctccatcacgcctatacactgcaaccaacaacaattagatatggtctctgaactgctcccatgtaaagtcgaggaatttcccattatctacctgggactgccactatctatgcgaaaaccaaccaaggcagagctacaaccagtcctagacaagttagcaagcaaggttgcaggttggaagccaaaattactgtcacctgatggtcgactttgcttaatcaagagtgttctgatggcattacctgtgcacttcctatcagtgctgcaaatgccgaaatgggcggtgaaagaaattgaacgcaaatgcagaggattcttatggaagggacaagaagatgtaagtggaggacactgtctagtggcctggaaaaatgtttgtgcaccagtacagaatgggggattgggaattcgaaatctcgacgcctttggtcaagcgctaagactaaaatggttagccaaaagtcttgagcagaaaaatcgaccgtgggccaagtcaggatataaacttggagaagacgtggagaaaatctttaactcagctgctgaattctgtgttggaaacggcaaagacacaaagttttggacagccaattggctaaatggtggaagcattgcttggcgatggccggtactgtccacttatgttggccgctcacagctgacagtggcacaagctttaaccaacaacagatgggtcagagatctgcaaggtgcactctccaatgaagccatggcacaattcttccagctctgggatgaagtacacactgtcgagctaaatctagaggaagacaccatccgctggaagctttcctccgacggacttttcactgtatcttcagcctataaccttttcttcatggcaagagagatctgccctttcagcgaacttatttggcacatcaaagctccatcccgagtacgcttcttcctatggttggctgccaaaggtcgctgcctaacagctgacaacctgggcaagagaggatggcagcatgaagattgctgctccctctgtcagagtgaagcagaggactgcctacatctgttcgtaacgtgcgctttcaccaggagagtatggaggatgatgcagggatggattggaatcaatttcctcttgcctacagagaacgaaccagccctggcagattggtggatgaaggcgaggatggcttttcggacgggctacaggagcatcttcgacagtgttttcgcgctaacatgttggctgctgtggaaagaatgcaatgcgcgtgtctttgaacagaaatttcgaagcatagaacagcttgtgcaagatatcaaggaagaggccattgtctggaagacgacaggagtgttcacaacgtgcaatagcgagatcacgtaatatgcattgtaatctgtagaagttttctagcttaccgggtcagggcttttgccccaatctgttttcgacagcatactgtcgttgtaagctctttaattgtattgtacccttcctttcttaatgaaattggtcgaccgaacctttcggctgacccggcaaaaaaaaaaggaaaacataataaagctgttaacaagtgggaaacctagtgatctaggtgttctgccattagttggtgtcggtggtgttgggaaaacaacgcttgctagatttgtataccatgatgaaagaatcaaagaacattttgatttgcgaatgtgggtttgtgtatctgattatttcagtgaagagagactaacacacgagatgttagaggtcctgtgtaaagatagatgaggttatgaaaatataaccagttttgatgcactgcaggagagccttttagataaaattagacacaaaagatttctgcttgtattggatgatatctgggaagataaggacaggagcagatgggataagctgttagctccactaagatttaatgaagcaaatggttgcatgattttagcaacaactcaaaggacatcggttgcaagaatgataggaacaatgcataaggttgaagtgaatggcctgagtgacacagagttttggttgctcttcaaagcatgggctttttttggtaacgagaaccaggagcatgatccaactatgcagtccattgggcaacacattgctaaagcactaaagggcaatccactggctgcacggagtgttggtgctcttctaaacaggaatgttagctatgagcactggaggaaagttcagtacaaatggagatatcttctagaacaggatgatgatattctaaccatcttgaagttcagttatgaatttctaccggtccacctgcagcagtgtttctcatactgctcactgtttccaaaggatcacaaacttagaggggaaaatttggtccgtgcttggatatcacaaaattttgtggagtgcgaatgccattccaagagattggaggaaacagggaagcaatatttggataatttagttgattggggcttcctcgaagaggttgagtcacactacattatgcatgacttaatgcatgacttggcagaaaaggtttcatcaaatgagtgtgctattatagatggattgggatctaagaatataccaccaaatgtccgtcatttgtcaatcataactactgcttatgatgagaaacgatcttgcgattttcctagtagtgagaagtttgagaacatactacataagatcgtgcctttgcaaaaactcaggaccttgatgttctttggtgaaagcagcataatgttattaagatccttacatactttatgcaaggagtcaaaaggtttacgattactacggatatatgtgacagctgatgacatatgcactacacacaatttgttgaatccgtatcatcttcgctatgttgaattcattgttgtcccgaccacgaatatttttggatctctagattttgtaaatactcctattcctcaagctttgacaaaattttaccacctccaagtgttggatgctagcagtcgagtcaatcttgtagtaccaactgatatgaataatctcgttaatttacgtcatcttattgctcacgagaaagtgcactcaacgattgctggtgttgcaacttgacctctcttcaggaactgatattcaaagttcaagatgctagtaatttcaatataggacaacttcgatctatgaatgagctcgtaatacttggaatttctcaacttgaaaatgtgaaaactaaagaagaagccaagagcgcaagattgattgataaagagcatcttcaagagttgtcgttgtcatgggatgataaaaacatgaactctggacctactgcagagaaaacaagagacggtgtgtttgagggtcttgagccacaccacaacctcaaacacctacagttgactcgatacagtggtgctacatcgccaacctggcttgccagtaacgttaagtcactgcaggtacttcatctagagaactgtagagaatggcaaattattaactctcttgaaatgcttccagtacttaggaagttgaagttaatcaggatgtggaatttgatgtcagtctcaattccttcttatttggaagagttgatcttagttaatacaccaaaactggaaaaatgtgttggcacttatgggtcagatttgacttctggtctaagggtattggtggtgaaggattgcccttgcctgaatgagttcaccctttttcacagtgactatttccacaccaaccagaagttatggtttccgtctctcaacaagctcaccatcggtcattatcatcgtataatgtatttatctattatcgttaatattgctttccagtatattgcgaaatcactgtgcacttactttgataaaatgatgtttcagatcatggaaaatccttcctttagaagaaatgcgagcactcaaggagttggagttaatggacgtgcctgttgttgaagaattgtcagttccttctctggagaagttggtgttgattcaaatgcctagcctgcaacgttgcagtggaataacaacttcatctctaccggtttcgacctcccaaatacatcagaagaaattggtatctagtctccataaacttactatccatgattgccccagtttgatagtgtcgcttcctattccaccttctctgatttctgacttatctgtcaaggggatttcagtgttcccaacaattaacttatctcatggaacattcagtattgaatctaatgagttgaatgagttggataacaggatcttaccgttccataatctgaagggcttacggtcgatgtacctacaacattgtccaaacttgagctatgtatccagtgaagttttcagccagctcgttgctttagagcatttgtctatagagcactgccctaatttgttccagccacactccatgtccgagcctgttcatgaaaacagtatacttaacacagatcaccttgtcctcccatctctcaggtttctcaaaatttcctcgtgtggcatagtaggtagatggctaacacaaatgcttccccatctgctgtcccttgaatactttttattatcggactgtccacagataaaattgctgtcaatcaaccaaccaacagaaacagaagcaaccagcagtttggcttcagtagagacagcctcatctagggatgaacagattctgaaaattccatgcaatctccttcgttctctaaagtggttgcgaatttgggaatgtgcagacctggaattttctggagtcaatagaggattttcaggattcacctctcttgtgatgctacaaattagggaatgccccaagctggtatcatcattggtgaccgaaacaaatgatactaatgtattactaccacagtcacttgaacatcttgatatcggtcctcttccagcaaacctgcagtcctactttcctaaaggcctgccctgcctcaagaagttaagcctaaatagcggcgaatatttgaagtctgtacaattgcattcatgttcgggtttggagtatttgcagatctcgcggtgtccacaccttagtgtgttggagggcctgcagcacctcagctcccttcgaagattatgcatccagatgaatcctgagctgtccgctgcatgggatcttaaactgtttcctctgtcacttgtagaacttggggtcagaaaagtcgagggcagcttccattcccgctctctgtcctgcctcccttctatcacaaagttagagatacaggatagtccagaattggtgtctttacagctaggatactgcacctcactggaaaagctagagattacaaattgcaagtcgcttgcttcgatcaagggcatccagtccattagaaaccttaggtacttgaaagtactcttcgcccccagcttacctccatatctgcatggggtctcagggatctggtctcgactggaaactctccagattagtaatgcagctgtgctatccacgcccctatgcaaacagctcacagctctacgtgagcttatgtttttgggtaagcagggggagggatatgacggcgagaccatggtgagtctgacagaggagcaagagagagcgctccagcttctcacctcactccgagtactagctttctcccacttgcagaatctcaagtcacttcctacgaacctacaaagccttgactgcctcgacgagttgtatatcagtgtgtgtccgagcatcctaaggctaccacagatgggcctcccaccttcgctccgttacctatctttgtaccgctgcagcgaggagctctgtgtgcaatgcagaatggcagaaactgctaacctcagggtcggcatttactctgcatcggctattcccaggcctggttatggtacatattcctatgcctgattatgttgcaactgcccttccctaatctagagttgatgctgtctgcatatgcactgagtctgaaacaactacacatgtatctgcatttctgctgtgcaaatgctatgatatagtcaaaatgatacagttaaagcttgtgtgtaactccaatctttgctattgttgtagaaacatagaaagcagcactattcagttttgggtcttttggcaagtccaacctgaaaggcgaaggaagcatttcttcctagtaagtttgaagaggcttctgcaaggatgcatcacatcactcagcactcagcgggcctcaacacttgcctctcatgctacattggagtactacatataaggcacaagatgcgtaggatatgctactgcctcacaaactgcatttgtacgctgtcttgcttgttctgaaagaagccgtcatcagcggtaagcatctcacactgctgtaatgtgactgtccatgcatttgacttcatctacatcttctgccacaatacttaaattattaagagtattaattatgcagcatcaagaatttggaaataatctctgtttgacttgcattccttagctaatgggctgtgcagctagcagggagaagaatggaaggggagaaacatgcctcggtggctctgtaggatggactgcctggagggctgcgccatcaggtttcttgagttcatgactgctctgattagcataagtggtcgccatttcatattttccacttatgctcagtcgcccacttctctagagtaacagaaaataagaaatggcgagcatcatgtagggtcgtggttcaaaaagtagaagtagaattttctccttcttaatacaatgtttggttggcaaagccggcccggcgaaaaaaaagtttttttttgaaaggagggcaaaagctttgcctcgtatattgatagagatggagaaaaaaatacagagcgacagaaatatgtacagggctagtctaaagaactaaacccgtaaaaagagagagttaagtgatatctcccaaaattccaaactcttgaagctttgaggctcctaaaaaaaagtagaagagttgaaaaaacattaacagaattataacagaaccagctggggaatttgtatgagctgttttttttagttgttgacaattgtttggcagtggattattgcattacaatggattatatttgttcatgactgattgatactaatttgttccatgatcttgtaggtacctggtatagacttcttggtggcttggcgcaatcgtctacacgagatgtaacgtcatctgactccggtgccatctgctggctgctgcagatgatcaccggacattaggagcatgcagcagagagcagctgcacctgctctcttgccatctattcagctcctctcactcactgctgcagaggtagaagatgttaagattcggtcaatcacttgctctgcacaagcattttatacaaagataattcacaaatggatgataccaaatgcatggacgcctatgagaagcattttagaacaagggataagtatccaattactctggtcagctcatgtagtagcctgtagatgttgccacgctgccgcccatggttatgtattgcacaagctttggttcggcttcggcctgtctcctcccaccaagaaatggcgagcgtgatgcagaatgtaggtggataatacaagagaattggaaataaattgctaagccaaataggtatactaatatgagctgatttacgaaatcttttcatttgtattattttgctgataatcatttaacagtggacaactgcacgcagaatgtatcggtattggttggtaggccgtaggcctataccattcacaacccatgtgacggtgtcccatggaatagcattcctgtgtcttcacaagtacatatctattagcagcgcacatatggtgtaccctgccttgcctgtcctcatatggcagccagcctgccagccatccatcgtcaaggtcagttccttgaattcaggtctgtctagtttagtataagtggttgtcgtttcgtattttctgcttatgctcagttgctcagtatatagtctgatggtttttatctcagcgcatttcgtattttctgcttatgctcagttgctcacttccctagagtaatggaaaaataaaaggcatgagtgtgatgttgatcgtggatgaaaagcagaagagttgaaaaggcattaaatactccctatgtttcatattataagtcgctttgacttttttcctagtcaaacatttttaagtttgaacaaatttatagagaaatatagcaacatttccaacacaaaacaaacatattcaatgttatatttaatgaaactaatttagtgttgtagatgttgctaattttttctataaatttactcaaatctaaagaagtttgattagaaaaaaaaagtcaaaacgacttaaaatatgaaacggagggagtaaaacttagcaattttatggacttgcagggacatcaacataaccaaatgagagataccatgggctgatttttttagtcactgattattatttaaagttgtgtgaaaaactcttcataataattgattgtgcattacactggattcgatctgtttatgatttacaccgtcattaattagttccatgatcctgaaggtactcgttgtagagttcttggcgctgtcatctacacaagatgtaaagtcatctggccctgctgcagctgatcattagacagcaggatgagcatgcagtggagagcaactgctcctgctctccgtgtgaagcttgggtcaatcacttgttctgagcaagcattatgcaaagagaactgacaaatgtagatggaaccaaatacatgtacacctatgagcagcttaaaagaaaaagaaagaagtacccagttaatctggtcagttgatatgtggtaccctgtacatcacgccacacagcagccaatggttatttatggcgcgatgtactctgttttttttttacttcagctgcatttttttttgtttcagaatattcacttgcatagattagtatgaaaactgaatttctttctcggtttcaatatgtgagttgcttcagacagttgtacgatctggagtcctgtggcttctgtggagctaacataacacatcgaatgctggagagaaagcaagaatcagagatgagatgtgccagtcagtccagccaagccatatgccctggaatttcaatcagtgcttggtaagaggatgaggtaaggacactaacctgccaagaaaatattgttcgtgcctgaagttttctcagaattgagcatgtcgggagaatctgaacaatggtggttgttgctttgtagtctggagctcaggtgggcattgggcaaccatggggaggaggagcataatgcaggtgctggccagatttttctgggcttctgatcgcttccatgctgagttgagtcgttgcaagcatgtctccaagctctcaagtttgcttcagatgcaggaatgcataagcagaatagtgaagaaacatactccctctttttatgacgttggtcagttcaaaaacattttgggatggaggtagtatgtttgtaatatcgatattggcctatatatatttgtggacgacaaccactgattcttttgtcagggaaactaagtttctgctatcttgtaatctcattggtattcctaatctctgagtgtaattcagtcgcccatgaatgaattagctcatcagtttattggagcttacatggatccggcaagtgtcttgttgtgactggactggatattgtgaacaatgtttcagctttttggtgttctttttttctttcaaaaagaacagattagtgtaagatatggccgatgaattagagattcgtatagtcgatgagatggtgagatcatccagttcgttggtgcaggcagccggacaaattcatcatcagttgttcggatttgctaatcttatacggcgggcgcccgcgacttgtgttgctaacgggcgcttctctgcactgcagctatttggtcaccgtgctcgctcaaagctgccgcgaatggccaccgaggaatgaaaccctagttcacgcccaccggggatgctgcgactgcgaatctgcgattcgtcgcgcggcgttctcgcgggatccaccggtggtgtggtggtggggattccgcgccggcgaaaatctccgccaaatggactggttcaaaggttagatccaccttttctgctatttcatccttcagtccaagtgaaagctgaaaaagaaatgaatctgaaaccggatattttgtgtaggattggtgttttacttcaacagttgcgactattggttggatcatggattgggaggtccgaatcggctgttcattgtaccctcggcccctgtgttggcaaggtcatgtgatacatacacaggtaggagtaacactcaaaacactgtgtgctgattaggtgatctacaagttgcctcctcgactactagaatctatagtgtgtgttcacttcactgaccgagttcaggcctagttcggtcattgttagcacttgctttcacgaaattggcacaaagccgtgccagtggcagagctcgagctcgacgggtattggtggaggccatgtccttgaagccttgtttggatcatggactggcagaatcggtttcattgtgcgctacgcatgccgctctcttggctacatatgttcaggacttcagatcagctccgagctcgttgatacataatggaggtaacacgtgatgtcgcaacaatctttttccctctgcttatgtttcttaggctcaaaagatgaactgctgaatcatactcagcgaccttatcatcttcttatcctcaacatttaggcaacagcatctagtagttggtatgtaacatcacatgcttagattttctgcatggtcgatgtcacagtttgctccactagctcgtaatcacagactcacagtactaccaaatattacaactgtggagccaaagaagacttgacttgcagtctcccatcggctgtgcagactacacatcattcttctttggctcttatctcatttgctccgtaccttctcagttgatcccatcttctttcattgcgccactttcgtctagatccatcctcttgtgcaagggttgttcttgctgctgctacaacctccttaggtgcattggggaacgatgggattggtttccacagcagctgaggctgcaataggatgggtggtgcaaagcatactcgggagtttcttcacaggacagatgcaagtgtggactcgtgaagttgggctcgacaaacaagtggaggagcttgagactgagatgagaaacatgcagatggtgctcgcagaggctgagggaaccaagattgataataggccactgtccgagtcactggatgagataaaggagctgatttacgatgctgaggacgtgatggacgagcttgattactaccggctccagtgacagatcgaaggtggtgccaaatctcatcaatctttcattccatgtttattgttttctaggagcatttcttttgtatttggctatgcaactaagagtagccgaataccatagacatcaccagtaggtttgtctcttggttaagtgcgaatgtatgattacctttcccttatttcaactttgatcaactacttttttattaagaaaacctttggttatttattagcagttgtaagataatgtccctttttctgctcaattatctttatcttgcttgtccccataacaacatgtagtttccttatccagggaaaggttctagtgctgctgcttgtactaaccctgaggaaagctctgcatcttcatccactccatcttacattcaacaaataagcaacaggatgaatcaaaatattagttgggttatggatggcaaaaaaaggaaaagagaggaagaggaggagccaactcatagcgtcatgctgcctcctgaggttaaacatggcatttctgagaggatcaatggaatagtgaatcatttacgcattaggggcaatcctgtacagggggttcttcagctagagattttacggcaaattgctttgccaaagcagagtcagaacggacccaggaaatcacgcctgacaatttctcttatgactgaacacaaggtttacgggagggatgcagagagggacaacataatagagttgttaacgaaggggaaatctagtgatctagatgttgtgccattagttggcgttggtggagttggaaaaacgacgcttgctagatttgtatacaacaataatagaattgaaaaccattttgatttgcgaatgtgggtttgtgtatctgacaatttcaatgaaaagagcctaacctgtgaaatgttagaccatgtgtgtaaagatagacaagagtacggaaatattagcaattttgatgcattgcagaagatccttttggagaaaattagacacaaaagatttctgctagtattggatgatatgtgggaagatagggacaggaaaggatgggaaaatctgttagctccattgaaatgtaatgaagcaaccggctgcatgattttagtgacaacccgaaggacatcagttgcaagaatgactggaacaatgagtaagatagacgtgaatggtttggatgaaacagagttttggtcactcttcaaggcatgggcgtttttaggtaatgagaaccaggagcgtgatccaactttgcgatccattgggcaacatattgctgaagcattaaagggcaacccactggctgctcggagtgttggtgcactgttaaactggaatgttagctttgagcactggaggaaaattcagtacaaatggagatctattctggaacaggatgatgatattctagccatattgaagctcagttatgaatttctgccagtccacttgcagtactgtttctcatactgctctctgtttccaaaggaccacaaattttgtgggaaaaaattagtccgtgcttggatatcacaaaattttgtgaagtgcgaatgccataccaagagattggaggaaatagggaagcaatatttggataagttagttgattggggcttcttagaagaggttgagtcccactatgttatgcatgacctaatgcatgacttggcagaaaaagtttcatccaatgagtatgctactgttgatgggttggaatccaagaaaatttcaccaggtgttcggcatttgtctatcataactacttcttatgataaagaagaacattgcaattttcctagcgaaaagtttgaaaaaattatacagaatatcagatctttgcaaaaattaaggaccttgatgttcttcggccaaaataacacaatgctattaaggttcttacatactttatgcaaggagtcaaaaaggttacgattgctaaggatttatttatgtgacaccttcagacatcagctctacacttaatttgttaacgccatatcatcttcgttatctggaattcattgttatctacgccaggtcaacatatggatatctagacattgtaaatacttctattcctcaagctttgacaaaattttatcaccttcaagtgttggatggtgatagtacaggcaatcttgtagtacctattggaatgaatgatctcattaatttacggcatcttattgatcatgaagaagtgcactcagcaattgctagtgtcggcagcctgacctctctccaggaactaacattcaacgttcaagccgctggtaattttagtatcggacaacttagttccatgaatgagcttgtgacacttcgaatctgccaacttgaaaatgtgaaatctgaagaagaggccaagagtgcaagatttatagataaagagcatcttgaagcgttatcattcacatggaatgatcttagcatgacctctgaacctactgcagagaaaacaacagatgatgtacttgagggtcttgagccacaccataacctcaaacacctacagttgactcgatacagtggtgctacatcaccaacctggcttgctagtacagttacatcactgcagggacttcatctatataactgcagagaatggcgagtcgttcgatctcttgaaaagcttccactacttcagaagctgaagttggtcaggatgtggaacttgatggaagtatcaattccttcttatttggaagaattggtcttagttgatatgccaaaattgaaaaaatgtgttgggacttacggtcaagatttgacttctggtctaagggaattgatggtgaaggattgtcctcaactaaaggagttcacgcttttccatagcaacctttttcactcccagcagaaatcatggtttccgtctctcaacaaactcactatcagtcattgtcaacatataatgtatttaccttatttcttgttaatcttgcttgttcaatatagtttcaaaattattctgcgcttactttgcaaaatgatgtttcagagcatggaaaatccttccactggaggaaatgggagcactcaaggagttggaattaatagatgtgcctgttgttgaagaattgtcagttccttctctggagaagttggtgttgattcaaatgccaagcctgcaaagttgcaatgggataacagcttctccacctctacagttctcgaattcccaagtggatcagacggaatgggtatctagtctctgtgaactcaaaatccatgattgctccaatttggtattgccgtggcctattcctctggtttcttacttatccatcaaagaagtttcagcatttccaacactggtgataaagcagagaaaattcactataaaatatagcgagttgagtgagatggatggcaggatctttccgttccataatctgaagagcataacatctatgagactagaaaattgtccaaacttaatatataattggagcgaagctttcagccagctcatcgctttaaagcatttggatatatcaaagtgccctagtttgctccaacgtcatgttatgtcagagtttcttcatgaaaacactacacctgatacaaattaccttgtcccatctctcaaatctctcaaaattttctcgtctggaatatcaggtagatggctaactcgaacgcttcctcatttgccatcgcttgaggactttgagttgcggaaatgtccacagataaaattcctgctaataagtcaatctacaggagaagcaaccagcagtttggcttcagcagagacaacctcagccagggatggtcagcttctgaaaatgccatgtaatctcctccgttctcttaagcggttatgtatttatgattgtccggacctggagttttgtggaggcaatggaggcttcggaggatatacatctcttgtggagctacagatatatggctgcccaaagcttctctcgtctccggcgaatgaaatggacataagtttgctcccaacgtcaattcaggagctctggataggagacttgccgtcctttttctcccctgaaggcttgtccttcctcaaaaggttgtggctaagtagcagccaagatttgaagtctctgcagctgcattcctgtacagccttggaggatttgaatatctggggccgtcaacagttgggtgtattggaaggcctgcagggtctcagcctccttcgaagattgaacatcgagatgaaccctgagctgtttgccgcgtgggctctcaaactgcaggagcaagaacaaagcggcaatcaggttggactgtttcctccgtcactcatagaacttgagatcagtaatcttgagggcagcatccatccttgctttttctcctgcctacattctctcacgagattagagctaggggatagtccagagctggtgactctacagctgggatactgcacggcattggaaagtctaacgatttacgactgtaagtcgcttgcctcaatcgagggcttgcagtccattagaaaccttaggcgcttgacaacacgtgactcccctggtgtaactccatgtctacagcttgtgtcgcagcaggaaggggcctctgggatctggtctcgactggaagttctatgtactgatggtgcctctgtccttaccacgtcactatgcaaacatctcacatctctgcaatcccttgtgttttggtcgcgatttaatgatgatgagcccatggtgagtctcacagaggaacaggagagagccctccaacttctcacctccctccaacaacttgaattttccaaccaccattatcttgagtcacttcctgcaaatctacgaagcctcgactccctcgaggcgttgcatatcaatgggtgccggagcattcgaaggctaccagagatgggcctcccgcccttgctcacatgccttaatttaattggctgcagcaaggagctatgtttgcaaggaaaaatggcacaaacggagaagctcatggtctacactgcctgatcgcgtaacacttctgtcttaaggtacatttctgtcttaacaagtaatcgatgcacttacactttgcttgcttaaaagtagattatctttcagcagtttgagtcagtatggtgtatcactgccttgtctgacatcgcgtggctgctggccatcgtcatggacttagggtcgcttaccttgagttcaaggctgtcagagaaagctaaaaaggggacatcacgtttgctctggagacttcgaaattatcatgttaaatggtgaaaaaaaggtaaagatctacaccatctgattgtggtgggtttagatttaatggtggggattggtcgaaatagttttatacttgtattacataaatagaaggttgtatatccaaatatgaaatagaccatgagcttctccgttagtgccatttttccacataaatagaaggttgtatatcaatttcccacacaatttaaataaatttcctacacaatttttaaatatactttaatctagctcagtgcaaaattgtgtgggaaattcagttagtctagcattagcgaccaccattttgtattttccatttgttttcctcacttccctggagtaacagaaaataaggaatggcaggtatgatgtagtttggatgaaaaatataccattttgattttgcaaatgtgggtttgtgtatctgataatttcagtgaaatgagcatagcgcgagagatgttagagtaggtgtcaaatataaccagttttgaggcactgcaggagacccttttggaggaaaattagaaacgctagatttctgcttgtattggacgatgcatgagaagatagttccaggagcagtcgatcaggtgcaatgagctattaactatactgagaccattttcttaaaaaaaaagctatattgagacgtaatgaagcaaaaggctgcatgaagtggtttcagtttgttattgtccgcttataatcaatttcaaacttcactggagtatagaaaataagaaatatatcgagttatatagattgtgaatgaaaaattacaagatggttgaaaaatacattaacacaacttagcagtggtatggacttgtatgggcattaacagaaccagctgggagatagcattgagctgactttttatttaattgtttataattgtttgacagtggattattgcattaccctgaattcgttctgtttatgactgacatcaaaattaattaatttcatgatcttgtagtacttggttcaagttcttggcagagtcatctacacaagatgtaacttcatctggccctgctgcagctgatcacgagacgacagtatgagcatgcagcagagagcagctgcacctgctctcttgccttctctctctcagctcctctcactcaccgctgcataggcagaagatgttaagatcgggtcaatcacttgctctgcacaagcattgtgcaaattgagttgacaaatgcagatgaaaacgaaatgcatggacacctgtgagcagctcatgtgatagcctataatcatgccacgccgctgccagtgttagtttatatctctatgcgtctgctggtttttgttccagttcatattttcagaagcctaaaagaaattagcatgaaacttgagttttctttcttgaagatgaccctatgtagctccacttttgatatattgatgactggttctttggtcagggaagttatctcataatttcattgagggcttgtttggttcataaccttgccaaccttttggccttgacaagagttgtccgttgccaaaatttttggcaaaatttggctaggcattcatttactttgctaccaaagttatatctggcattcaactaatccaaataatttagtggtgccaaattgtaagctacaaaccaaacatatcacaaactttttggcattaccaaaatattggcttgcttaattttttatccctattcttggagtgcaattcagttgtccatgattcatctcggtctggagtgccatgctgttgccagtgactgactcggtagtcggtaccaacgttttattttcttcttttggaagggagcaaagcattgtttctcctttgcagctttgctggcgactggctagcgagtgtccaagcctcggtcttcgtccttcacttggcgaagtgtcctgttcggaagagagttgctgaaaaaaggggttcgttggggtgttggtgaggggagttgtattaaaatccttacggacaattggatccctggcttcccgcttgttacctttgccaagtgaggttactgtggccttcttgatggacgatgtgtccaagacatgggatgtagacagagtgaatgcttttttttgaagaagaggttgccagcgctatttttcaggttcccatcagtcgacacggaggggaggactttgcttcttggccacatgacaagctaggtcagtacactgtcagaaaacctcgtcatctttcctagctgcacatagcagtaatggaagaggactcccatcagttctagatgaaactgtcaagaaagggaaggctctttggaagattaaggcaccaggaaagatgaagataaatctgtggcgtgcagctcatgactgtctgcccacgggtttccaactcagacgacgccatataccagcaatggagggatgcatcttttgtaacagggacgatccaattgaacatgtgctgcttttttgcccctttgccagtgctgtgtgggatgaggtcaggaagtcttttaatctccaactgggtcgggcagcactgagtaatatgaagcaatggatttttgactttataagccggggctctgagctacagaacaaggtaatggtggtcacaatctggcacatttggcaagccaggaatgaagcgaagaacaacaactcccctgtgaatccacgtagagtggcgcaatcagttgtggcatatgtgaacatgcttactcaattttgtttcaatctctgtcctgctcccaggtgtgagtccccctcttcagttgctagatgggttccaccgccggcaggaactttcctcatcaacacagatgctgctatcttcaaatctacttgccctctccattgcctgggaagatggtatccaacgggtaatcctggcttccgactgctcttctatcatcagaagaatacaagcctgggcaagggatcgttcttcggttggttgtgttgtctctgacttcaaggttttggcttccaggtttttatcatgctcgttcaagcatgtgaatcgtttatgtaatgctgcagctcatgttttagctcgtcgggccgagcttaatccttgtaattctcaccgtggtgtcatcccggattgcatccaggatgttctatgtaatgatgttacttaatcaatgaaatgctgcattcatgtcaaaaaaaaaagtttaacaagataaacgcctccttgagaaggaattctatagattatagctgcaaaatttgaattgattctcgtcaaaaaaaatgctaaaatttttgtaaaattcctgcctttcaaagcgccacagtgtaagataggagtatagtcaatgaattagagaccccgtacagtacagtattcgttggatgatgctggaaaaatctcttacacgtaaaatagaacggctcattatattagttctagctaactttttaaaaataaatagattaatatgatttcttttaaagaaatttccctatatatttatttttaaaaaatgagatagtatgtgagttaggaacgtcggctgcttgtctgtactgcgctgacataagtaaatttcatcatgggctattttctttttaccggcgtttcactttgggctagagctaaatcaagattttcactttacaccatgtttctttgccaagaattgcactttggggcagggtatgttcacaatctgggtatgtgcgacctcaccgtagatattctgctgttgtggctcttcgccatgcgacagctatgtatttcgttgtaatggtgatgttcgacctgactggcggcgtccggtccaaccggggaggatgcacgtacgagcatggcggcggggcatggcactcagttcaaacaacttcttgatacacggcgtggcacgaacgccttaatttgacgagcatcttgaggcggccctcaggaagtatgaactactccccagtgtaatttagcttagcttgattgctggtcaccgcagccagcgagagggactgtcatgatcaatcggatcatgttgccgcgttgcacgggacgatagtgagttgaagcaaaatgtccaccgcgctgcgctctcaccaggacatggcggcgtatggtcagctagttcacgctcgatctttaaggacgagccacgcgcggttgatacatacgccatcccgctgatgtacagccaccgtcgactgtctatcgtcggccaatattccagcgtgtggtgtggacgctacactacccatcgtagaagaagatgtgtgctatcgtttcatgtatgcagaacttcctttgcatatctaggtgttgccacattgcaatcatctctattgcaagcttgccgatgcccacaatccaatcatctccatcacaagcttgccggcgtcctccctgctctctcttttatctcctgatctactgacatgtgagagtagtacaaagtgaaagcttttggtaaaagaaactagcccaaagtgaaaactttgtctttagaatggtccatgttaaaacttgggtaaaaataactagaccaacgtgcaatttacttaaaaaaaaaggaaagaaaatcagtccttggcgcgcgccactccgtcgacctcgtctccctcagaatcggcggtcggcggcgtctgctccactgtcaggcaatgcaagcatctaccgcatcttcctctcccggattcgctaatccggcgggtgccccgcaacttctcttctaccggcctctcctctccctgcagcgagctattcgtttgcacagtgctctctcaaagctgccgctgatggccacgggtggtggggattccgcgccggcgaaaatcgccgctcccgtccaatccaaaatggaaatattgcagttcctattggtatgaataagcttattaatttacgtcatcttattgctcatgagaaagtgcactcagcaattgatagtgttggtaagttgacctgtcttcagaaattaattttcaaggttcaagatgctgatagttttgagataggacaacttcgagccatgaatgatcttgtaatacttggaatttctcaactcgaaaatgtgaaaactaaaaaagaggccagaagtgcaaggttgatggacaaagagcacctcaaagagttgtcattgtcatggaatgataacatgagctctggacctactgaagagaatacaagatatgatgtgcttgagggtcttgaacctcatggtaatctcaaacatctgcaattaactgggtacagtggtgctacatccccaacttggtttgccagtaaagttacctcgttgcaggtacttcatttagagaactgcacagaatggagaattgttcagtatcttgaaatgctcccactgcttaggaagctgaagttgatcaggatgtggaacttggtggaagtttcaattccttcctatttggaggagttggtcttagttaatatgcctaaattggagaactgtgttggcacgtacggtatagagttgacttcccgtataagggtattgatggtgaaggattgccctcaactaaacgagtttgtgcttttccacagggatcattttcatgctgagcaaaagtcatggtttccatctctcaacaaactcatgataggtcactgttaccgcataatgtaaactatctattcccatcaatcttgctttagtacaattgcgaattttgttgtgcacttactttgttaaatgatttttcagaatgtggaaaatccttcctctagaagaaatgcgagcgctcaaggagttggagttaatggatgtgcctattgtcgaagaattgccagttccttctctggaaaagttggtgttaattcaaatgcggagcctgcaaatttgcagtgggataacagcttcacctgtacaagtttcgacttcccaagtggatcaaaatgaatggatatctagtctccgtgaactcactatctatgattgctccagtttggtagtgtcccttcctattccgccctctcctcttatgtcttactcgtccatcaagagactttcagcatttccaacaatggagataaacaataggaagttcactattgaatctgacgagttgagtgaactggatggcaggatcttatcattccataatctgaagggtgttacatcgatctaccttcgaaggtgtccaaacttgactcgtatttcaactgaaggtttcaaccagctcatcactttagagtgtctggttatacaaaagtgtcctaatttgttccagctacagatctcagatcaggcaaataatacttcatctgctacaaacatccctgccctcccatctctcaaatctctcaccatttcatcatgtggcatagcaggtaggtggttaactcaaatgcttcatcatgttaactcccttgagaagttggacttatttgattgtccacagataaagtttctattaaccaatcaacctacagaaagggaagtaaccagcagtttggcttcagcagagataacctcagcaggggatgaacagcttctgcaaattccatgtagtctcctccattctctaatgtggctctccatttctgaatgtccagacctagagttttgtggtggcagtggtggctttgcaggattcacctctcttgtgcagctacagattaagaattgccccaagctggtctcagcattggtgagcgaaacaaatgataatggattactcccaatgtcacttcaagatcttagcctcagtcctctctcagtctcagaaaacttgcagtccttctcccctgaaggccttccctgcctaagaaggttaagcctatgtaggagccagcatttgaagtccatgcagcttcattcctgtacatccttggagtatctgaaaatctcgggatgccgatccctggttgtgttggagggcctcagctcccttcgaagattggacatccagatgaatcctgagctgtcagctgcatggcatctcaaactgcaagaacaagaacaaggtggcaatcaggctcaggtgtttcctccatcacttgttgaacttcacatctcaaatctcgaaggaagcatcagttcgcaatttctgtgtcttccttcagtaacaaaattagcagtgcgagatagtccagccttgaagtctattcagttgaaacactgcatgacactggaaaagctagagattatcaactgcaagttgcttgcttcaatcgaggatttccactcaattagaaaccttagatccttgaaggtacttggcacccgcagcttatctccatatctgcagcaagaggcctctgggatgtggttccgactggaaagtctaatgattgatgatgcagctgtgctctctgtgcacttatgcatacagctcacatctctaagaatcctacaattctggtctatgggcatggcgagcctgacggaggaacaagagagagcactccagcttctcacctccctccgacaacttggtttctcgcggtgccagaagcttgagtcacttcctgcaaatctacgaagccttgacttcctcgaggtgctacgtatcgatgagtgccggagcatccgaaggttgccggagatgggcctcccgccttctctcagttaccttgatttgtacggctgctgcgaggagctctgtatgcaaggcagaatggcagaaacggagaagcttaaagttgagattatttacaaacagtgaatcgatccctgtaagacactccagaggtacacctttgtttcccacgagtcacatatttagatcatctttcttaagatgtactgcagcaatgccagtcaccgtatgttgtaatgctgccttgactgacatttcagtgttgctgccagcatcggtgtggtcatcttgcctgtgttcaaggctgcctagtctagattatttctacttataatcaattgcaaacttcgctagagtaacagaaaataaggaaattgttagtgtattcttcttgctggtgacttgacgtttgtcatataaagatctctaatgtgtacttgtgctaaaaaaatcaggatgcaaatggactagggatgagagcaattccaggagaggattactgtcgaattgtaatacagtacccaagcgacacagattctaagtgggtaagttgcacatgtgccgtgtaatttccttctggatgcaggccttccccatttcaattgtagccagctcctgacatagtttgcaaaggcctcttttaattattgcttgcatcctagcttatggttctgaaaatcgccattagcgtgtacaatattcctcgcatactcgtgccaccttttgtgatgcatgtgtttgttttcttagttcttaggcactgatatttgcagaaagatccaaaaactggagaacctgaaggtttatcatttgagttcaatctctgtgaagctgtagcctcatgggagcaggttagcattcattcaactgacatatgtatgtgatttttacagatgtattgaagttcaacattatatgatataacgcaaaacatggcgatcctcagtatatcacaaactatgatgccttattgtccagatgtttgtagatcacagtattagttattgttatggacttatggatcacagtattctatttagttattgttatggactcatggtcactcagttgttgttttcctaggtctgcaatagcacaacaatactcacaaagctgttattacagtgtcgacatgtatggatttacagtagacccaggatgcaaggaatggttggtgctattgatcttacgtactaaatatgatgtatgttgatctgcagatcttcttacagttgatgtgatgatctttcaggatgaggtacttttcggagtccagaaagggacacacttcactacatgggagagcatattatcaaatgatggaatgtcttggtgtgagtttctcatttcccctaatccgaactaatagaaccattcctacatggagggattattacttagccacactgttatcgtgtgaagagattgacttgttgatttcttaaagaaaagggtaaattggagccatgccattataattttgcaaagtttgagatatgccattggtatatcaatgacatgtagaacccacatgagtcaatgacatgtgggtcaggatggtatatctcaaattttgcaaaatgtgcagcttgtaaaaatccactcacctatgcgaggtgatcctggcagagtagtaaagtggcttccaaccaaggacaccattgaagctgctagggctgcttctgagaaactgttgaagtaagttttgtggccttcctttgtttagcatgattcttgctcccagttgtcaagcactccatgtccatggcaactctacttaggggcttatttactggatgttgatttccatctgtttggttttggtgcttgaattaactaaattaatcagatacaatatcatcacgccacaagttgtataacttgaaacctcctcgttgcaaaatgcactataggagacctggagctggaagcgagggccctttgagctcttgcaccatgataaagaagctcgagaaagtgaagacagcaaaaagatccgttgtccacgatgctgccttgaaccacctggagtacataagaggttccaccaggtaccctctggagcgaaatgctgggggcggttacttctgcatgatcaacgacagatagacatatagccgcccatattccacatgggacatagaggatgaggaaacacaagcggcagcagaattcatggtaccttgaagcagaatgctgtacccggacgaatcaatcctacacggacaaactattttgagggaactttggtgctcatttttgtacagagccggcagttgagatgattttaaacgcatgagtagtcacaatggttgtatcctacgtggaatctatgcaagtgttgtgtgatggaatgaacaaatagctgagcagttggctgtgcgttcatcggatcgtcaaatttgtcacctgtaacttggagaaatcttaactatgtacatggagcctgtaatttggttggcgtagatatgtactatttgattggcatcacattctgaaacttgctgtatgtctgaacttgcataactttgttgaccaacaaacttgctatatgtctgaacatgtaccaaatattaggttcctatatccatcacaagggagagaaatttgtcaaatttccatttccataggcctttacaccgttgtatagtaaatgacagaagtggatcaatggacgtgctgttctttgttgcagcatttttacggggatatgtaagatacgtatttttatattaagaggaaggggatatgtaagatacgtatttttatattaagaggaataaaagttagatgcccatttttgtattaagaggaataaaaaaacaaaaggaggagtaaaggggacaagaactagaatcttgcaacacttcacaagcctattttcacagcattaattgacaaccacgatatctattttcacagcattaattgacaaccacgatatcacttggagctagatgttgatagatggtactgatatcatttggagctagatgttgatagctggtactgacgtattggtcaaccgtcatagtgtcgcagttttagaacattagagatatttagtggccctcctgacgttgccgctcccgcagcagaagcagttgatattgccgttgcgctagccaccgcagctgcaatagttgttactgccactgcttctccttcggctgatgctgcggctgctggcgtttgatgaatggcagaaaatatttgtcatcatacttagaattttttatttttgactttttattttttaaaattttattaatacaccttttcaaaaaatattttcgaaaaatgaaccttttgccacgccagacacggtggtgtggcaggacaacactaccacgccagctacatgtggcgtggcaaagttatttggccacgccagccgtggccaaaaggatcagatttagaaatactttttggagtgatgtattactaaaattaaaaaaaattatacttgaggacccaaagaaaaaaaaattatggaaagttccctaaagttcataaagcactcaactatcgacgtgtagtctcgatgggttactagcaaactatctacagtcatatagcatacatcaagcaagtaaagtaaaatttgagattaatcgaaattaattggtttaaatatattctcttatggatttgaatacttgaaagatcaatcatatagtgcatttagagttttttttgcaacatatcccgtgtaatataaaaacacaatcatttctttgcctgggaagatattaatgatcctattgtgtgatataagaaagcgaggttgcctttttttctttgttttggattttttttttcattgcttaataattttggatacactatacattctggaattataggagtggtatcaagtaggcgtattatatttaaataaggtaagggaatggaagttcgtgtgattgggaagggaaagatatttttggaaacctctagaatccatatgtgatatttttctctagatttttttctcacatatgattgttaggtttttttcttctctagtataaattcatgatttttcttcaatgtaaggggtgccacatggaccaatcaaaaagctaacaaaagagccagctttagattattagataactctcttgcccttatcttctttctctaacttatccatatccagtaaagtctagaaagtcacgctggcaatagtggcccatgcaagcaaagtttttcaacgaactctcttcctccctgcctcctgcaacggcaacgacaggatccaaggaggcggcggaaagaactacatcagcgcaagtggtggggagactctctagatctacaatgtgccgctttgatctctctacctctaccgctctacaagtgacaacaagcgtcaggcaacatgtccatggtggtgacctactagggtcggtgaagagtagtaagagcattcacagtgcgtcccacacatttaaggagctttagggtgccacatagaaaaaggtaaaccggagaggagagacaagggatagcaaggtcgtttctcacttgtcgccacgtcagtttcctgagatgacagctaagaatgacaaaatttctagaaaggggcaattagaaacacttgagtgagtctagatagcacataacttgataaatacttaggtaaattaacaatcccatatattatctttctgaaaagaatgtatcacatataagaaaagaaatgatttatctaagcccgttgtgaaataaggaaatatgcagatcacttatgctcttctcttataagcatctcctgcttactaccgaaagaaagttccatcccttatttcctttcttaacggattgtactaccgaaagaaagtttcatcccttatttcctttcttgaaccggattttcttacgttcatctagtcttaagttattaaccggatgactaacgtgtttggtttaattgagttttaattattataaacttaaaaaatggatttatttgatgttttaaaacaacttccatataaaagttttcacacgaaaagcaccatttagcactttaaaaagcatgctaatgaaaaccatgaaaaaaatatgcatcttaatagaaaaagaatggccccgctatttttcgacctgttttcaataaacgttgtatatgtgctcggttaatcctgctttttcccccttatggtagttaagaacacaatacatatcatggacgaaaattttacacaatacaaacacacatctccatatatattgcatgcttgaggttaaactttacataatgcagaagctatccagcttactcggcaatcagctgggagcaataaacaacaagcctgtaaagtggaacaagggcatggcaacatccacaggctatcacattctggaaacaaacatgaaagatgcctgcactcctggagagatggagcctagacatctgcatggtcatggtgaggcttcagatccatttcgacctgatgaatcgtccattgcatgccctccagtttctgcagtttaaattggttgtcaatgatgcatcaaacatggtactcattgataatgatgaagatgagtcaaattacctttacaatctcatggtattgccttgcaattacatcaaagtgtggatctacaccttggtactcgcgcaaccgtgaaacctggtgcaagataaaacgacactctagaatgtaaaaacaaattatgggaaagtcgactccttttcaggtaaaagaggatactgaaagatggcatacattgtttatagaaattcagttgaaatagataactacagagctctagttactagatttccattacagagttaaggactagatattcagtaaatgagtaataaccattgctattaaggatttaatgaccaaatattttgaagattacaaggggaaagtaagatgggtgtatcataccgcttcagtataagaattggatgcttctttcgtggcctctactagatatttcctgcaagaaacggtaaataagtaaaaaatgcattttcctgaaaagaaaagcactcaacatattggatctgttttgagaagatgtaccacttaactcaagatatcatgtcagttttttttaaatcaattaaactggctttacctgatcctatgtagtgccggtactgtttccttggtataggtgtcacgcaagagatgatgctcaagatagctagaaccatgttaagaaagaaatagttaattaactctgttttgtcccatcgctgactagcaaataactcaattagaagactaactatgtttaacaaagtacaaattaagatccgttattaggtgatgtatgatggacgtagatgcaggtaccaaccttaatttagcattcattgtccggcaccttttaataagccaagtcttcttcagatcatcctattagcccacaaagacaaagtaggaggattaactatatgaaactgaaaacactccatgttttcaaagaagcagcatcataataggaatatgagaaagcttacatattgatgctgatgttccaatttcttgtctttaacgaactgtataagtacagcaagaatttgctccaggaccttttgaaatttcaggagccatcagtaagtggatataatccagaatttctactagaataaagtgagctaactggctatgtggagtttgagcaatcacttaatatctacacacgtacattatagtgttcggcaaattttctatccatcgaagcaagatcgtctagtagaagggcctcttccttttcaatctcttcaataattaacttcaccctgccaaaagggaaaatcatattgtgagtaatgcgtctcatgaattccctgttattaatattttaagtccaaacaagtaaaggttgacaattggacattgccatcaagaactgagaatgcactgtgagtgatcagagtaaattattacagaagcaaacaaggagattttttttcactcaaaatgttatgcttgacctaagagagttttggcatatcaagcatttccgtataagtaaaaccattgcaagacaggcaaagatatgaaatttcacctttctggaagtctggcacttgaaatctgactaatggatgatgaatctgcagcacatttgaaatgttaagctaaaacaataatattgaatacaagatgtgtactgttgtctaaaactaagttgcccaagttgcattgcataaaatggacaggaacgcagggagtgaaattggtagtcatagcaagattcaaaaactgacccctttcatccattgcaaacagatcagctaaagcatcacacttggcttctaagcgggcctcaatctctcttgccagagttcgttgatagtcaaccatgtcctgcaacgggaaatcagaggtacatgctgtaaacgtttaaacagcccggttttgaaaagaaacaatgtatgtcctgattgctcttcagtaaatggtaaacaaagataggaagcagtgaagcagtaattgtctgattccccaagaaacatacgataatatatccaaaactaaaatgaaacttgaacccaccaacaactggttcacacgataaatttggttgcaaaagattatacataccacggtcatggctggctgctcttgctgcacctggtagagataatccgatgtgattccaagaaaacgatcaggaacaccgccaacaccaggctcaactggctccgaaccaccagtaccaggggccgcagcaacagtggctgcacttgcggtgctgctgtagttattgtaactagtcgagattgaactcgagctaggtgcggcacttgtcatggtgctatcgaatgagctcctagacaaggtgctcagcttctctatctcctcctcatgtacatctccatcctgcgagagcagtggaagccttaacctctgcgcagcctctgcaaccgccaaatggtgctccaatgactcgtacacctacatcagtccatacaatgctccattttcagtcagataatttctcaatttagcagcaaaagtttcatctgcaatcaaccagttgaattcacatttgcagctttatgtccaccattcactgaaagacgcaaaaatttaaaaatgcgggagagaagtggaacctgcggggagcagttgagcttcttcccagcgttggcgacgccagtggagatggcgtgctgatactcctccaccatagcaatggcctccgcgtacacagcctaaccacattacccccagatctgatcagaaccccaacgggaaaccctaaaatcccagatcccacgagaagggacgggcgcactcaccagtgcctccaggtatcgcgcgcgctccgacgcgacctcctcccgcgcctgcggcgaaggaaagcacagagacagcagcgggtgagatcgcggaggtaggacatcgagttcgcggaggtgagatagcgtacctggaggaggtcggagtgggcgcagctggagaggagggaggcgtcgggggcgaggtggtggcgctggagctgatccaccaggtgcgccacctccggcggcggcggagggagcgacgcggcggcggcggccttggacatcgtcgtcgccggcgaataagaggttcgttggtggtggtttgaatcgtgtcggggaatgtggggtttcgtttgtgtagccggatttgggggggctaccagccgttggatcgtgggatgacggatgagattacggctgattcattcggctatcagagacacggaaacaaaaatgcctctataatcttctgaaattatggatgtccactataatctccttcatcaaattcgtcatctctccggtctttcatttcatacgctgtttgttatttttatttgccgaggccaaattttaaaatttttaagaaaattagaattgagagttgatttttaggggtttttcatcgtggttcattttaagttgacttaaaaaaaacctgtgaacattattatttttatgcttagttcttttttccatggcttatgagccgtaaatcaaacaatgtgtacttcgattttaaaatgagatggtaaatcctagtactatattttagaaacagatttaatggctaggtttcgttatgctcgagcataccctcaaatgtttgcataaaaatttaaaatagatgatatctctttgtgattggtgttggagaaggattatagaaaagaagaacgggtgtttgctcgtcctggaagaagaacataagcaacacaatgatatgattagaactgaaacggtataaattaaacaacttactccctccgtcacaaattacttgtctctttaagatttaaactttgtctcaaaatggttatcataataaaatactatttgttccatcaatcgtttctaattcaaatttatcttttttcttgcccctaaccaacctcctacatccaaccatacaatatttagttaagggtattatagttttttttcttaaatcttaatctatgctttaaaaaaaaggtaaaattgtggcacatcaacgtgcatgagcttaataatttgattagatcaaaataccagcccatatccccatacacatgtggtcaggtagatggacgaccttcaagtttgttgttttcatgttcaggcttgcatgatacgattacgatctgccatgatgtctttttctcgagattatggtgtcgtagtcgtcttcaactacagtaaccagacttttatgacagaaaatggtgcgccaaagcagccataccatatgaggaaaggaaaaaaaagatagaaaataaaacacaatattgaataacttgcaaatattgtattgtataacaagatttgtccttggggaccttttattatgcgtataattagcgtgttttttttcgaaagtatttttatcccgaaaagagaagcactagaaaccaaatttcaaaggaatgcgacaagatttatgatgatagccttactggagaggagcatcatgaaatcatcgtgaatgcgacttgaattgaattattatgctcatcgctttcgcataacctctgtaggagtacaattctttactgtactaaccacttttgattaggagtaggagtactgattttatttcaggataaatcaaagcaaaaggaaatatatgcaccttgtcgggtcatcgtggctgctttgatgatgcactcatcaccttcacacgtcggatctaagagaaaaacggccactaaaatgcattatacaattctaataggaattctcccagtcgaatttaagagagaatttggtctcgaactctcaacgaatgaaaaaaaaactctgtttgaaacgacttcagttttatctttgaaccaagtagttgtctaaaatagcgacggataaaatgtttgtgcaacaaatgtattattactatctcttttctacacgataaagatttcgcatgaaaattgaatgtttttctagtattctcccgtttcatattataagacctttgctttttttttctaatctggctttgttaagtttgactaaatttataaaagaattaataatatctaaaataaaaaattagttttattgaatccaacattgaaatattttaataatgtgtctgttttattgaaaatattactatatcttttacaaatttaacttataatatttttaactaaaatgaaataatatgaaacatagtgagagaggtgagagagggagtagtaggtttggagtggataggtgagcctgaacatgaatgagtcagcgacgagtggaacaaacatgtggtgtgctgctgccttgtcgtcatagaacaaccttctcttcccttccctcacctttcgcgttcacctcagctcagctcgtctctctgactctgatctcgccgtcccgagttcgccggacacgcacgcacgcggccacgacggcggcgatggagggcgccctgctctgcgccgccaaccacgcgccgctcacgcccatcaccttcctcgaccgcgccgccctcgtctaccccgaccgccccgccatcgtcgcctcctcctccgggctcacccgcacctggcgggagacgcgtgaccgctgcctccgcctcaccgccgccctcgccgccctcggcgtccaccgccaccacgtggtaagattcacctccgctcgccaccgcaatttctacagtaacttgattctcaccattgattgattgggttttctccccaatctccccctctttttcaactgtttgttcatgctaaaacccccaaatcgcttcgaatttacttgtaatttgattcggaattagcggtcgagtgattcgcatttttctgtgtaggttgcggtattcgcgcagaatattccggcgatgtgcgagctccacttcggcatcccgatggccggcgccgtcatctgcacgctcaactcccgcctcgacgccgccatggcctccgtcctgctccgccactcggaggccaagctcatcttcgtcgactgcgcgctgctcgacgtcgcccacgacgccatccgccgcatctcccaatcgggcgccacgcctcccgtcctcgtcctcatcagcgagctcctcgacgacccatccgatgccaagctcccgtccggtcgtgtcgactacgagtacgagcacctcgtcggcaatgccgggtcgtcgccggagttcgcggtgcggtggcccgccgacgagaacgagccgatcgcgctcaactacacgtcgggcacgacgtcgaggcccaagggcgtgatctacagccaccgcggcgcgtacctgaacagcctcgccgccgtgctcctcaacgacatggcgtccacgccggtgtacctgtggacggtgcccatgttccactgcaacgggtggtgcatggcgtggggcgtcgcggcgcagggcggcaccaacgtgtgcgtccgcagggtcaccgcggccaccatcttcgacgccgtggcgcgccacggcgtcacccacatgggcggcgcgcccacggtgctgagcatgatcgtgaacgccacggcggaggagcagcggccggtggcgaggagggtgacggtgatgaccggcggcgcgccgccgccgccgaaggtgctgcaccggatggaggagcaggggttcctggtgatccactcgtacgggctgacggagacgtacggcccggcgacggtgtgcacgtggaggccggagtgggacgcgctgccggcggaggagcgggcgcggatcaagtcgcggcagggggtgcaccaccacggcctggaggtggacgtcaaggaccccgccacgatgcggagcgtgccgcgcgacgggaagacgatgggggaggtgatgctgcgggggaacacggtgatgagcggctactacaaggacggcgcggcgacggcggaggcgctcgccggtgggtggttccggtccggcgacctggcggtgcggcacgaggacgggtacgtgaaggtgctcgaccggtccaaggacatcataatctcgggcggggagaacatcagcacaatcgaggtggaggcggcgctgttcagccacccggcggtggaggaggcggcggtggtggggcggccggacgactactggggcgagacgccgtgcgcgttcgtgaagctgaggcccggcgcggcggcggcggcgaaggcgggggtggtggaggaggagctgatggcgtactgcagggcgaggctgccgaggtacatggcgccgcggacggtggtggtggtggaggaggggctgccgaagacggcgacggggaaggtgcagaagttcgagctgcgggcgcgcgccaaggccatgggcaccgtcccggcggcggcggcggcgaagtcgaagaggagcaagctctgaatgaatttgtttgcgtcagctgctgacgactgcaatgcaacttcgatgcagcatgcgtgtgtgtgcctgtggaatctcgagacaacaaccaaagaaaaaaaataaaaaaatcatgatttgttgtgatgattcgtgcgagaacaggttggtgtcctttggctgtcagtgtgccgtgcggttttgacagtatactgtcatcgtgtgggcttgccatatgatgtggtaacctcacacggtgatacattttcggtttttgtcggtaactatacaattagggccttcactgtgcgaatacgtggcgagttacttcgatacgccagctcggagattcgtagccacgtctatatcagtcggcccccttgtgaagagcggcggatctcaatgaagttctgtgttcctggtgctgtcaagattataatcgtgggccctgtgctgccaaagtctaattcaaggtcatactacctccgtccaaaaaaacaaaaaacgaatatggcatagtattttagcacagtgaatctggacagatgtatgtctagatttatattactagttttaggatatgtcacccagtactagttggttttttatgggacggagggagtactgcactatgactaatatgttgatcggttcttagattgaaaaggtggttcgacgcacgatgctttgactatggatggccttatcatgtattcgtattgaccgtgatagtgtttggtagtggttgtctgtactcaaccaaacttatcctatcaaccatttcattttgatttagacatggcatcagaacaacctgaatttcgcttatgtacatacgttgcttttaccactaaaaggccggtttgaacttaaacagagtagcttgtttatttgaaacatactctcttcttcctaaaacaatcaattttttatataattcgttcacgtataaagttgtctcttactcaaattcacgtataaaagttgaattttttttctgtaatagaggaagtatgattttatattagggttcttgtacagtttaagcaccgacaaccgctatctgtaactgcaaagggaggaaaatgagctagcttttatacatgcccagctcattgtttggcttatttaaaaaataaacccaacggtatatttgtaaacgaaaactaatttatgaataaaacttttatatacatgttcttaacaatctaaaagtaaagaccgaaaaataaactacgataaaaaaatctcaaaatcaactttaaatttaagattaagaatttaaaaaaaaattaaaatttgagttataagcataagcattagctaaggctgtcaatgtggctatgagagcgagacagtggttgagtgacccattgagctgggcaaacgatggtgcaccgcgaacgaaccaaacgcctagtacagccatagcccattttggtgttgtgtcgccaccaaaggcgattttttcctccttttttttttggtaaatctggagagcgactgacaaaggggggacgcggccccgactcggcgactccgaccgacgagatcgccgtcgctccatcccccatggctgcctcctccgccccacctccccctccccgccgcctcctcgctctcaccatggcgctcgccgccgccgtcgtatccgccgcctccgccgcgagggccccggcctccgtcaccccgatctcccgcaccctctaccactccaggtgcgcctccctcccacgaacgaacccctccctgccgtctactcttctcgggggggtttcgattcggaatttgggggtgatttcataccatttcgaacctaggtcgatgccctgcttcagtatactatacctcgtggttgacgaatcgagagagtgtccctgtttgcttaggtatcatttgctgctgcgcgtgatttcactgcgatttgttctcgttttccccctcattaagtgtagtctcagattggtgtggtggccattgctttgtataaacggcatcatacatcggtcctggcaccactaatgtggtggtttctaggaaaaaaaaagaatacgattctttttattttttttcagcaagtggtatactggcaccacaagcctgtatcttaatgcaaacgtttgcaggcctagttgtgagcatgtgagctgatctgaattttgtacgagtgtgttcaaccttgcattgcttgcttgcttgagccggtctgatgaggagcatatagatacaatgtatcggctttttgattctgtctcctgtgtgcagagcatcatgttaactgttccttttgtttttcctcttcagtgattcccttctgagtgatatcaaggccttggttgcccggcatccagacaagttgagtgtgagtggtttaactgccctatttcagtcattgttggccagtttgttttgttgcatactagtgtttcttatgaaattttgattgaatcgttgcagatggataccataacagcaagtaacaaagggtattccacagacctctttatcgttacttttaatcatgccaaggagagcacgtccaattcttcaaagatccatgtccttctggttagtttccaacagaaattaactcacgctggatcattctgtgcacactaagttatttcttaccactaatatttatccattgtcccaaagcaaatggtatttgtttcactgaaactgttgtcatttccaacctcaattaagagaaatcccaaagcaaagcaaaacaaaaccaactttttgataatttttacacattggcttgtaaattaaattattgatgtcttgcggttttgacagaaaggttcattgtcttccagagctttgggcagcatggcagagagcttatcacttctgaagttgcattaaacctcctctatattttgaccgagaagcggaaaattgctggtgtcgatctatcatcctttgagaagatactggagaatcttgtaatcaaagtacgtccttttgtaacttgttttgacattttcacctcctgacccacataatcattaggagatatatcaatacacatgctcttttctggtatgctctgcatggaattactagagcttaagggcagtctcatttattaggaataaagtataagatagaccaaagttagttatttcctttaagccttgtctgattccatctttgttctattttgacatattttttttactctctttgtttaaatatttagtgcagtgaacacgacaaaattatggtttaaacgtcattactaaatgtttcacctggcatatggtgtttttctcctaaattactctatgcgtatgtcattattctaatatatacaagcttggtttggcttgctaagtaaaatatttcatgacatgaagttcttagggttgttaacctgatccatgctctttagtcttcttaacttgttgcttcctcttcccctcttttcatttttgttattttttatatttctatattaacgaagaatcagatttcttaataatcagttatgattttttttaatgtggctttgatctttaggtggtgcccatggaaaatttaaatggtcgaaaacgtgttgaagaaggggagctttgtgataggagaaatggtgatcaatcttatcttgtaaattcatcacttgatgcagttctatgccaacttcctatattcatgtttttttcatttttcaggaagaggagttgatcttaatagaaattggagtgttgattggggaaagaaggaaaaggttgttttctcagcagtttattttatgcacagggaaaactgtttccttttgacttactgtagtgtgcatgttgattttactgaattgcgtcttaagctaattacctaaattcatatggacaagaccgtagcattccctaaacttgctcgcttgctaccattgattgacatccttactatcttagaactatttttaatttagatctatagagaatttagaaaatagacctctgcatatgctatggttcattaccatgtatcttagtttgtcatccttggctgttactacgcctgtatatggtatggttcagtggttcactatcaatttatcatatgcgttaattgctgattgttggattacttaacctcagttatgcaaatgtagtgtacatcatatcaatattttgagctatatatgcattttacctgtattataggactacgacccatatgaggaaaatcctggcactgctccttttagcgaacctgaggctcagatcatgcgagagctatccaagtcatttaaaccacatatgtgggtgaatgtgcattccggaatggaggtaagacaggctattgtgttttgttgttttccatattcatcatgtaatagagaccattgttcgtagtgcatcttagccacaataagatagcactttgatcctttggaaagaagctacagttaaatatgtaccatagtcacctaggacttgtaaatgctgattcctaattttaatacggttattaggatagcaatcaatctattaaaatgcataagaaagttctaaaatctgttattccttatagtgctacacagaactatacatatcttgatgagttactcactgttgctttactcatttcatctattgttaatcataggccttatttatgccatatgaccataagaatactacaccaaacggagcatctgctcatttgatgaggacagttttggagaatttgaatcatcgccatttccaagatagctgccttgttggatcaggtggtggagctgtggggtatgcacatctaacaagttgcccaatttgtcagttttatcgtgttttttgttagtgagcgtcctaagttctatgtaatccaactagggatcatattgccagcaactaacaatgtgtatgcctttatatccacctgctttctaggtatcttgcacatggcaccacaactgattacatgtacgacattgtaaaggtgcctatgccctttacctttgaggtcagttaatctgtttcctgaacagtcaattcccaagtttatgaagctgtattgaaactatagggatcaactcacattacttgtattcagatttatggtgatgagaaagcatctaccagcgattgcttcaagatgttcaatcccgttgacaagacaacattcgatgtacacaaatcaagcatctctatttctatctttattttttggaagacttgttcctgtatacttttagagttatgcctctgatttaacatttccttcgttgttgccagcgagtcattaataagtggtgcatggccttccttatactttttgaggaaggactgcgaaacctgcgtgaagctcaattagtatcccaaggtgcagtggataactgggtcccaatgggaggagacattgttgagataagtgcggcacgaaagagcagtcccgataagaggaaacttgaaggccttgaccttggaatgcaggaactaagaacctactttagactattcatgctatcaacagtcctgctgatgttcatgttctgttcgaggatatcaaagaacaggaacagagaaacaggtaacatttttgactcctgaaaacccataaaaaggaatagattgaagctcgctgttcagtttgagtttcggatttggttgtggcaagagtgatcaccatttgttgcctcagatgaacaaagtgcatgaaccattcgaactttggaggaaacttatgcggtttaccgcttggagatccaccgatttgggaggcgacatggctggcagagttcagaatggcattgtgcagtctatgtttagatacgagatgcatgtcgaatgatttgtttttaccttcaacaaatcatactagctgtaagttgtaaagctgtccatatcagttcattgtgatgaataggcattccttcactttttgaaggctagtgcacaaacaacatcttgttaacgttgaatatttgacacaattaaatgtactattccccttctcgaatgatttgtattgtcatgagctgcttcattacggaccagtgacgtttgtatcccgacagcctgagcaaacctttttttttcccagaaaatcactcaagtttaacatcaatatgcgtgttttttcagtatgtttagaacacttgttaaaattcaagtctcgcaagaataagaatttgtgaaaagattacgacagaaaggcaatacgctctatacaaattgttggcaagtgtcaatgcaacgttgcaacatactttttgcacatcttctgaacgaagatttgttgcaattatattccattttccacactctcacgaaacagagatgagatgggagcatccacatctttgaaagactgcacatttcaaactgatttgagttagacacaggttacaggtgcttgatgagaagccaagcaatgaccgcaagaaacactatagcaacgacagatatcagcagggccatgcacgagcagccacctttgacgcgcttattcagaatagcaagcctcttttgcacgcgctgaatcaaagaaagatttatgtcaaaattcagttcgcataagcttgaaataactatataacagtgaaactttcctgatgattgtataaagaagtaccaaaaatatacctgaagacgtgagtttgtaacatcaacataatcatccaaatcatcctgcaaaaaccacaatagatcagttgttatcaagtgctaggaacataaattcatatggttttgtgagaataaactaacaatcaatcttgtatgcagggtaagttcttcattgactgctagagcaatatgttttgtgctcagtactgtctcttccagcttctcaagaccctcatcttgttctgcggattgttgcaacaggcaagataaatgaattagctacaatgcaataattgtttcccgtactaaaagctactgtttgtaaccatctagatatatacaagtaaatacaaaatgcaactctgcgaacagatcgggccacttagaatatatcaggggtgctttacttcacacattccaatagaattccaaaaaaaataaattaagagtgatgcatgaatgataataatagaaacaagtcatgcgttagtacctttcataacttgcctctgaagtgaaacgattccttggttatccaaaccagctactctactcatatcatcagctgctttcttactctgaccaagcaaatcctccctaaaaatacaaacaaagatttccattaatatgcttctgaacaaattgcaacatgtcaaagcatcaaccagttatctttatttcgagagaacaaggcaaataactgtatcaggctaccaggttgatatctgagaacaagaacagacctgtttgcaaagtttgacatgttgaaacttgtagccatctgctttgctctagatttcagatttgaaagcatgtcttgtcgcttatgcaactccttgtccgtgctgcataatgagagaacagcatgaataccagtagcaatctttttttttcactagaatcataatcccgaattgccgataatccctcagatatagggagaaatatcgaacagcatctactttaatgaagtctcaacccaggcacacaagagtaaccaactctaatttagtgttcgatccagaaggtgaatcacaagggtgaaaagtggacaggtcaacgtgtaagggtaacaattctaaatgaattcgatcgcggcgtaagttaatcaggggaccgacagattccataagatttgtacaagctaactgtgattccatcaccaacatatgaacaacccatattagtacgcaaacagaaattaagtagtagcagtgttatgaaggaaggaaggaagcaacacatgaactttggaggaatcctggacagcaacgcttctaatttatctcgtaatgaagtctcaaccccaggcacacaagtgcaaccaactctaatttatctcgtatctctctctccataagtttgatccagcaggtgaatcacaagggtgaaaagtggacaggtcagtgtgcaaagagtaacaattctaatcgaattcgattccgccttaagttaaaccaggaccagagacattccttaacatttatacaagctaataactgcgactccaacaccatcaatccatcatatgaacaacccatattagtacacaaacagaaaataagtagaagagtggtatacatggacttgggaggaatcctggacagcaaggcctcgaggctatcgagcctagtcccgaggatggttatcttcctccgaatggccgaggtgtggcgcatgatctccggccccgactgcgggagcgaacccctatcggcgatcatggaggtgacgtcatccgcgagcctggacgcctcgctgtactccctcacccatggatccgaagacgacgccattccttccttcctgcccacccaatcaactcaaaaccatcaggtcaccacctcacaaaattcatcgaggattcaattcaaccccccaaacccacgagaatcatcgattcccaatagatatctatccctaaatggttaccgatcgggaggcggagagcgcgaattgaacgggggagagggaggggggatggatcggagaacctggcggatcgtatgcgcggtggtgcggcggcgggattggggggctggattgctcgtcggtggattcgccgccggcgagtcggcgacgccgcgcgattgcttgcgatttgcttgctttcccctttttggtgttggtgtttgcttcggctggttaatcgctttgacccaagttatgattgctctctgcctatgcgtgtgggacccaggatgaagataataatattaaataatacttttttgatttgtttgtttgtttgtttatttatttatttattcggcagaggagaaaagggatttttcatggctgagatggattcaagagcgagatgacgtgtgcggttggtacggtgattcatgtgcggacacgtgggccaattacgtaggagttgtataggtgggccgggcccaaactagccttttgttgtgactcaaatatgggccgtcgaatgtacattgttttatgaagagatggaaactatggaatgcagagttgtacacttgaaatcacagaaatgtttagaagtacatctttcatctcaaaataaaccaacatcgtacatatcctagtacaacaaatttatacatagagcaatcccaaaataaattaatctcgtactaaaatgtgatacatggatacccctatcatatagtggttcaggacatctctctttcaaggaagcagctgggattcaacttccttgagggtaggagtattatgaaagtatgttaattgtaggttatcaaaaaccctagaataaatccttccagcgtcgatgcacgagcggttaatggggacagactataaattcgttgacgatatgtctacgctggttcaaatccagctcggccaaaaaatctagggctttgtgaatatgagttagtccatatatcacatcttagtccgagattattttattttaggatggagggtgtgttaggagggagtatgtaacactagtaaggtcccgttcttttctccaacaagagttggacgaaaattaagattttcgtggcacgctttttaaactgctgaacggtgtgtttcgtgcgaaaactttgtatatgaaagttgctctaaaatatcatattaatctattttttaagtttataataattaaaactcaatcaattatacgttaataccacatcattttacgtaaaaaaaacttaatcttcatcttcatcttcagaagaaaagaacaccacctaaatcttatcaaaaaccatgtataataatataatactgcatccttttaaggttataaaactttctagcattgcccacatacatatagatgctaatgaatttaggcatataatgtgaatgttatatgggtaatgctataaagtcttatgctcgaggaataaagtataaagtcttatgctcgaggaataaagtatttagcaacatgctatagcaagtaacagtatgtacgcaagaaacagagaccagctaactactgcctattttgaccaccaccaactctgcatacgccgacacaatgcatgatgtttctaattcgttcgtgcatccatatatacacgcatcatggcggcgggcttgatcgcctgagatacgttgatagtccattcaaaatgaacatattagtaacaaataataatgtgtgaccaagacttctatatgcatcttattagctgtttaaaagccagtgaataaaaaacagagtacgataaataaaaattctaaaaaaaacaacccgaaaattaagtcatgaaattcgaattttagctacaactcatcaacgtgttgacattttcttgcattgaccttctagtcgtactaattatcatgcatacaaccatacgcgtaccaaccaccaaccgatcgttcgattttgtagtatcatcagaaaaaataagatcgttcgattttgtaaggacaaaaagaaaacaaatattgaactaattattgcgtgtttccgaaccttcgatacttgttgatattatatgcaaaaacaattataaatcaacccagttgttggcccatgactcaccagattggagacttggagtgtacaaatgtgcagctcagcagcatggtcaaaaatattcaacttgtatcgaccgctcgcacatgaaaatcaagcaaactgacattcatgcatgtgtgtgcttagttgcttacatgttggatatataaaattaaaccgtatgatagcccatatgtaggttggtctggtaggaaggtctaaatttgcaatgtacgatcaataattttttcagtctcgttttgaataagattaagatcaaacttttctaatttcgggcctgttcactttgatgaaaaaaaaacttaccaaattttggcaatggatttcttatatagttaccaaaatttgacagcaaactaaatgtagccattttttttagcaattttactaaaatttgataaggttgaaaataataacaaagtgaaaggcctttcgaccataataactctaaaagtatttaaagtaatagtgctagaatacataaatttatattataaaatactaaaataaaaaattaaaatatatttattatgtattataataaaaaaacataagttcaatattattttagagacgatattgttgttaagaataatatggaggagtggtcatctgaatgatgatgagatcacgatagggagagggggccgcagcatgtgcatgtgccaccgtgctccttttctaattaaaatccacaaacattgtggcggccacggtttctgaatccacttcagctttcgtacagttatttaggccaagcagctgcagggcggggtgagccccagagagaactctgtttaaatgagactaaaaaagtctctatcatattagatgtttggacattaattataaatattaaacgtagattattaaaaaaacccattctataaccctgaactaattcgcgagacgaatctattgagcctaattaatccatgattagcctatgtgatgctacagtaaacatgcgctaatgatgaggacatcctccactattacccgctggcaaagacgcaaaagtcggacggcgaccgtgtgagcctctgaataatcccaccttacttagcttggtaggaggaagccggcgaccgtgtgagcctctgaataatcctactttatttagcttgggagaaggaagccaccttaaaagggagagctacccttctcctattggactagtcttttagggagattgggcctttcctccagtgggtgtgcctatgaactgttggggtccgggcaaccttaagttattgggctataaactaaattgttggggtccgggtaactttaagttattggcctataaactgttggggtccgggcaatcttaagttattgggccttagccaaccccacctggaccagattgttatcagctaattatagattaattaggcctaaaaaatttatcacatgaattagctcatatttatataattagttttataaataatctatgtttaatactctaaattcatctgatatgacaggactaaagtccaaacacttgatgcgataaacatgcatgtgcaatgcccgtctacacaaactgtgcgtacttactttactagttgttccatttgctatagacaaggttaccattcgacgattgattactatactggaaattgaattaacttgctttcaagaattatttcttaccatagatggccgcttatcatactactttcctacgaaggttcccatttctgtgccacctcaccatttttgccaccataaacacactatcacaagataaatttttcctattgtaccttctctgagggaaacattctatcagtgtgatgttgtgtctgcagtgatatatatgcgtacacatttaccgtgtaataaaaataaggaagataaatacactgccataatactatttatgtcctgtattacaatctactccctctatcaccaaaaaaaggcaacattgtactaagatgtgaatttggatattctctacagtatgtccagattcatcctaatgtgtcacgtcgtagtatgaggttaagttttttttagacagagggagtatgtaatactatttatgtcctaaactatgagagattttacatttacacttggacaatcctaggactactagaataaatcatatcatatcctagatttttaagttatttttgaaaagaagggagtaacaaattattcaaactttaattgcctctaaataacagttccatccccatccaagctttgccagtcaaacgacgacgactcaaacgcgatctcgacggaaaaaaaaaagcaccagtcaccaccaccattagtctcatcaaaattattcaaactatagcacgactggtttatcagccaaaggacatgcatgcctgcaggacatatgctaggaacagcatgccatttccctttgttgatctaaaacaataaaccactactattacagatgactacactagcagctacttctactgcgaagccgagtttagagatggttgattgtaggttcatatggttaaaacttaaaactagcagtaattaattaaggggttatttagatggcagtcaaaataaaccttaccaaattttgtaagatggtaatattatcaagttttggcacgattcttcatgtacttaccaaagtttataaaaaactaaaagcatgcaatttaggaacttcaaaaaaatggtatgatttaaattgatatcttaatttacacaataagagcaagtttaataggatagccaattactggctccaaatcatctatagctaatccaatagcttattcatacaatagttaaccatagaaatattctacaccattaatatcacctctcatacacacataacattttagagtctgtgttccagctggctataaatctgtagccgctttcttttctctcttctcttttcttctcgatatgttgtgattatagctggcttatagcttttcctgctctaaataagtaatataagagcaggtacaatagcaggctataaaccagctgcaaacatattttaaagagataaatcaggagagagaagagcaacgggctatagatttgtagccagttgtagcacagactctaaaacgcagtgtgtctatgacaggtgggactagatattaatagtgtagtatgtaactattgtatgaatgagctattagattggctatagatgaattggagctagtagttggctatactattgaacttgctctaagggtaaatagtagtaggaacagtaaatagtaaagacgtgggtcattaaaggccgcatcaaagttgtcgccgggtcgtcccatcctccctcctccgcaacgcaccgcgccgcggcacaacctccccctcttcaccacctcgcccccctcacatcgcgcgcccactactatttgccgccgccgccgccgccatgagctagcaaccgcccacgccctcgccctcgccctcgccctcgcctcctcaccgcagcatgaagcccgggggcgcggcgtcgtcggtactccccgccgcgcgcaggggcggccgcatcgccgccgtgatcgcgccgctgctcctcttcctcgcggccgcgctctccttcccctcctccatcggccgcatcccgtcgctcgtcgcgctgggacggaggcacgctccgtctccgcccccgccgccgccgccgccgcgggtggccgtgtgtttggtgggtggcgcgcggcggttcgagctcacggggccctccatcgcgcgccacgtcctcgccccgctcgtcgcgcatcagcaggagaagaaggaaggcgaaggcggcgcgcccgtcgtcgacgtgttcctccacagcccgctcgacgccgacgcctacaagctctccctcctcgcccgcgccgctccgccgggatccaggctcgccgccgtgcgggtgttccggccggagcgcatcgccgagacgcccgagcgcgcccgcgtgctcaccgccagcaactcgcccaacggcatccaggtacgcgcccgccgccgtttcaatctccgatcacccccactactccatggttggatttggtttggtttgttccttgcttccgcatcaaaccacgcacgcacgcatgctagctacctccccgactccgatcgaacgatagcttccccgcacgttgcgtcgttttcttcatccttagacttgcttgctgccgctgcatactcctcattgcaatttttttccctacacattgctaattgtttatcgattttttgttgggtgttctgtttgttcgtcttgacttgtttgtcgcctctgctaatctgtccacgttgcttaatttggagataatttgtttcaacctttcttcttatattaaaaaaaacatttaagtaaaaaactacctaataaagtagtaaaaccacctgaagttaaaccgaaggtaggtgatggtggcaatggcatggtaggggcaggttgttgggttcttctctttaatctaggggcggtttcatttctctatatccttttaatttattaagcccttaattaggtccaaaagataattaagattgataacgtcttcaaatggaggaaaagaaaccaagcaagattgaattggtaccagtttaatcaatttgcatcttattatctaccgcggaagtcgcatgggaattgtatagagccatcatcaatttgttaatggcccattggccagccatcgggccatgcatgcatgtcattccaaattcacggatctagtcaaagtgtcagctagacagcggccaaattcgctactgctagttattttttttaaatgagagctcgttgcccacagctagcaaaaatatcaatcacaatcaccgagttggttggttctcaaaaggcatcaacgcgttgggaccataactctcaattgttcataaggacgaacactacagtagaatcagcacaagaaagcaaattcagaattcagaagagaaatcatgtgcttaacagtaaataaatatccgagtcagtctttggtccaagcaaggtaagcaaggttggccaagtcgtcgatcggatgattgatcacaaagtcattgttcctttcgtagacagttcggtacgtgtcaatcaatgacccgtctctgactcgctctgcactgtgtaccaacaaaaaaattgtgtcgtgttttcgttttttgcactgtgtccttgtgaatgttcggcggaagctacgaactgaataggacattgccgtgtgcacatttgattttcactgtgagacatttgtcacaatgtacttggctagtactgtgacaaatcttacgcgggtgcacccataggactaccagtacacgtaggtataaggcatgcacgtcagcacgtgccacgactaccatgactgatcccaatccgatggtagtttctaactgtctgtgtgcttaactaccacgattaattagtctagtaatttctccgttacaatgcaagactttttagcattgtacacattcatttaaatgttaatgaatctagacatgtgtatgtgtttagatttattaacatctattccctccgtttcacaatacaagccattctatcatttcccacatttatattgatgttaatgaatctagacatatatatctatttagatttattatcaatatgaatgtgaaaaatgctagaatgacttacattgtgaaacggaggaagtatatatatatgtggataatactagaaagtcttatattgtgaaatggagagtaattgagtattattgatcagcctgaattatccatgagatgctgtgtgtgtcagtgttgatccatggttggttggagagagactgaggggggcaaattaaaggcaaattaccggcatgtcaattagtagatgagcacatggctggctccacatgagtgcttctatacatacagtagagtaaccagaaggttgcgattgctagtgtaaacaaagcatatcaggctaggctggcacatatcctcgtttctgcaaataaactgctggtttcatttggactttttttccaatgaaatttgtgccctccaaaacagaggatgacagttcatcattagagtttatttaggttctacaagacaaaatttggtaccgaccatttggaacagtaaaaaaaatatcttctgaaattactgtagaaacgtgatgttcttataccatcaatgtacggatacatcatcttggtctaacataatttgttttgctcgaatataataacgtgcaaaggtgtatgacaatccatgttccacgtagtattaaaaacggcaggtaatgtgggtacgtagtgacgcttttgagaaagtctcttgaaaagccattgtcatctacatcacaaaagtttgatagatattgttctttgccttgctttatgctcgtcttttgcatcctctgtattcacctccaaagcttcggattatgatggcattatgctttctctgggagaattggagaaaaggtgacaagctacaagtagatagatacctcatccccatgtaaacaaccgatgccgcaaacgtcaatgctcggaaaagagaaaaaaacaaagtagatttaaacttgtcatgtgttctccatcttgtcgtaaaaaaagttattgacagtgactaatctacctaatccgtagattaaatcaatctattagaatacttattactgtatctacttatgtgtctaactatatattagagtatattccctgtcctataaaaacaccaaatgtctaaatttaaatttaaagtgagagttggtttttatgggacgaagttgctgttaatctgcaattagagttctcatttttgtatgtatctatattgagcagggattgctgcaatattttcggttggtggaagggtgcttggacctgatccgcgagcgcgaatctcgaggcaacttcacgtacgattgggtggtccgtacgcgggtcgacggcttctggaccggcccgctcgccgccgccgacgcgttcccggccggcggcgcctacgtcgtccccaaggggtcccggttcgggggcctcaacgaccgcctcggcgccggcggccgccacgcgtcccgcgtcgcgctgtccaggctctcgctgatccctcgcctcgacgtcgcgggctaccaggagctcaactcggaggcggcgttccaggcgcagctgaaggtggccggcgtcaaggcgagggagcggcggctgccgttctgcgtgctgagcgaccggaggtactcgttcccgccggcgccgtacggcgtgcccgtggcgtcgctggggagccccggcccgctgagcggcgccaagtgccggccgtgccggccggcgtgccgcggcggcgagtgcgcgtcggcggcgcggctggtgcgcgggtggagctggacggagtggcggaacgggacgctggagatgtgcgacgcgagcgtgccgtgggagcaagggtgggaggcgctgtttgacgaggtcgccggcgaggaggcggcggcggtgcggcggagggtggcgaccatgggcgcggacgattgcgtggcggaggtggcggcgctcatgacgcgcgccgagcggtgggacgcgcccgcccccgccgagatctgccgcgccggccgcctccgcctcgccactcgctccgcttctgccaatgccactgtcactgccaagcccaaccaaaattgatttgaccatttttttccctcaggaacaccaaaccaaaggcagaaaaggaatagaaagaaagaagagaatacaagttggatagtggtaactgatacatatttttgtacaaatttcatagagatttagctagagatcactgatgaagaatactgaatacacacacagtgtatatagcgtcaaaattcattaattgcatgatcagttgttcgtttcttgtacttacaaatgatactaaaacataaacctaatctaatagtacgctcgatagctgcaggcagcatgtctcatgcattcttgcaagctgactactaatctaatctgatggttggtgtaaagctgtatccatctggaccacctctagccctttcttgcaagttcgtgccattgttggtcagtgtatgattggtgtttgtgtgtgtgtgtaaatctattatttggtgggcaaatcaccataagacgaggcatcacatcgatctacccatcattcttgcttgctgtttcttctagtgttagctctaggttgcccaattttatgaccacttgtttgttaccccatcagatggttatcatcgcaatatctcgatcgatcgatctctggttccttgtatctcaatctcctactaaactaactattccttgtttaaatggtgtgacatatacgttagctagggtaaatttcactcttgttacttcagtaatccgatcaagattcatgcttgtgctatggattcttttcagttagctgaccaaactttcctcacttgggaccgatgagattgagatggtgtgtcctttaagatagtgacagctcttatgtttggttaatgtgagttctgatggatggatttggctttgtatagaattatacctgtcgccgtcgaatgcagggttggtatacactaggcaggagaggcttcttttgctttcttgcaagacatgttaagttccctcttgtggcatagtttggacggcgacggatgttcagatgccaaaatactggcacatttgatcaggaatttctctcccaagtgcttctgtgcttgtcattttcctttgtccaaatcatatgctcacatttgttcatagctagaagttcttcttttttctaggatggaggggatatgttcgtgacctgtccaatgatgcatatatgaactccagtgatatcatccatccatttcattaacctttgatgtttccttcttgttaacatatttccactgatggatacattctggcattttcattcagagtgtatttctttgtttttctggtcaaaaaacaccaaacattccaagatggagttaatatctcatctgtaacgaccaacagggaggacacaaggacggataaaaggagctggcttcttatctgccaacagagacaagcaggtccccgcaacaccaacaccagcagcaacaagccatcaatgcagctttctcctcctcaagcaaccacctcgctgtcctacgtgtaatgtgttattgtccttggtccttcctcctccactggtcaggttaagccccaggcaaccaacgacagcagcaacaacgcaaaaacatggtgcaacacattatttcctgtcatttcagacaaaattgcactgacaaacttgcgacctaaaggagctgatccgttttccttttctctttgaaaattgtttgagcctttgcatcagaatcctattcctctccatgtgcaattaccgtatggcatctcctgtgtagatcgctccatgttggccatatgtttcttgccggatgttacaaccctatcttcagagacaatccatggatggaatttgcattgtgtaaaagcaaaggagctctcacctgttgcataaggcaaagctcgaatctatcaactcttgttgttgttccagcagcaatccgcgcatgatattcaattattgatttgtcctgtttgtggtagactggttggtgcgtttgttctgctcctcttcctgttaatctaacttggcttcttgtcagctcaagaggtgtgataacttggacctgactttcagagctggctatcattttgctggatgacacgcgagattgatctccttgtttaatcgcctaatcgggattgccatgttcctggatgttctacaagatcatccatcacagaggccatcacttgaccagagaggcacatcgcagctatatgttgatactgacatgaaggcaatgcatccgccagtttctctcagctttttttccatgatccttgcattcttctttagtcacgttacaactcttgccatgcacttcattttgatttatgatcaatcttggcttttgtctattacaaatagctgcagtggtcaagattcagttgacagaccatttcgtcttcagtattgccttctcagcagctgacgtgtttcctgtgagaaacaaaaattgctgtgttttagggacaatgcgtagaccttaccttcccaaacaacattgcaaaatctgaacttttgatgagacaggcagcagtatgaaccttcagctatgcatgactcacaggattgctgaatgctgacaccaaaacttcggcatgagaaactggatccaggtgacaaaatcctaaaatcttacacaagcaggatttttttttatttccacaaatcttttgctttactccagtagacaacagtcagtttactaaaagcttaatgtctcctacagatggaccatatggaccttcagaaattgagatttggatgatttattcagacatttacaggaaaactgatcccagagggaccaaagtggggggacaccaatagaaaaagaccaatatattcctctagtacaatatcccttcttttgcatgagattccactgctgcataaagactaatgagcattccaaagtattccctccgtctcaaaaaaggcaaaccctgactatgtatctgtctttttttttttgtgacggagggagtatgaagttgctcagtagtcggtaccaacaaaagggtataaacatctgatgcagaccattcaagtaatcaagctgtgctttcataaatattggatctgcaaaaagggaacaaatgaattgtgctagctaggtatttaaaatatagagatagcagaaaaccatacaactgcggacatcttttctgttgagcttgccggtcatggaaaaggcaggacatgatgactcagttttctcccatgctagcatgaaccattgcagtacctagtgaattacaagatttgagtaatttaccacattcttcaagatgtcctgaaactcactgtgtttcagtgaaaaacctattatgcttttaatgaaggctgagaaatgcctttaaaaaagggtgcatctctggttatctgacagctgcatggtttttctgtgtgtttttttaatcttgtatgcttgctagggggcactacataccaaaactaacccacaaggtggtgctccactgtcaataggaagatgttaatggatgtcagcagagtcatgccgcaaacaactaaccctagcggtggttgttggaggatttgaagaaacactagaaacatagtattgctagcaagtgcaaaccaatgggatgttaatacaataaaactgattaagttcatcatgagaatgaccaaatgcctttcagaagacaattgaactcactaatataacacagagaataactaaagtgctaccgtagtcaggagaaaacaatacaatgtggatatcaaatgtaaacttagcatagcaaaaattattggaacatttgctgaagctgtgagaaaactattgtcaatttgcattgattttatatagggatataccaataggtaagatgtccgaagcagctaaaatctcagtccaatagcatgctttttgtacatgataaaaacactgcactaatgatccatgtacttgattagctcatgcaattcactactagataatttattcagatacaatatttgattttagtgattctgattcatagtgttgatgtttttcatggtcacacctgaaaaaaaaatcgtttgaagaaaaaaaattgtgtttgtttacacaaaagcatcgaatcaagctagaaaagcttggtacagatcagaatagggctcttgccatttttgattctcaaggactaagagcatattcaagattttgtagcttcaattgtacattttggtagatcaaacaatcatatcacagattcatctgaatttgcatatttcattgtaatacaacaaattaaggcaggcaactagcttttcatggaaaaaaaaactaaggctgaagcaagtaccagggacaaagatactggccatgcagcctactttatgatttcatccggtgcagccacttgagcgagttctcgagctcagtatacaacgtcacctccgcaaagctcttgctctcgatcccgtagtcgaacacctcgtatgcatccggtattctccctgcacgacacaacgccctgacgaatgtcgcataagctggagcttcaagcttcatcgcggcaccaaccatggatttgtaaacatcgacggccttgtcgagcttcttgttcttgcagagccccatgagcagagtgttgtatgttcgctcattcggctcgcatcccttggcctccatctcctcgaggagagcaagcgctcccatggcgtcgcccttgacgcacatcccgttcatcagcgaggtgtatgtgatgacgtccgggaagtggccagcggcggccatggcgtcgagataggttcttgccttggtgaccatcccggcgcgcgcgaggccgaagacgagggtgttgtaggtgacgaggtcgggctcgacgccgtcgtccttcatgcggcggaggacgccgaggacacccgcggggtcggaggcggcgcagtgcgccttcatgagggcgttgtagacgggggcgtcggccttgacgccgtggtcggcgaggacggggaggagctgcgcgatctcccggggctccccgcggcggcagacggcgtcggacagcgcgagcagcgcggggcgtggcggcggggaggcgggcgaggggtggagctccgcgaggaggcccctcgccgcggcgacggagcggtggcgggcgaggcggcggaggagcagcgagagggagtgcggcgggagcgggatggtgcgggccgcggaccgcgcgaggtcgaccgccgcgtcgacgtcggcgtcggccgccgcgcggatggctgcggcgaggtcggaggcagtcttgatcggcctcttctctaccggcggcggcgcggcggccgtggccggagccggggttttggaagccttggctggggttttccggtgcctgggattgctgggcctcggcggcgcagggggctgggaagccgaagcatgggtgggcttggcaaggacggcgagggggagcttggcggcgcgcatggcgtgcggcaccttccccatcgtccccggcggcggcggcggcggcgagagtttgggaatcgaatggtgacagaaggagacgggaaggaggaggcttttggcccatgagatatattattgggctttcgtttagtgggccgtatttgggccaatggagtttgttgggctttgcattattgggccgtggtccctgcccatgtatgtcatgtcagccttgtactggttgggccagattgaatatttttggggggaggaggggtgagagtggaaaattgcaaagcgtgtggcgcgttgaccggttgaccccacgcaggtgggacacgggacgggagaggcgcgtgggaagaggggaagacgacgagaggcgagcaacacgatgacataattttataaaccactccacttgcacaccaccaaaagtgaccaaacataggcaacctttgtttcaaagttagtttatattttatctggattacatttatttatccaatctattgcactttcaaatttaatactccacacacacacatgaaaaaataagtacaactgtagatattcatatccaatatttgactatccatctttataattttttttaaaaaaattagtcacacataaaatattatttatgttttatcatttaataacaataaaaatgttaatcataaaataattcaaataaaacgaacgatcaaatgttaaatataaacagtgtaaaactatgatagaggaagtatagtagtactcctaattttcaagtattaattcacttgaattttgaaatgtgccctcgcactatcctcattctcctatttgagatgacaaatgattcccaaaatgaagggactaaaccgtaaaatcgccgcggctttctctttccttttgttccctcctccttggggtctcgcagcatatcaaccaatcaccaccggcggccaccaccaccaccaccaccaccatcgcctcgccgccagccagatcctccccctcccccgcgccaatcacatcgcctcctccgattcccaaggattcttcccgctctctttccttccttccccattcatccgcttcttcttcttcttcttattcttctttcttgttccgatcggggattcggatttggggattccgaggcagcggccgcggcggaggcggagagagggagaggatggggtacgtggggcagcacggggtggcgacgctgcggaggtacaagtacagcggcgtcgaccactcgctcgtcgccaagtacatcctccagcccttctggtcacgattcgtcaacctcttcccgctctggttcccgtaagcgccgcgccccctcgaatttctttcctttccttttcttttcttccattccaccagtgttttgatccgtgccttgtcaagctcctggctttcgccaagatgattgcttcaaagagaaacactggcactagttaagatgattgttcacaatgttttcttctccaccgcacaagtcgcttttgtgttttttttttcttcttcttttttcctacagggacagtagcatttcgagttttttctttgattcgttcaactgggttagcagttatcgcatatgcttatggcgctcacagttacatagcatgggcatgaggaatcccaagcttttctttagcttgtggagtcattttttagtttagagagcatcttccagtgggctgcagacagtggacatcaaaatgtcagcttttgttctccttgctggacactgaaaagcatcctattccatactcctattcaatacagtagtattagttaatccttttctctaacatgctaaagttaggttcattacaaaaattagtgctatggcttcatttttacatctctggtcatttttgcttcctacaggagggtgtaatctgaaacaatggttactgtaatatcagtacataatcatttgctgtttatcatccaaactaactagttaagcacttatggagcatttacattatgaattcatgctagtgcaatacattatgttgatttctttgtccaaatgtatttgttaaaatactaactttattcttcttttcccatgttggaatcgaccgcaggccaaatatggtgagagtcccgcacatgctgatactatgaactagggttttctttttgttcaagagctgacaaagcattgtttccattcctgttttccagattacactgacaggcttcatgtttctattgacatcggcattccttggctttgtaagtatcttatggctgtaaattttcgatgctttctttattgtggcctatacagaggagttttattgctcgttgatgcagcagaaatatttcagccaactgataccttattactgttccaattttatctgcagttttattcccctcatctcgatacagcaccacctagatgggtgcaccttgcacatggaatgcttctcttcctttaccaggtttcaatctcattttttgtttgattgtgccgtataaaatttccagtcgctacaagctagaaccttagcttagaagtacaatgcatgcagacttttgatgctgtggatggtaaacaagcaagacgtaccaactcatcaagtcctttaggcgagctatttgaccacggtagtctttactgaaaatacaacttggtgaattaagttttatccctttagaaagtcctgtatctgatgctgacatgactatatcttgaacaggatgtgatgcgcttgcatgtgctgtaaggctattcaccaacttttctcccttgcatgtcccaatatacggaaaatcttgtgaactgattgtatttattttatatattagtttgaggccttggcttttggaagcacggcaatgtgtggaaaagctaccttctggtattggttcattgctgctgtcccattttactgcgcaacctgggaacagtgagttcatgttacttgagttcttccattcctagttagagcatcaaactacactaggaaccaattttttatgctcactcatctattgtgaaatggtctgtggaatgctttagtgctcttaaagaattcgaaagcaccggtaagaaaatcaagggtttatcagcattggcccaattcaatttagtttctgcaagaacatagatgatagaagcactactttttttcaagttcaagaactaataaactagatactctgctcattgttgtttctatatttgcattgatattaagagactttcactgcatagattttgagtagtacctttctattcacacttaattgtcatctctgcagctttttcacaaacacactaattcttcctatagtcaacggaccgactgaaggccttatgctaatctatttgtgccattttttcaccttcttcacaggtactattttattcccatttttatcaacttttaactaatcaaatctattctgagcctgtaaatctttgtggttttattctgacaatttactgtgcatgtatatcagccagtcacattcaagccatgtggttatagcaatactaatagctcatctttcctttcacaggagctgaatggtgggcacaagatttccggaagtcaatacccctactaaactgggtacctcttgttcctggtatggggactagcaagcttataatcgtttcgtaatatttattgttttggtaatcatatggtactcaattgttttagcatactatttcatctatatcagtgcaattttttcgttaatactgtgcaatagacgtagggttttggacagctacaaatgctggcattgcctatactataattaattgctggttgcttctttgcagaggtcccagtatatggaattgcactgtttctaatgatagcttttgctgtaattccgacgattggatctaagtaagttcttactgcacagcatgtactactttatgaattattttatattacctgtcagtttagtcatctatggactatggagcatatgaatccagcaagcttctcttggaatcaactgaaaaaatagttgtgttttatttatcaattcactctcgaggcaactattgaatttaaataaaaatatcataacgttctttatttgatagccgataaacattcaacctatgatcaatttgcattattctaaacctacagcattcacaatgtgtacaaagtggtcgaggcaagaaaaggaagcatgctgctggcactagcaatggtaagatctaaatatgtcattttgtgattttatcatgtattcatgtctctctttttttcaaatgatattctattttgttgtgccagctctttccttttggtttgctgttggccggagttcttgtctggtatacctgttcacctaattctagtttagttgtatatatctttcttgttctttctattaatttattaaatttgagctagacaacagaagctagcagttaaggtaaaaaatcctccagcatgtcactgaaggatttttcatttttattcaggtcctacctatctccttcagatataatgagaaaccagccacatcttctagttattggaactggttttgcatttggctttcttgtggtaaggccttgtgctataactcatacatttattgccttgcaaatacttgttttgtggatgtttctcttttaacttcctgtcattgtgaaatatatttctgtctgtcatcctgcctgctgctatgaaaatcgccttattggcctaatgcatggaatggtttataatattgctcatcttattatttctcaatagaccatgctggcatgatttgatattttgtgttaaagattctgttcagagtaggtgtgcaactctaagcaacagtttataatatgatcactttatagttttagcattgtatcgttccaggtctgtcatgctaaaaatagtttatgtaagccagtatattttggtctgacatgcttcttttgttgcaaaagacactcttatgagcattacctaatatctacttctattatgcacagggcagaatgattctggctcacttatgtgatgagcccaaaggtctgaagacagggatgtgcatggttgttgcctaatcacctttgttctttggttttgttttccaccaccttttataagtaatatatgatgatacgcatatattttgttatgattaaacattgtgcctccctttgcagtccctagcatatttcccatttgcaattgcaaatgcgctgactgcacggcttgatgatgggtttgtgcctaactacctttttattatcctctacatgataactctttttaccaaccttatttggccatcgattgttgttgcagaaacccccttgttgatgagcagctagttctcctaatgtactgcttatttaccggtactacattattccagaacttaattactaccgatggcgcttgaagtagtagtttttaccgatttcttttcaatagtttttacagtagtagcatatcttaccttgtacaagcccttttgttccacgtatgtttgatctcactattttgatcaattttggcagtggctctctacatgcattttgctacatctgttatccatgaaatcaccaatgctctcgggattcattgcttcaggtttgtgttagtcactgctatgcacttcatttctgccattttgtatcaaatgtttgacacgaggttttttgtgtggtgacaggatcactaggaaaaaggcataattgtgaaccatccacaattgccttgctctggttggcaatcatatgttatatttgcgcaaaaaggcaaatattttcaattattcttcatgaagattctgctcttcagatcatatttgcatttgttattcccaggattgctattatccgagattgaaattatcatcagaacttgtgctgataaggaaacgacgtccttggaagagttggattttgtttgttgtatcacctagaacttcaattcagtgatgctcggcaaaactttttttttgggggtacatgttgagcagattggcagatgatacatttgtaatttttacattgtagcatcacctgagatgcaggtgtacaatttatgctaaaaatgatgctcattatgccttacatattattcatgctcttttttttgagagagagagtaaacttatatatacatactattatattctaatagattattgttcctctctccgggtgagctgatgtactgggctctgaaagcatgatttgaatttgctgaatggatgatgacacttggagagttggagtgaacttgtctattctcatttgaagatgcacctctgttccaaaatataagcactgctacatctttatcaaaacatagcttgtaaaatgcacaatcaattggatcttgctccaatttttcttatcccctagtgcttttgtcctgggcatcaagaatcaagaactttccagacaagctggcttcctcctttttgttctctcttgagccttgtggtagttactgagtacagttaattgtagtaacaagtaactgtaagggtgaatgtaatcacattccaacccaaatcctgtactaattaagcactgagctagctctctctcttctctgtatatataactagctgatctgcttgtattgtcacaaggtcacttgcttctcatagccatggctgtgctacgagctaccgagctccggttgcttctcgtggccatggccgtggctgctgtgacggcgaggggcgctgccggtggcggcgcggcgaaggttccggcgatcttcgtgttcggcgactcgacggtcgacgccgggaacaacaattacctggccggaatcagtgccagggccgacttccctcacaacggtgtcgacttccccggcggcgagccgacggggaggttcagcaatggcctcatcggcgtcgacttcataggtgagtagtagtctaagtagcttcatcactgaaaataattgaagtcattgcggtttgcaattgtatgcaaaggtggaaaaaaagtaagtgtaagtgatcatctcgtcgtcacttgagttaacaaatttcagcaaattcaatatgtaaattctgatgaatggagaagaatatttgaaaatgaaatttgtagcggctgcgatggggttcaccaggagtccaccaccttacctctctctcatcgccatggatgctaacagcagtggtgaggtgatgagcaacatgatgatggcagctgcatccgccatgaaaggagccagctttgcttccggaggctccggtgttcttgattccacagtacgcataaaattctccaaaaccattttgatcctgcatgttatttctgttattatgatggatatgtttgtggattgtgatgtcatgtaatgctagtaattttgttggacacaaaattgaatttcaagtcctatatatttatgatcaccagaaaaaaaggaagtttggtaggagcatggttgctacctaaagttgaaaattttcttccaaccttcaactaaagctataaattctgctccctggttcaaaatttggttacttacttttccaaagtgcaactactagtacagtttactgcacacaactgacaactgacttaacaaattatcattgcaccaggggactacaatcagcatgacaaagcagatagagtacttctcagatctcagagaccagatttcgaccatattgagcgccgaaaaagcgtcaacattgctgtcaaaatccatcttcctcatcagtgctggtgggaatgacgcctttgaattcttctcgcagaacaaatcgccagactctacagcaattcaggaattctgtgaagcttttatctccacatatgatagtcatgtgaaagtaagagatccgaactatgatccagttccttcaagcttcaagatgctaataggccagtagcaattgatgcaacttaataaaagcttccttctatgtaaaagaaagaaattgatgcaactcatgttacattttactttagtctgaatcaatatatctgaaattttgaacagaacatactccctcatttcaattgtccaccaaatgcaactcaaactcgaaatgcttggcatgctggcaaacaaattatgttttattaagttagtaactgttgaagtattcttgtagacattatacaatttaggagcaaggaagtttgcagtgatcaatgtgccattactcgggtgctgcccatatttgagaagtcagaacccgaccggagagtgcttcgaaccgctaaaccagttggccaagagactgaacggcgaaatccgggacctgttccgtgacctcagctccgaaatgcagggaatgaagtactccattgccagctcctatgaacttatctccagcctaattgaaaatccacaagctgctggtaagttacctcagtttaagcaaagagtaatatgacctggaactcacacctcaaacattgtcacagttctacttagcatgaattgaattgtaaccgtctacttttcagctatatctgagatctcacagacttgctgattgatttcagggtttgtagaggtgaagagtgcatgctgtggtggtggtggcaagttcaacgccgaggaagcctgtacccccagctccagctgctgcgctgaccgtagcagatatctcttctgggatctcctccaccctacccaggccacctccaagattgtaggccttgccttctatgacggggcagcacggtttgtcagtcccataaccttcaagcagctggccgacgcatagcatttcggcatcagaactagaacttaggattcactagaccaagacaatgcttgtatcaatctacagcatggcaaagatgctgaactatccaaagaccaaactatctgaaaaacctacataagagaggtgcttctcttatgctttaccctttgagaactgcagaaatggtgacagaacctgtcctagttttctcatgagtgtaagtaaaaatggttgctggttgtccccattaggtgattgatctgtgctctcctcatccaccggagagctccagtcagtggccagccattgcttcaccctgtcgcgcttggcgacaagccggcctttgttcctcatggacagcctcagggggctccccatcctgctcagaacctcctgagccagctccctcaccttgggctcacctctgacatcgctgtgcttgccaatgccacacaccactgacacctccaatggcaatgcgcggcgcgccttcatcgcatccacccactgcaaaatcaaaacataggctgcaattgtgctgaatccatggaggttcagcttcacctccgactccgaccaatccatcgccttgtcgagcaccgaagaggatgtcaggagctcctgcaccagctcagcttctgctggccattgagatgcagacctgagcttcttgaccaactcagccgttgacaatggcagtgattcccccaattcttgagccatcgaagctactgttgggcatgagttgagcacaaagttgaaggccttcgtcgtcggcgcaatccgcagcttcctcatcctcctcagccatgccagcatcctggaatggtcacggcaggaggtgtagcacgagagcacgatgttcgccgcgccggtgccgaggcggatgccggcgtcggacatggacgagatcaccctctccatctcggccatggatcccgccttgccgtagcacttcgccaccaatccgaactggaacgcctccggctggtgcccccgagacgccatctccctcagcgccgcctccgcctcgccggcgaggcccatcaggcacagagattttatcatcgccgtgtaggtcttcttcccggacagcggcggcgaggctcgcagctgggagtagaaatccatcgcccggtctcgcatcccgcgggaggagaaggccgccatgaggtcgcagtagaagagggacacctcctcggaggaggaggaggtggagtggaggcgcgagatggagtcggagatgagggatcttgattcctccgcgctgccattgctctcgagcagcgcggcgacggcggcggcgtggatggagctccacttgaaccaccgcgcctgggtgaccacctcgtagaactgcagcgagaaatcaaatcccaccccaaattcgtgacgcgaaatcggcaagaaatcacaagaataatttgggacgcgctcacgcacgccgcacgcgcaccgggatggcgaaggggtcggagtccatgagcaggcgggagagcgcggcgagggcggcgcgctccgacttggaggcgacgtagctgcggatgacgcgctccgccgcgccgggcgtcaccgtgcgctccagctccgacatgagccgccgctcgctccgccagctcgagccacctcccgccgccgcccgccgcagggacgccaccgccacgttcaccctcctccggcccctccccccggccgccggcgatggcgccggggtcgagagcgacgccgccaccgccaccgccatggctggctgctgcgctgctcgcgagcgacgcggttggcgcgtcacaagatgagacgtcttatcaccaacgggtacacatcgcaaggccggcccagtaaaacaattcagcccaaataggcccaccacatttggattagcgacccaactggacccaccagtcaagcaagcttcatgcatggctgatggggcccagttcgttagcaactgatgcagttcttgtcacgtttgactttattctgaaccaaaagtttatctgaaaaatgtgagctcattatgtataccctcattttgaaattgtgaacaaatcatacaccctataccctcattttgaaattgtgaacaaatcatacatcctcattttaatccacgagatgcaaaagatgcagtcgtgcaactcaaaactgatcactatgatgatggaatgccaaaaatttccaaacatgtttttagcaagggaacaattatttgcatgtattactgtgctcgaatttaatgattaatcgtgaagttttcagtttttcggcagaagatcaccaacttttgtgtaacacgctccactttcaacaagatgtcaaaactaactggtagaatataatgcagatatttttttaaaaaatataatgtatagaaatctggcctctacgtccacaagccacatccaaaggttatacgaatatttagattttaagtctcgtaacgaaacgcagataaccttggaaaatataggcatacactacaagattttcatctacaacataggaggagaaaatcggaattcagacatgaacaagaaaacaggatcaatttgtacaactcttttcagcacattcctttttctatacttgttctcattaatgcaacaaaactagaacaagaaaaacaacagcaaaagaaaccaaaaagctgaaaaaaaaactaaataagcaaaaaaaacaaagctgcaacaacgtaagaaatactttttttttaatcactgtacaccacaatgcgcttccctcttgttgtgggatgctacaattgaatgatgcaccaacattgtataagctactttcagtggtttctcttcaatgctgaaagaaatcctgcctttgatttctggcgaccctcggtatcagctctcacctgtttttttaaatcaggatattaaaacaaaatttaatatatatttttctggagcatgatattgaacatgaaacaaactaaaatttcattgagcaaatagtttctgtttttgtaaaagaacaaaatcttgagaatttttaagaaatgcatgataaattgatgagtcgaggtgcattagaactgacctctttggggagtctctgaagaatctccagtatctgggagaagtcaggcctttcagcaggatctctatgccagcatttctgaagcagctcagacagcttggggtgcgtatctttcggaattgttggtctaaggccctgcagaaaatgatcaaaatacacatgagtgaaccttaattttgtgtagaattgttgtaaataactagcagctctctgctacatatgtacaagttaaaatgctgtcttgcaactcttttagataccaaaggcaatctcctatcttaggccttttatccaaaaaaaaggccatactttatgaaatcaagcaggtataccgtatatatgcatgtatatgaggatatagataaatatgccaataaatttccatgaaatttctaggtatgtacagtgtctctaaaggacctatattctcttgaaaatacttgtcttttcaaactactcctacttggcaatcacggcaactatttcatttacaatcaaggttcataatcattttcatatgcaattcatagcactttctgctaatggtaagaatctatgatgttaagcagatattatatgtgaccctacaattgagggagctacaatgacgtgacttgacggaagtttgttctacttcatctcattcccatgagcatggtaacctgaaaacctaacttgcacctctaatcaggtgagtgattagtaggatggacacaaagggaggcaatcgcatattaaaagaatggtttcttgaaagaacaaggatgccatcattttttaaagactgcttctcgaaactactgtatccttagagcatcacacatgtcccccacttgaactaaagaaatccagcacccacaggacatagctatacaatgggtttcatcaacattttaaatttttgagctaaatactacggataccacgcatgtaactacagaatttaagcagggatgcttgcttaccttctgaacaacacctatggctgcttgtagtggtgttaggtactcatagggtatctgagaaattgaatagttaggtgagtttagttttatatgtaattaatataagttggaaaaagaaagaaagaaattgactttttcctggagcaatttgtagttaccttgccagttagcagctcccatagaacaataccaaagctaaaaacatctgctttatgatcatagggcttatgttcaatgacctgtagttacaatagaatacaaatgttagaataaacaaaaatgctgttgttattcttatggaatgagcgtatgtataacaggcacctcaggtgccatccaacgataagttccagtctctgcagtcatcactccggattgatctttgacacgtgcaacaccaaaatctgcaacctttacgacctgaaaaatatgatcgctctcatttagaagttcaatgacaggagcaaatatcactctgcacactctgtaaatcatatagcattatggatgagattatggatgagaaaaaactagccttgttttcatccataagaagattcgctgtcttgagatcacggtgaattatgttgttctgatgcagatagttcattcctttagagatatctgtcgccactctcagtatttcggatagcttgaaagaattgttctttttatgaaggtaatcatgcagactacctcctgacatgaaatctaagaaaatgaatgcaaattagagtgtgtcaaacactacagaagtttgtctacaaagattataagttaaaccgttgtaatatacctgttacaatatataagttgggctgtcttgtacaggcaccgataaactgtacaacatttctatggcggacctttctgcaagcatgtagattttgtaagaaacaatttggtacagtcaataaagtcaatatgcatatgatttgccaaatgctaaacaccagaaaatgctcgataaatgggagaagcaataaaaaaatattaagttaacctcataatgtagacttcctgtgcaaaatcacggtacatatctgcactaatgcgttcaggtctcactactttaatagctacatcctgactgcagtatgatccacggaacctgagaaagcaaagcatcaaatggcactcaatccccagttgtgtaaaattatattgttttcacttcccgacaaagataatggaacttacagatcgccatttgatccagaagcaaccttggttccaaacttgagaagcttgagatctatctcccaaacatccgtcccatctgttggtatttccacactggtagatggcatactctctccacctgacggaccttccaatgattgtgacgatgagtttgatgttggccaagcttgtgtctgtacacgaaaccaaaataaaactaaaacaaatgttttttatctgaggaattcaatagaccttacaagatttttatgagtgcaatgaacaaggcaagtactggttaggaaaataatgttctgcattcctttttcaggtccaggtaccatattttcaggcaacaattaataccacgagaatgagttttttttttcgttgaacttcatagaagaaagtgaggggaagcttatacctcaatgtcatgaaacttctccagcaacttttcttttagctgctcagtaccctgcagtgtgcatcaaaagagcaaattatcaacacgaaaagtgaagtatgttactgaactaactgaactactgaagcgtttagctctaaagaccaattgcaataaggacaagacaaactaacacagtaacactattatgctgggtgcgtaccccaaggtgccaaccagtgacaacaaatacatccaatgagtaaccatcacttgttgaaaatgcatgcgcttcttggatgtcaagaccaagctcactaagcaagcaagtcagctgcaagtgtatgaaaggcaaagtgtaagaatcaaaacaattgctgacataagtcctgtataaaattgccttgaagttcacattaaacagatttgtaatgtttttttaatctttttttctaaataaatatgtccatttatttttactaatgattttcctaactagctacttgtcagcttttgaatttccttcgctttgttaagattgtattgaaagaagtatgcctacctgactaaggacctttggcttatcagttgttgcaaaagttatctcatgcattggcctgcaagattcagaatatagcgagaattaatcaactagaatgagaatatatagaatccaagtattaatcaactatttgcataatcctaatgaaaatgcccataaatacttcctccgtttcacaatgtaagtcattctagcatttcccacatcatgtctagattcattaacatcaatatgaatgtgggaaatactagaatgacttacattgtgaaacggagggaataaaggcttaagttggaaaaatgaactactcccaccaattatgagtacttttgacaatttcataatccactcactacatgatcaaaccagcgcataacaaagaagctcatgcgtggcatcggctttttgtgaaatgtcttgtacatctaaacaagtatgcaaatgcaatattgccagagaaagtaccatattcggaaaggaaattctgcatatcatggttttgcagctaactgttagtaacaactaatccactgatgctatcatttgttaaaaaataggccacagaggcatgcattcttcacaaggtaaaatatgcgattttctggttgtaacacaatataccatgttaattaattgatatagagaagtatcaaaaacagtttttaaaagggaatcgcaacatgccgacatgccaaccttgtaaggtagtagtacaagactacaagctagtgctaagcacgctatgattgtacagaatggcacatgaaccaaaagaaccaaagacaaatacagtgggctcctctgaaacacgggattgagaaaacaaaggaataggaaaaacacagaatttcgataggaattcaaacgcaaaatagaggattgtaaaacacaggaaaaattcaaaaattgaatgagagagatagactcatagaaaactttccatgaggttggacctcatgttaaaaatcctccaaaacttgtatggaatagagcattccttaagaatttcataggattcaacagttttcaatcatttgtttcaaagggccagataggaaaaaaaacctataggatttgaatcttacaaaaatcctatgtttttcattcaaatcaaaggggccctaaactcaaaataaagcgaggtacacgtgaactgaaaaggggaattatctacctggaaatgagatgaacactgctatcttcatcattgttactgctccttagattagcctcactcgcctcgagcgcaagtgcctctaagttggagcaagaaccaaaggcaggagggggatgaaccctgaaacgatttgtgtagtcaccattactccattagcgtgcataaaagacaagaacagccaaggagacacatgcatgaaagtaaacgaacttcatgtgcatatagatagatagatagatagatcatgcatacatttgtcttgccaagtggttggtatgaaccggctccatcccaagctcagaacaatcatccatatcaccatcaagaatcctagaaacctagatcaagcagaaaacaaagtttggtaagccaaggaattaaaatgtctcttcagtttgatgcaacatctaagctctactcttcagtttgatctaatgaacaacatgagacagcacaaatcaaattccccgagcaacaccacaggagagaaataaaaatctaatggaaattaagcagtacgcgaaatcgaccgacatgcaggcagccatggatggatctctctcacctggacgacgcgcaccgacaaggcgggccgccggtccggatcgcgcgcctcctccagcaaccggtggtgcgtcaccacgtcctccgccctatccgcgtgcacatccagcgcgtacctgcacgcccgccatggccatgagggaagtcggggagggggagggagggggagagagagggcaggagaagagatctcaccgggcggggaggcggtggaagtgggcccagagcgcgtcctcgtaggccggcgagatctcgacgggggcggcggcgccgaggccccggaggcgggcgagtacctcgctgtacacctcgaggcggcgcccgctcttgtccgcgcgccgtccccccgcgccgacctccgccgctggctgcggggacgacggcggcggcggcggggacgacggcggcggcggcggcgactcctccacggccatcgattactctcgaagcaaagcgagcgcgcgcggcggcgtggtgcacgagacgagagaggagagccgtgccgctactgctgctgggtctgcatggggtggtggtggcgcgcacgtgagacgtgacaatggcggcgagaaagtccacaactttatagacacaaacaagcggaggcgctcgccgtagagaagaagaaaaagatgagaagagagacaggtttttgtctaggttctggattgacttcttctcccctattggctggagtaataatagtaccattgtaccctcaacgtctcaaaataaatcatctcttactaatacacaacaaatctagatatatatccatattcattgtattcacattttaatacgaggttgatttatttttgaaacgaagggagtaatacaatgatccaaacaaaataattcaagattaatggtctgtttcgtactagcttcaattccacttattctaaagttcaagtccagctaaataatttcggctccatccagaatagaagtggagctagttaaactccaaatccagctcttggaattaaattttgaaaaacagattctaagtataatactaagaagttaaaaaaatcacaatttttattaggtattaaactccttccgtgtttagcttatttggaagtgaagtttaaaatagtattaggcttgaaatttaagtaaatttatgtttttattaaaaacattgaaaaaaacaagttgtattttaattggggattgaatattattggggataaggctgcagaaaatgggggtgatgaatctggaggatttggatgaccataataaaatatgaggacattaatccaaaaccgagtcaaaaatgtgatgtggagaatggagaacggttacacacaagccatgcaatgaccagtgaatcagtccaaaaaccattgctttctcctcgacctgtgtgcatgcgcagtactacaactccaaggtcaaagcagacattgcacgtggtttatttgctacgtccacacgtacggtgtgtatgaacccggaataaaaacattgctttcacaaaataaaaagaaaagttactaccatatggttgaactaagcaacaattgaagcatcattttaaaaggatgcaactctgagcgagactcaaaatcaacttcaaactgtgtaacgagaccatgggcgggaattgtatatatgtgtaccgctggcttctcaccaaaaagctctagtattaaatttataggtggtacctttaatatttctatattgatatgtttatatgtgtctatatataaatagagcgtacaaaatatgacaaaattggagcttactcggcgaaacttgcgggcattgatgaggcaatgtactaacctaactaagctagttaggttcattatatctcatatttgggctgggttcaatggttcatccagcctagacactcaaaaagtgggcaagataaacaaagatacaatattgcaatttgaagcactagtagtaccagtgagcaccatatcatagcaggatagtataattaaatcaagaagatattgtaaattatttggttagtattttctataccatgatggtcctatatgatactgctaactagtactgtatgactatactgttaattggagctctttgagcatgtaacaatggtagcaagtagaaagtagctagctagtcactgaaacgtacttgtacgtacgtaattcaagaatgatagataagctaatcaagtactgatgagataacattgtccttatttatttgtttgaggcgattttctactaaccaattttttgataaatacagacacagcgtttgtggtaagttctgaaaaacttcgcatatatacacaccggagggaacaaaagtaaaaggaaacttcgataaatcgtttttctttaatttggatagtatgagtgatttgaatttgaaggcatcaattttctgacggtatagcgtgggatctttttcagggtacgtattttgaattgaatggaatttagcttggaaattacccactctaaaaaaaacttggaattaaaagagtggtgccttgcttttgcctatgacctcgttctcttaaactatatatatgcagttcacctttcgaggcggagctggatatgcccatgtcgatcctccgcatcgcacagttactccatgcacgaaccaatttttggtttggctaatcacgccacgtgtactccaccatttctcaaaaagaccgtgttttagcatgtgtaaaggaatatgcgattgagttttaattatcttcttcgcccattgatataattagtaaaaaatactactccctttggtattatttgtttgacgttgatcatcgtatatacacaacttcaatcagtaattttcactactccattcgcccctttaagataatcgattttaattatttactgctccttactctaccaactctcatctcgtaccaactctcgtctcatactggtcgctagcttctatccaatctctaactaaaaggtcgtcgggcatatccatagtattgtaccccagaacgtgaaacgtaagcaagtggacatttatcaccttatctccgaaaaaaagatagattacatcgctggctcgagcttgagtcttcgcatcggtccaatggtgaggattcacttgatatataaaatccatcataaaaccatgttggcatatttctagcgaaaccttattcaatttgacacatggctcgagacaagcagcctgatgtttttagaatatgcttggggattaaacccaacaatcatacgatgattgatctccacgtctaatataagcatatatagttgtggttaacttaattaatcagagaggaggaatgatatttatatcaagtgctgaacgagatcaggactccagcccggcacctagcaagtactcctacgtagtacgacacatggatcgatatccatttatactagtggatcagtagtttacaattgactcgcaaaagcaagctaagcatcgagttaacatcggctagctattccagtgacagtgatttggtcctaaccaagtggctgctgaattattgaccgtttgcaacttaaattaattgttgtttttatcactactacttgatctccgactctccgtttgagaacatatacgtgttaagcagttcaaaattaaaactgaaaaagtcatgaacagcggcagaccagagatatatatagatcgagaaaatatatatagtaaatgcacgatgtgtaacctgcatttttgtcatttagttaagcaataattaagcattcattatccaattaaaaagcaataagcattgtatattcagagttgcaggcgaagtcacgcaacaaccgatgatcgatatcgattcctggcgtcgcatgcgtgagtacttgtgcctgtcggcatcagacaaattaagcaatcgattcattaattaaacatatgtgtgtggagtagctataaccttgcagagaatcagatcgaataagttaaggtaaacgataaagataacataagaaaatatatcaatagtagtaattaagtctgcattttgtttttgctgggaaagtctgcaataattagtagtaaaaaaatagtgttggatccaatcgttttgcagaatcaagtgcaggtttgacctgaaaatgcattgcagcatcagagtgagagatgcgtcaaattaaacgagcagtggcgactactggacgggctcgactggccgcgtcacaactacaggatatgcatgcagctggacacgtagcttcatcgaccgacacgtaggcatgcagagatacgcgatgtctgacgaaattacgtttataaaatttactactccctctattatatattataaatcgtttaacttttacatagtcaaacttggttaagtttaattaaatttataaaaaaatttagcaacatataaaatatcaattagtttcactatatctaatatttaatatattttaataatatgtttgttttgtattgaaaatactagttaaatttgaatagatttaactaggaaaaaaagaaaactacttgtaatatgaaacggatgaagtagttgatttggctgtgacttattgacataagatcgaagatgcattctttttattattattgaaacagagcagcagatagatgcttctcgggattttcagaacgtgtcatgaagataggaataccagaatttatacactactcctatcatgtgccttaggatagtacaggcgtactataatatattgagttattcaccatcaattcattcagttttaaacccctttaaaaatcatccatccaatcgtggcatttttaaataatgttttgtttttgaaatttctttgcatgcatataaaataaaaagggataataataacaatactaactatcatcatttgtgccactccaagaaagaaggaatgataggaaggagaaaaaaaaagaaaggaaaaggagagatgaggaagagaatgttcagcaatttggcccatatattaccgatgggccttccaaatacgtataacgtggcccatcaacctggttcgaattacgtatgcagcccagcaacatgcgtccggatacaacacacacaaacacatgctatgtttggcctaaaggtctaaaaaagttataacaaaataataaatataaaatgtattcatatcctaggtagagtttaaatatttttatttaatttgtagaaattaaatttaatgttgtatgtttgtggagtgatatacggataccttgttaaatgttaataaaatttttaaaaattttgatagctatttgggtaccttgaaagaaatgaggtaacatccactcgaggaaaaggaccatattctaataattatggataaatttaaacgcttatcatttttatatttgtttacctatggagtaaaatacttgtattctgattctacacaggcctgatcaacgatgtgcttattatgctttatgctacttgtaacttgctaatgaagcgcgattacactcgtgactcgtccctgatgccgcctgtcgcacgctcttctcaagccaagaatcgcattccttccttgcatacatagcatcatttcatttgcgttttcatgcatgcccccgtggggcccaccttagtagactgcgggcccaccggtcagcctcctcttgtgcattaattcagcaatcctcccgccatgcatgtgccctacgctttcacaccgttaatggttagcttagctagcccccgaagcggccgagctccggtcatcatgtcttggtccggcgagctgtcgccgccggcggcggcgtcggggactcgcctcctccacggcgacctcgacctcaccatccacgaggcgcgcggcctccccaacatggacttcctctccaccctcctccgccgcctctgcctctgcctccggccgccggcgagacggcccagccccggccagagccgcggctctgtcccggccgacgaagacggccgccgccagccgcacggccaccacctcctcccgacgtccgacccgtacgccgccgtcgtcgtcgccggcaacacgctcgcccgcacccacgtcgtccgcgactccgaggacccagagtggtccacccatgtcctgctccacctcgcccaccacgccaccggcgtcgccttccacgtcaaggacgccgaccccttcggctccgacctcatcggcgtcgccatcctccccgccgccgacgtcctcgccgcggccgccgcgcccatcgtcaggagggagctccccctgtaccgccccgacggccgcgggaggccgaagcccagctccgccatcgtcatcaccgcctcgttcgtccccgccggcgagcatcagagcatctacgacgcggaacacggcggcgtcccggcggcctacttcccggcgcggcgcgggtgcgaggtgaagctgtaccaggacgcgcacgtggccggcggcgagctggacggcgtgcggcggcgcggggtgttcgagccggggcggtgctgggaggacatgtgcctggcggtgctcggggcgcagcacctggtgtacgtggcggggtggtcggtgaacaccaaggtgcggctcgtgcgggaggcgatgtcgccggagatggcggcgaaggtggaggaggtgcggacgacggcaaccgacgacgacgacaatccggtggcggcggagggcatgtcgctgggcgcgctgctcaagtacaagtcgcaggagggcgtccgtgtctgcctcctcgtctgggacgacaagacctcgcacgacaccttcttcctcaagacagttgcgttgcgtaccaactcaattcaactctgttcttgaatttttgtcaaagaaaattgaatttggatttgatttctcagggcggcttgatgcaaacacatgacgaggagacgaagaagttcttcaaggactcgtcggtgatctgcttgctgtcgccgcgatacccaagcagcaagctcagcatggccaagcagaaggcaagatataattaattactcaatcatttccaaaatatattactccttttatttttcacatcgtcttatttaaaatatatataaatattatttatttttgttatgacttgttttactatattcttattaataacttactccctccgtcccaaaatataatctttttttttaccttgatatggtctccgagatgctattttgaccaacaatattaagatgctttaaataaaaatagttgcatattataatagtttgtttaatgataaatctagtaacatcaattttacatgtttgatttttttttattttttgttattaatggtcaaagttgaaaaaatatttgacttattactatgctaaaaatacttatattttagaatggggtatatacttttacatatttatgctaaacttttagataaaataataattaaacgatacgtgaaaagttaacggcgtttgaaacgaaagtagtatcacaagtaaatctcgattaaaaatggtgcaatgcaagcaaagcatgcaagacccaatgctgagaggggcgtgtcagccagcgtgcagattgtggggacgatgtacacgcagcaccagaagtgcctgctggtggacacgccggcgtcggggagcacgcggcggatcacggcgttcctcggcggcctcgacctcgccgcggggcgctacgacacgccgtcgcacaggctcttcgccgacctcggcaccgtcttctccggcgacgtctacaaccccgcgatcccgccggcggggaacaagggcggcgccggcgaggaggggccgcggcagccgtggcacgacatgcactgccgcgtcgacgggccggcggcgtacgacgtgctggagaacttcgagcagcggtggaggaaggcgacgaagctgttcagaagggccaaggcgcactggaaggacgacgccttgctcaagctcgagcgcatctcctggatcctcagcccctccgactccggcgccggcgacggcgacggcggcgacagccacctctacgccttgcccgatggtcaccccgattgctggaacgctcaggtacatgataaaccgatcgattgatacttgaaatcgatggagataattttaatttcttggtgataaaactggcaggtgttccggtcagtggactctggatcagtgaaaggattgcctcgttgctgggagacaaaaaagatggttaataatctcttcttctctcttcatcaatggctcatcgtcattaacttatcaatcaatcaatcaataatcgacgtactccctccgtattttaatgtataacgttgttaaatctattatcaacatttggccatttgtgttatttaaatttttttacagatataaagatatttatgtcatgtttaaataacgtttgatgataaatcaagtcgcaataaaatatatggtacttagataaattttttaaataagataaatgataaaaaatgtatcttaaaaaataaatagtgtcataaatttaaaaaataaatagtgtcataaattaaaatacggatggagtaataaaatggtactccatcaaatagctgaagcatcgatatgcgatgcaggaggcgaagcacctggtgtgcgacaagaacgtgacggtggagcagagcattcacacggcgtacgtccgggcgatccggtcggcgaagcgcttcatctacatcgagaaccagtacttcatcggatcatccttcgcatggccatcctacaagcaccaagaaggcaggcaccatctgaatttgctgaatttgtctcatcacttgtctgaatcggtaaaaatacatggagcttagtggttgcagtcacctgagtaacaccctgacaccctaaggtcatgagtttaaatcttcatacgagcgaattacaattaggttatttgaggactaaattcctaatttcatattgggttatttgaaggctaagttctcagtttgttagactaagctcttattttaaaaagattcatatgtccggttggatgtagaggctgtaccaaaaataccattctctaacaaaattgtctgaatatgctgcacactgatgcatgtatatgtgtgtgtgcaggtgctggaaatctggtgccgatggagatcgcgctgaaggtggcgagcaagatcgccgccggcgagaggttcgccgtgtacatcgtgatcccgatgtggccggagggggttccaacctcgggccccatccaggagatcctcttctggcagaggcagacgatgcaggcgatgtacgaggtgatcgcggcggcgatcagggcggcggggatggagggcgcggcgcacccgcgggactacctcaacttctactgcctcggcaagcgggaggcggcggcggcggcggcggcgggctcgccggagcaggagcacaacccggcggccagcagcgcgcggcggcaccggcggttcatgatctacgtgcactccaaggggatgatcgtggacgacgagtacgtcatcgtcggctccgccaacatcaaccagcgctctctcgccggctcgcgcgacaccgagatcgccgtcggcgcctaccagcccaatctccgcgccggcgccggcgccggcgacggccaggtgttcggcttcaggatgttgctgtgggaggagcacctgggcagcagcgagtggcgggagctgaggtcgccggagtcgccggagtgcgtgaagcgggtgaacgagatagcggcggagaactggaggaggtacgccgccgacgacgacgatgtcgccatgcaggggcacctcatgaggtacccggtggacgtcggcgacgacggcaagatcagcgagttgcgcgggcacgagttcttccccgacgtcggcgggaggatccttggctccaccaacaacaactactgggattatctcaccatgtaggcatgtagctgcctctgcattcccaaattactattcggattaatatatgggactttctaggtgtcttttgacagaaaaaacctccctaaatcttgcaaattatgaaccgttggatcaatcgtgcaacataagtaaaacctacttttcctccttccgcttctcagtccatccgtcgccgccgcccggcctcgcgggctggtcggaaggagtcaacgacagcggcaagcccccccccccctcccatggccggcctcctctccctccccccttctctttccaaggttgcacggcccattttccccccaccgccaatgccggctctccgcccgctgccaaccccgcagctccgacgccgctgccggcgcctcgtcgcccgcccgtgtccaccacccactgccggtcatccaccgtccacggccgtccctttaagatactggtacgaagtatttaaattgagtgtctagatttcaggcacgtgaaattttcgaaaaaaagagagttcattttttttgtatgccgtagttccagtggttattatcacttccctgttagtacttgtggcttattatcactccccagtttccaatataaaaaaactttataaaattacatgatataaacgtataactcaatacaatttacaatattacatgaaaaaagaactcaaacttacataaaaacatatatagcaataaaactgtagttaaaataaattaaaattgcacattgcatagccttatcaatgtgtaatatttggtgaatatataaattaaagcttacaaacttatagatgtcttaaaaaataaattttaaggtataaaattagctatattttggaatgaaagggagtactagcaattagcaaatcatttctatgcattgatttgagagtcatttgaccaatgttgttgctcacaattgacacgtgtgtaataactatctacacgcctgtcttataccgttatacgctgacgtcagcaatagtgtcaccaacccgcgcgcgccatggaaaccgccgcctcggcgtccacctcaacgccggagggggattccggccaacatgccgccgccgctccgccgcgcatgaccaccgtatccaagcactacttcggcggcgcctcatcggcccacaaccacgacctccgggtggacatcatcgaggtatgtcgcccccccccacacccccccccccccccccccagtgttatgggtgtctctccaagacgcctcgctgccgcgatcggtaaatctcgccgcgacgtgacgagcagtagcaccatggctgcgagtgaaggtggtagagatggcgacgccggggttaggggtgattcgtgcaggccaagtgctcggcgaaatgccgcacccggctgttgttgatcggctctcgacaagtcctgggaattttccttttcagaaaagaagtcggcttcggaaattgttgcttatgattctgcatttttgttttggattcaattgctactgccatctctgagtttctttgacacaactgctgttgcctcgtagaatatagaagaggattacgggatgtttgtctggccatgcagtgtcattctagcagagtacgtgtggcagcagaggtcacgcttcactgcctccacagttgtcgaggtactatacttgtcatctttaaattctactcttgagtgtcaatggccaatgatgatctacttgccattgtgatgatcaaccataaatcaggtcctagcgccagcctctgttatgaggtttggtacagccattatgacattctgttagtagtaattgtatccagttcagagcatattttgcactctaattttaatttgcatgtacgactttcagcttggtgccggaacctcactaccagggttagtagctgcaaaggttggagcagacgtcacactgacagacatcgcacataatacagaggttaagttcattcagaggggtgctgtgtttcattcatctaggctcatattaattattttcttcttatgttttatcaataggtcctgaacaacatcagacaagtatgcggtctcaataatgtcaactgcactgtaagtttttttatttagagggaaatgcatggtggtactttgcattctgctacatagcttaacaaatctgcattctacaacatagcttaataaatctgcattctactacatagcttaataaatctgcattatggtacatatagcttaataagtcgacaacactcatgcaggtattaggacttacctggggagaatgggatgaacctacatttgacttgcatcctgatgttattcttggagccgatgtgctttacgactcagcaagtaagctacacctacacgggctacacatctgtatttgtagttctgtataattttcatgttgactgacctgcacacaactgcatcaatttggctagagtttgatgatctcttcgcgacagtctcatttctcttggaaaattccccgggggcgatgttcataaccacatatcacaatcgcaggttccgggaattgttttacccttctcctcatggaagaattgcaggaattgttttacccttctccttgtgtgtcaactatttgattcctgtatgcagtggtcatcatttgattgaatttttaatggtgaagtggggtttgaagtgtttaaagcttcgggatggcttctccttccttccgtcatgcaaggctgcttcactacaagggaacattcagcttgttgagattgcacttgacaaggaaaaaccgaactgctcttcagctgacgagaacaatctgtagcagttatgttccatgcggttcagccttatgggggctgaaggcaagaacatggcacaactttggggcatcctccgcacacaggttaacttttataacactaggtgatttccaggagcaacatcatgtaaaattgcccgtacaaaatattctcaagtttaaccatggattgtatttgttggacaagcttgttaaacgaagattcaccaaaccaatagttatgacagaatattacacatctctacacgggatgttccaacagaacttaatcgaacatgttttccttagtatcaatgagatgataatcatcagacattgcatgtaggagcagcaatcagttgtaatacaaaatgctcctcattgtgaggttaacatgattccaactcacaaatttgatatgccacttgatatgataggaccgtcaagtattagtgtgtagctgatgaaacttctatcagactgtccagcaaagcacacacgagaacttcctcttcattagcaccagtacggataaatctggaatctggattgttttcaaattccgtaaacaggtaaataaatggcagtggaccatcgtgcaaggatctttcatcctgagggaatggtcgactcatgcctaggctgtgggatcattgtcgaaaattcctggatgtacataaaatacttaaaatgtgcatgcacgaattgaattatgcaagaaaacagtactaattgttaacactggaactgaaggaaacatgaaaaaaatgatggagcactagtccagaaacatgcaccgattaccttttggatgtcagcatgttcccctcaagttcttgtaatcatcgtagctaagaaatttatccttgatttttagccagtcagctggctttggcataaaaattgctatatatccttctctgtcagcctaataaaggtgggaaaagtatatgtgttggtcagagtatgaaaaaaaaataaaaacttgcgcaagcagatacagaatgacaggtcacgagtaaaaggtaatgcaatatatgacaaacacacagtgatccacagacttctatcacaggtacagagctaaatgatatctagtcaattcatttgtgagaagagggtcgacctaaacctcccacttcacccacaatctacgttcatgataaatgcaatagctgtattcatgatatatcagacagatgtgcaactttaccagtgtttatctggaatccaactagtttttttattctaatctagtctgtgatttcctatgtatgacttcatgtcacaattctattcacttgtgtatggcaccaacattgaaatttatgagtgaaataattcaaaaatctccttgctgagtatgggccttttttgcaacaagatggcagaataataaacactatctcatgtttgatattagaatgttactgatacagaaaactatagacaatatgtccatacatgtctgaccactgtttcaatgcatcagacaagtgacaacagtaaaaaatatatatttaacccaaactaaaaaaaaataaaaagaaaacaaggaaagaactgaaacacaggaggaaagaaaatcaaggcacttgttaggtcaaaacaggatactcacagaggtgttaagcaggtctggttgtttgatcaatctatcattgatctccaaaagtgatcctttcacacaacacctacatgagtttagcataaacaacaactcagtgcaaaaatagaatggcattatcaattattgattgggagatctagtggaccaacctcactacaaaagaattactacttgtgcagactttacacagcgctgaattttcttgcaaatgttgtgcattctgtaaagtaaaataagaaccgagtcatgcttccatagttccaataagtcaaccaatgataaaaacatgcttcaagagttcaagtcatccaattacccttttgcgttttcctgtgactttcatctcactgcggtctgacttcccaacattgaaatcaacggcagttatccccccttcctctttcaatgcaatatgggctgaagctaaaccaaccacacacaatctgatcttttgagaaacagaagaaaccagcgagaaaaaaaaagttcagcttcatcatagacgcggtaattaaaacgaaggatggagtggcacgtttcagctcaagctacatatgaaaataattaactaccacaaaattgaagcatgcctcaaaaagataaaccaatggtatgatgatattccttaagaatgcactagacatagttgcctattgcctacatataatctcattggggaaaacacaccacagtgaattatgacctgctttggatccaccttgtgaatatgaaaagttcatcaacaaacccattctaacatttttttttctaaggaagactaattttgatttcttgggagctcacccgtttggatggcggtacacatactgatcatgtcctggattgagaaagtctgcccaagaaaataacaagagttgaattagacgatttgaagcatagatgaacctatatttcaatcacactaccaaatgcagcagaattggattcagttcaacataaggttctttgaagactcggaaatgttcactgtgaccagaatatgtatgggcaatgtaagatgtggccttttgtttttaacttgtattggtcaaagaaaagtaaattcatagacaaaacgattcagtatctggtatttcaacagcaaattgggtaaagtaatccatggtccatactcgataaagcaatgcgtactgaaaaggctagagcattcagcccaagtgaagaaattggagctctacctacctaacgacctcaacaacttctcaaccttccctaaccttaataacggaatgccaagttcccctaacatcgaagctctctctatgctacgtacaaacatacccaaaaacccaaaaacccaaaaacttccaataaaaacttccaatcttttacatcaggtagggctctaggaagtaaaaagtaccagcgacgaagtagcgggcgaagttggcctccacggcggagggcgggaacggcggaaggtcgccggcatcggggacgacgagggcccgggtctcctcgtcgaccgcagactcccgttgcggggaccgttcaagcggcggcggcgcgtctagggttgcggattcttccgccattagggcgcgcgacgcgtggatctcctccgccgccggagagctcgtgccgcgcgtggccggtgtgggttttgctttgcggcggcggcggcgcgagcagaagagagatattcccgtttagatgtggaattaactttttgccactggacccacatgtcatagacacatgtggagccacgtgtcattgagatagaggtgacaaatagttatttgtcaaatctaaaagtggaaatagttaaaagccccgtgaagagaagggcaaagtgcgtgggagtgtgtgagccgttagatcattcgatccaacggcctacagcggtacagctcgggcgtttcggaatttgctcttttttttgcaaatccccacctcttttcctgctattccaatttgatcctcggcaataagggtacagttcatttttaaccctcgaacattgctcaaagtctgttttcaccattatttttaagaaaatgggataaactctctacgtccaattggatgtacatgtccataagaaccgattgttttttgtcctaaactttaaaaaacaaaaatagacacactgaaacttatttcaagttggttttcatctgtattagtttcatatttgtcaacctacatataagtgacagctacaccattaaaatatgcgtaataaaaggttcaagtcttcaactcaatacatatactcatatttatgcctatttatttttctttttagtggtagacggtgtgttcatcaatagagagacatctacgactataatgacttcgtcgatttctaaataagttagtccaatctctcagaaatgctcattagggtggggatgcatgtgtaccttcatataggcaaatatgcacacatacataagtatatatgtttcgaaaaaaaacagaaagaaaaaatatcctcatttcaaataataccctaatttgagagttgcttcaataatctttggggcagggtttataaaaccgcgcggttaccatgcacggtaaccttttcagtttttgaaaccacggtatgtctcgcggttaccatgtggttttcgcggtaaccacgcggttaccgcgggggtgcggtaaccacaccaaaaatggtaaggggaaccctgttttggggatgcccatagtaataggagacatgcgtggtttcataagggcatgctcaatggtagagacgaaaatggtctcttaaacaatgcaagattattaagagaccatgtctttacaatagttgagacgacaaagactctaatcattaactcaaaaaatattccttttgtcaatattcaatattctttctactttttttaccctcatgcaactttatttccatattacagtgattaagagtcattgttaagccattgtcataaataacagcgatgttttgtctcttctctttctctttcttccatgtcaataaatattcctaattagcaacgctgagagaccactgttgataaccattgtacatgccctaagagcgaatgtgtgcgtgttatataagcattttcgtctgtactatatttcgaacaaaaaaaattggcaagcaaaagtttttccaacaaaagtggaaaaacactcgatagaagtatccacaattctagctagccacatttcagtcatcaagtcattatgcatatatgccattaatcacaaatactagacaactacttatcaaatccattattactagtacgtagcattatgtttctttctcgaataattcgagtgtgtatacactagtagtgagacgtagatggtaaaatcaatcatcatcatcaatcaaacgcgaggtaatgcaggtgctgatggtatccgccgccgacttcgtcgtggtagtgctctccaccggccgccgccgccgccgccgcagcctgcccgccgtcgccgccgtcgaacttggcgtcgtcctcctcctgcggcgacggccacacgccggggtacgtctcccgcgtcacctccagcagcgagtccctcaccctgtccgcctgcaccgccacctcgctgtccctcacctgcaatgcagaaaccaaccagctcggagtagtcagctcgcgagctcgcgttcatggccatggcggcggcgagcggggcgtactaccatgacgcggaagacgttgaggacgagggtcttgtaggtggtgacgttgacgttgatgacctcgaggccgagcgcgttcatggcgtccatgaggcggacgaacccgccgggcttgtgctcccagagcacctggacgaacagctcgttcccctgcacctgacgcacctccagctgcggctccatccggtgcccaccgccgccgccgccgccgaccttgtcgtcggtcattgctgggtccttgttactcctcctgctgctgctgccggaaacggcgagcggcggctgctgttggtggctgttgggcggcgaggcgtcgtcgttgtcgagcccgacgaggctcgccggcggcgggtggtcgatgagcacgtcgggcggcttatggtggacatggttgtcttccagctcgtcctgcagctccttcacctgcttctgcaaccccacgatgtagtcgatcgcgtctccaagaatcgacgcgcgatccatctacgattcgttgcaaaatcaaacggaaatcgatttgaagaagcttttgatccgttcatggccatggcgatcgacgaggaggtaagataccttggtgatgtttgggacgagcgagcggagcttgtagaggtggccattgagcttcttcctccgcttcctctccgcctcgaggttcttgcactgctgcctcttggcgccgccggagcgcccctcgccgtcgccgtcgtcctccgggtcaccgccatgcagcttcctcccctccgacccggactccgccacgccgccgcccgccgcgtgctgcatctgctcctgcgccaccgccaccgacggctcgctcaccgccatccccgcgtacggccacgcgcccgccgccgccgcctcgtcgcccacggcgtcaccaccaccaccacccaagaacgggtcgtcgtcggcggcggcggcgtcgaacaggttcagcgacgagccgccgtacatcagcctctgcgcgtcggcgcctccgtcccactggaagctgggcgtctccggcggcggccacgcctgccccccaccgtcgtccccggcgccgccgccgccgcactgcgccatgacaagctccgccatctgctgctcctccgccatctgcaccaacaccgatcaacccacaaatctatataacccatccatgcaaaacgcaaaggccgttgcgtgcagctaaccgcaagctctccggcgttcgttggctcacgcggatggcgtgagccgccgccaccaccgccgccgccgcagccgcagccgcatcctctctaactactactcctctaaccaatcgaacgaccgaccactcacatatctcgacgcgaagagctcgacgaggccgccggcgacggggaccagcagccgcgtcttggcgccaccgccgccatcagcctcctcctcctcctgccacgcatccaagcaacacacctcatcagtgacagagattcatattcagattcagattcagattcagattcagctactgggttcagtgatgaatcttgcttacactgctgctctgccagatcggctggttcgacagcaatgcctgcgcatgcatccttgatggatagtgacagagattcagattcaccaagcatacaaatgttcagagttactagacaagaaaccatcaattttgcaggtaatcagaacacgtatcgattgattgattaatcattcaatttaccctatggaggaggagtccagtgggattgaagaaggcaggtccagcagtgctgagacctgtgcttcaagctcactgctgcagcagaatcctgtcatctccaagaacctgccattaattttgtgttaatggttgtatatcactacagagataataaatcacaccgtaattgctactttgcatgcatgatatgatatgatatgccaagtaatcaatcacatacctctgatcaggagagagcctccagtagatgcagtaatcccagccatctgaaccaactagaggcctcaatgcagcatccaaactggtgccacctccattgacagcagctgcagctgcagcagcattgctgttcttcatcagcaggtggtctcctcttcccatgtggtgatcacccttgccctagcagtgacacatgaaagcaagaagaatggatgcaagtgtcagttgcagcattcacaaggcctgctttttcttgctgtcaggacaggataagttgatgtcaccaaggatacagcgaaaattcagggtatgatcacagcaagggaacaatcagattcagtctgaatattcatcagactaaagagacagatttagtctgaaaattcagtctatgttgaatcaaattttcagtaacttaaagagacagagatcaaagctgcattcttctggctcatcaggattgtatgtgaaatcttttctagtgaatttttggaattaagcagagaaagaaagataccttctgtcttcctgagatcgcttcaaactaactgacgaactgtggcagtgatcaacagatggaagagagaggcatcagctgatagctattggtaactgaagaatcattttgtacagaaggactattgcatcatgcatatatatagttcacatgtgtgtgttcctctgaatttagccatggctatctgatgatgtattgataccaagtcttcggaaatggctgtcaaattatgtatgatactagttgaattttgaattctttacttaatcactccacctatattgctctgaaggtttgttgtgggtaggtgagttgcaagaaaggtgtgagagttttctaactccaatacaaatgttgttgtctaatacgcaagtaatcgcaattgcgatgagtcctctcaaactacgcaatgacagttttggttatactacctataatcatggagataaaatgttcacaagaacctcttttacatgagttctgagtgaaattcagaacttgtctgttaattcagtaaaaaaaaaaaaagttcaaatgaacagggtgagacagagccttgagctgatctggtccctctccattgacagcagacagcaaacgtaagaggttgttgaatcgaaaaaagcttagctgtgtgagatatttgctgatgcaatgttactctgtcgtccacgcttcagagttctgagttcaacaagtcacatgataaaaaggacaggcacaacagaaaggaaaagggatagctacaaaacccatatgctgaatttgaactgcagatttaaacatggaatatacaaacaattcgattatcaccattaaatgttcttattacgattctttggttgggtgatagctaaaatacatcatggcagcttgtggaatgctttccacttgccaggatcaggacatatggataattggataagtttgagaagtctcatctcttcagaaactgcatcccaatatagttatgtttgatgttcagaaatcagaatgctactctttaattaaattcgacaagaaactcattatgttcagaactagtcggcaagagaacacctgcagcaatcactgtcaattagactttcagaagacgagtaacggtcaagtattttgttctttctgcaatctgaacatctttggctgcaataaatcattgcagcatgtagtaaattaactgatggtagtacaaacaacacaaatctgaaatcactggtgacaaacgaactgtaggtgccattgatttcattttgcatcagcaagagcatgagagtttatgcccggtccttcgagaacatacacagcaaccaacaagtactactgtactagcaatatataatttggtcttgaatggcacatgattcttctagtgataagctcgaatatagtttttattgacagcaatgtggaaacactgtcgaaaaagttggccggtgttggatgcaaagatggattcttgtaaatgcaaaatctgacctcttttttcttgccattgaaatgtacatggagggatcaagttccatgaactagagccatcagaaaataaagtttggcactacttctcccacttggactttgcccttttggtcagaatccctactctcttttagcttcatgaggaattctcttgggagtcctaactttcaatttaggcacaataaacacagatatgcattgcaagtttgcaatcacttgtttaagctttaaggagaatatttggcaatgataagatatttattgttattttattgtattattattattattattattattattattattattattattattattattattattattattattattattattatcatgccctgttccttttttcttttcaatgtctcattcaagaatcatataccatttggaccatgctaatgatgtcggtatatatagcccagtgatcatcggtacccagaccatcgaaacaaaacattcttcagttgatcttgagattaagtcactcctccatcccatctcaagaactgatcaaggaaaggaaaaaaaatggcactgaggagaataatcaaggagctcaaggaccttcagagggatccgccgacttcctgcagcgccggtgatacgcaaatctttgcattacatcctgaaaatcttcagatagaaatgttcagaaacaaaatcaagaagatctattgcattaaattttctcattgttgttgatgaattggtgaaaattcaatcagggcctgtgtctgatgacatgttccactggcaagcaacaatcatggggcccaatgacagcccctactctggaggagtgttcctggtgaccatccacttccctcctgactaccctttcaagcctccaaaggtatgtgctaactaagcaaacatcacttgtctatcataattcaatcaagattcaagaagttgatgaaacccaatcatgaaatgaaaaatgaagcgtctgattgactcattgattgggatcttgggagcaggtggcattcaagaccaaggtgttccatccaaacataaacagcaatggcaacatctgccttgacatcctcaaggaccagtggagcccagctctcaccatctccaaggtaattaacaacacaagaacaacatcatcatcagcagcagcattgtgaattggtaatgaactgatgatgattaatagtggatggtaactcactcataattggtgcaggttcttctgtcgatctgctcgctgctgacggacccgaacccggacgatccgctggtgccggagatcgctcatatgtgcaagactgatcgcctcagatacgaatccaccgcaagaggctggacgcagaagtacgccatgggctaagcttagctgcaagctagctaattgcagctgaaatggcaattggatttggatttggatgcaggggacaatcagtcaatcaccagcatgtcgattagaattcagaaatatagatcgtgccataaaaaaagatagtaataattcttgcttgcaattattaggattgttgttgcaaatctgaatcatcgttatcatctaacctataatcaaaaaccatcgtcttcttggtgaggaggaataataaaagtctgcgattttgacggaattattgttcgtcagaagtgaaattggaattattgttctttaaaagtgaaaatttttcactgacacaaccgacgctttggccgagtggttaaggcgtgtgcctgctaagtacatggggtttccccgcgagagttcgaatctctcaggcgtcgattaacttttttattttttttccaaccaactcgtaatatttttttatatatattttcactttctttcagaatccctacggttacttcgagacgatttttttggggggggattttgcgttacccttgtgtgaatcgaacgctaccacagcccaattgcgaacagtccagctgctggattgaaaaataaataaatataatacaacagctctcgatattataatccatgtgtttgtaactttgtgcttaaattttgcagcgacatcgagagctaaatttaatcttagaaaaacaaaaggaaggcctcaatcgggtcttttgaaatcaggggacaattgccaattaaccagttgagatatatatatcttggttccaggcacttccagctgagttttatttaacctggtgatcttctgagatgataggttttgactgattgttggtgacaaccacccaccaaattgcatccagtttaacaattttcaaacatgtacgcatgtatgatattgattctgctaggctgttgcatagatggcctttaaaaatgtaactggcaaagatacagaattccagcagattccacatattataatttacaaacaggcctctacttcaaagttcaaacatgctctccacaatctccagaaaaatcattatgttactagagctagatgttgactccaggtaaccattggaagttgagtaggccacttgtatgcaacaattggacaagtcagaagaacatcacagatcttgctccatttgcagaacagaatatgaaggggaaacataattttccattgaagtgaaataagaaggaaaagaataaactgagtgcgattacatcatgtctacttatgaaacagggataacaagaattttttttctcaaacacaggaaataccatctaggaaagttacctaattgccacgacttgtcagtcacacgagataatcacaaggcagaaaggagaaaatgaaacaaacggatcgctcattgcctcgacaaagaggccttgctgcagctgccagtaaactaggatccccggaccatgaatgctgtttcgctgaagcaagacgcaacaataataaagcctggcaacttcatcgttcttcttcttcgtcgtctactgatgattagatcacaaaatggagcacgcccccctttgcgcctttttcttcttcttcgccttgggtggctgcagcaccacctttattgccgcatcgaaaacgcccttgacgttctgcagatcaggggggggcaggatatctctgttagtatcttatatgttattgcacatttagcaaagaaatgggaagaaagcagtactagttgggtctttgagctgcattcgatgtagtatggggcgcctatttgctttcttagttcctctccctacaaaagtggcaattaaggaacaaaaaaatgatcaagatatggcaatgtagtccacaggagttgcaagtacatctctgatgctacagtaaataaggaattaaacaacccacaatgccacaactgtacctgagcagtggtgataggaacagcaccaggatggtccacaaaaaactgcttgtcatctcgaagatctgccagtgcaataaacaatgtgaaaaatgtaagtgggctacagttggatctttacaggtcgaaggggatattatctgtagaatgattggaatttaatttcataagacaggtagaaacaccagccaaaaaaaaaaagacaacaaaactgaatccatcatgacaatagcaaactgagggacaacgtgcaatgccacaaatctgtgagacagagtataactgttgcatgttgttgaaccaaagttgaatagtacaaaagtagaaccaaaagagcaaacagttcaaataggtttatcacaagaatttcttgcaagtactaaaaactatggctgattgatatactggtactatatatccatatttttcctcttttatagagcaccctgcttcatgtattatcactaaatgacgtcaccagtaccaagcattgacatcaaaagaacacacaccaaataaaatcgtatcaacctaaaaatcccatgccactacttccatccaaaatcaaaaccgaacttgtgacaggtacaaaagattagatttctcaaaatagagccttgcacggttcttaccaagctttgttcccacaaggatgataggcacaccaggtgcataatgcttcagctcaggtatccactgaaatataacaaagtttagaatcaacaagaagtaccataagtggagactaaaaaagtgaatcgagccacaaaaatgatcaaatcaagtatcaacataagacaatgacctatgaacataaatttatgagattattatcatcatctatcatctctaatgggtggaataatccattgaaggatgcatctaggcctgctctaaattttgtggagcctaattcccagcatggtaatagttttatcatcgaagaaggcaaaaacacaagaaaaatgccagaagcaacatatcattgcacagacgatctcaaattaaacatgaccaacaaacttctttagcgaaagaagaaaaaaagagcacatcaatattattaacagaaaatgaaagtgagtcccttgccttctttgaaacattctcatagctggccttgctgattagcgagaaggccagaaggaaaacatcagctccacgataactcagtggtctcagtctgttgtaatcctcctgacctgtggtattccgaaggaaaaacttaataacttggtagaagaaaacaagcatgcagaattagatagcagcgcaaccagattacctgcagtgtcccatagcccgaggttgacggtgttaccatcaaccacgacgttggcactgaagttgtcaaacaccgtcggaacataatcctgtcaaaagcaatgacgcgaacaatgagtgcacatatcgtctcaaggcacaaccgattcataagatacaaaatgaggtgaatcctactgttacagaactgataagatatctatggtaaatgtgcagtccattctcaaactcttgcctaaagataagattacaaaactgatatatactccactagattactattttaccaggcctattatacatggcaagaagtccacaggtggtccaatggatacactacccccactacatggtcaccatgtctcagggctctaataagctaatctaccccccaaagcagctgaaatgttctcttcttttgaagatctctcctcaaaagagggaaattaatgtgcaattgggaaattaaccatgcgcgaaaagcaagggtggtggtgtgtaattgattgggtgtggatttgcgtgaaaggaacaaagaatgcgcttaccaaccatggggaaggtgtgagatgtgagtggaggagggtacaggacaactagaaagtcgggaaagcgatatcgagctctcgacctggcggatccgcggtttcccacctttgatagagaaacgccagccaaactgattcgacgttatatgaatcgtggggggaaaaaacctgcatttttttccgccgctaatgctgctacaatccataaatgctgcaagcaatcaaggacgaattttttgtttttctactgcattttttttgtttgagcgttcacgaggaacgaatgaggcagcatttggcttcgatttgagccacggtttttgatttggtacggggtgccgtgcaaaagatcccctttttactcaaactcgaatggcaaccctaggcaggaattcgaagccgcattgtcccaaattcacgagcggcggacgaatcagaaaagccccacaatttgggcccaaatccagatcaagaaccataatcctagctccaagcctccgagcacacaagtattttttttcaaaaataattaaaaaaagaagaagcaaaagaaagaagaagaagaagaaaaggaaatgtttggaggaagaagaagaagaagaagaagaagaatacgcacagtggggaaggtgttggaggtgtaggagatgagcatgcaggtcttgccgacggcgccgtccccgacggtgacgcactttatgaacctggacgcgctcatcctcgccgctccccgtcggtcgcagcagacgccgccgtcctcctcctcctgcgaccgctcccccctctctctctctctctctctctctctctctctctctctctctcaagaaactccaagaaagaagaaggttgaaggaggagcaaagcaaggggtcgacgcgagaggaaggggggaggttgggttaagattgggaggtggaggaggcgaggcggagagggtttctcgcagatcggcgggtgaagcggtctcctctccgcgccgaaatggtgggtggccaagcgcaagcgaagcaatagcaatgccccccaatgcaaatgcaatgccgagacccgagacaaggaaggagagagctcgctcgagacggaggaggagaagaggaggagtagagagagaggtggtgggtgaggtgggtggaggaggtggccacgttgtgcgcgcgcatcatttccttctttattaccgctcctccccgattatcacgcacgcatatgcccattaattatttctctttctcgccccccccccccccctatcattttgtagtatattagttgttctatagttagggcgaaaattcaatcttctttagtagtaattctaaactcatgtaatatgataatgaataaattatttgggttcaaaatatcgatcaattgttgtttacattgtagcaaccaaccaacgccgatcaaatgttagcgcggctgactgggtggctactataacacggtaagccataccgatcagggtcatcattaattcgagaaagaaattatatcctttcaattaattaaaaagtcatgcacgataatataagtatcttgaaataaatgattttggttcaaaatatcaaccattatggatgtaaattgttgccactacagctacaaaccaatatagattaatactgcaccagtggctaccgagcacatatgtagccaacaatattcattaggactgaatatagcttttatatttttctcgtttattcaaagctttgtttgggacattgtaaaattttacaggattttcatatgagtcaatttttttcattaatatcctttgtttcagtttcccatggagaccatattacttgctaatgtgacagtactactacggagtatataccaattgcaattggtagttgtgtagttaattccagctcacctgtgtacaaactgtcaaatggtaccagtgtactgtagcttttacagatgttatataccggtggttgatgacttgatgccattgtcctaacctggtgtactcgttacattgtcctaaccctgtctgtcaggccgagaaacatatatatgtgcacatatatgtagtactatcatactccctccgtaaaaaaaaaaaaaaaaaaaaagaccaaaccctggatttctgtatccaatgtttgaccgtccgttttatttgtttcaaatataaaaaatattaaaaagaaaagtcacgcataaagtattaattatgtttcatcgtctaacaacaatgaaaatactaattataaaaaaatttcatataaaacagacagtcacacattagacatgaaaacctagggtttgtcttttttttttttggacgaagggagtatgtcaaactcaagcttccaaaaccatgggaatgggtgatcataaataaataaatgtcaatttcatactattgtaatttttatcatgtgttacaatcatcatattataataaaaatagttgtattataaaaggacgatttgttatccctatcgggttgctatttggattttaaaactggtccatacaccgaccttttacgtcaagaaaagtttttaagaaggcattcacaaccgccctgaccttatttatgtcatttctttcttctttttgatgattggatttattatttttatcattttacgctttacctactttgttcttttatattttgtgcctaccatctgcccaaactgcaccatccattattgccttatttgtgtctttttcttctcggcgtttttgccaactcagtaatcaactgctcagcagtcattcattgtttttttggcacaaatttattcagtatatatacagaagaagatgctgtaagttcaactaacaaaagttgctgaaaaacctttagaggaaaagtgaaattgttagttggaagataatacttctacatcaagtgaagtgaagttgatgcatctcatatgttgggcaagaaatatgatttctatttcagctctctttggtcatattataagttctaagattgatacatcgaagaaaaatatcaaactgtcctgcattgaaatgcaagtattatatgatttgtgatagaattggacaaattgacatgacaaacttttcttataaaagaaatgttacacgaccaaattccatccagctatgagtagtcaccagttggcaagaaccaaaacaaaaccatgagtgcagtgtaccatacataaaatagtattgacagctaataaaatccaggatccaactggctggattagattggggcagttgtttgtttctttccctctactgtgcagtcacaatgaccagaaggcagaagcatccaccactcattgtacccaatcaaattatggaaacaaatatactgctaactgatcagatggatggatggttcatccaagcttactggcatcccaattttgcctcattaccaaatacaacgaaaaggttattgttgctggtatcaagccaggaaaaacataccatggtcaaaatttatttttatgactattgttgtggttacctggtccagcaaaaggcacacgaaaaggttgagcaaaacccttatctggtaggctacagcaaaggttaagtacacatccattttttttaatggatattcatccgttttttaccatagggttgcacagttatttgaatttgtgtatccttttagctgactcaagtgtgttcgacaaaagcatcgcaattgtcattggcccgacaccaccaggaactggcgtgattagtcctgcaatcttggaggcctcctcgtagcacacatctccaaccagccgataacctcgagggctttctggatcctgagacatttcaaatcactagtaagcatagcatgcaaggaaatcaggaagggggtgtagggaaagaagcagccaagtcaccaatttctttggaaccttctgaggtattaactgagttaggatacaaaaacatacaacaaaacttaaagatatgcacaagccaacatttaagtgaaggcttgtactaaattgattaatcatcacatattgcccaaacacatatacaatgtgaagaaatttaccagcaaagatatgggatcatcaaaatttaataaggcaatttaagtttttataaatgggtgtccaacagtgggatcacaggagggtctactggtgtagttccttacctgccttcgatcccagctgcgaggatctagacaataatgttccctttgttcttgaaaaaaaaaactatattccttctaagaatgtgacattttgcatatatgaaccaaacatgattagaaacatgaagtgcaaaagcattatatattattttattaacaacacaaatacaccattagccatctggatcccaccaatgtggtgatattccagggaaccagtaacattggaaatcttattagcaggttcaaactacctccgtcccaaaatataagggactttggctatgacatgcccagttttcatgcataaaacttatccatctagaaatgggttggcattaaaagcaaacagatctgttgaatgttagggaggaagaattaaggaagccaatcagaaaagtaggtgtcttacatcaactggattgatgccaacatcaataatagcagcaccaggctttatccaactccctctgaccagattagcaactccaacagctgcgataacaatatctgcttgtcttgttatttcctcaggcttcttggtatttgaatgtacaatgctaacagttgcgttggctttctagtaatcacatatggcataaaaacatgttaattaaacactccaataaaatttctccaactaattgaagtgagaattaattcatacttgcagtaataatgcagcaggcatccccacaatattgctccgcccaattacaacagctctcttccctttgatttcaactccatatctgtgtagtaattccatgcatcctttaggggtgcatggaacaaagaacggatcccgaccttgcattgcaagtcgtccaatgttcagtggatgaaatccatcaacatccttctcaatactaacagcattcaaaatgttctcatcattcatatgctgcaaaccatcagagagcagaaatacagatgctcagtggatggaagacatggaaaacttgtgtgatgctagcaggcaaatacctcttttaatgctaacaggtaaaatcattcaaagtatcttgatcaaaaaattattcaaaaatatccccatcattaatatgctacaaacaatgcaacaagattaacagagaactgcaagcaccagtatagaccatctaattaaaaacaaatgctgacaacaaactcgaaagaccacaaagggaatgcgacggactacctaaaacaaaggatctgtttgcacacatttttctaagaccagatatctttcacaagagcagcatcaaaccagttaacataaatagaaacatttagtgtacaaattggagatggcaccaatatcacaatatttccagaaaatattgtgcataaagtaatgtttccatggtgtgccatactgccatacatatctaggaatgtacctcactaaaaatacatttaactaccagttcagttggtaagggccaaaattcaatatcagtggataggttatacagagacattggcccaaagaaaattgttgaaaacttacatgaggtaggggcaactgaaccaagatgccatgcaccgacggatcactgttaaatgttgcgatgtgcttgagaacctcatcctcagagctgtcttccggcaaattaacctcatatgacttgataccaaccgcttcgcatgccttcttcttgttgcgcacatacgtttgagaatccttccttgacccaactaggatgactgccagcccaggcacaaccccaattgcatccttcatcttggcgatctcaacagcgatttcctctcttatctgctttgccaccaacttcccatcaatgatcttggcacaagcatctgatgaacacagttgtaacacatgcaaaacgattaaaaaaaagaattgtcatatcagtgcatcagaaaatacaaggatctcttcatatactccatttgcaactacacttgctcaacaacgaaatcaaaaacatagtactatctaataatacaggtgcaactaatagcaaatgggtttcacctgaagagctcttccagccacacacaactcgacacggatgaatagaacattcacagtcaggcaagcgaggagaagtgggcgcgcgcacctgagtcggtagaggaggcggcggcggcggcggcggctgaggccgaagccgtgccgcgcgcgcgggggagaagcgggagctggggggcggcgatggcgaggggcctccgcggcggcgcggcgacggtggccgggcggaagcggcacggcggcgcgaggagggcgcggcggagggggaggaggcgggaggtggcggaggaggagcagtcggagagtatggaggacgccatggctagggtttagtgccctggagcggcggcggcgggaggtttttcgcgggcgcacgggaagggaaaagaaggggggaaaaagaagagcggaaaaaaaatggcgtgtaaatgcagcagccgctaaaccccacgtaacaacaagggtttagggctaatccattaataataaaagattttttagggtctaatcaataattaaaaagggattatttattgatttactactccctcaaaataagtgcaacttttggggtaatatttattgtaactactatgtaactgcactgtaactacattatcatctccgtataatttagatataatgttacatatattattttattacttatataggagttacattatagttatagtaaaattatattgcaattatactataagttagatttgaaagttttctttttaaaaaactttcgacaattctctagatagtccctttagctaaattttaggcccatttggaatagtggaaggctggaagatatgtgcaacttttaggctgtgttcgcttccctcgttttctgcgcgcatgcttttcaaactgcttctctagttttctagctaaaacttaattaatcatgcgctaaacgctgcttcgttttgtgtaccagagagtgactcccgagcacagccaaagagggtgcgtgctccagttgtttcctcggtttcaaaatcaaaatgttgttttgaacaaattttggaggacaagtggatatctaacactccttgtaacgatgccattaaacgagtacatgatcttgcaaagatagtcacaaagatgtagagaattcaggctatgttctactgttctcagaaatatttggattcagcaactgaaaaagacaagcagcatcacctcgtaacctttgccatccaatccaattcaaatcgacaattacagaacagctaagcaaaattccgctttattaactacagaaaaccgaaactatagtttcctcacaactgtagaaatgggtagtaaaatggaacatatcctatgctttatagtggagtattacagaaaacaaaaactctccctgattgatctgaatcttgcagcctatcgagaagcaggaacggcagtttcagctggggactcttgctcctgtaccagtgactcccactccacctccttcaggattctgaacctctcgtcgagatttacgaaaccggattgctgagtgaccgctccacaggtgccggctttgtgtatgaggactacggtgccgcccatgtcaggcccatgaagcttgccagtcagcagtacacggagcggcataaagagtgactttccctggtcacaaatggatacagccagaagaggtaagttataattgttccattcaggatatatggcacaaaaggcatttgcaacaatgggcttgaatgtgattttaaggtgaatatgatggttagtatatacaagtcaaaacaaaggaagcttactagggttgggttgtcaaagtctagatcaaatgattcggttgtattttcatcatttctagatatcaaggtttaggtgagacagattgcttccataaaaagttgtgtttgagcggcacctaagaacaaaagaacaaaatgattgctgtcattactcattagcactgacctttcttttaagtgatttgccaaaaattttcacccacttctgccaaccatcacggccctcagctagtgcttgacaaagttcaccgctatcataagcagaaatgagtcctgatgcaacctcagaaagcttgtcttgcaccacagatttagcttcatcactggtaatttacatgtgaacagaaaaacgaactgtttactccaacagtactaccacaacaaccaattcactgaagaaactttccttttttggcgacaatttatgaagggactttcagtgaaagattaatgaagggttcccgagggattaaatttaaaacatcacatttctgcagacctgcttaatgtagcatggaggggatacgacaacaggtttgaaagggctgcgtcagcatcagtgatcaaatcgatgccatccttcaaaagctcagccgcttcctgtgcaaaaaataaagtaattatgttattagtgctccccaatcagttaccgtccatttagcatatatacctaattctttttagtgtgtagttccaaagtacaaacacccatggtgtgtagaaataacaaaaggcctccaatcttactttagcaaaaccactttcagactcctggagaatgcctgtgtccttccatctatcctcaaaactcttgatgagtacatcagggggaaatgatcttagatgttgtccattcatccatctacaaatataaaaagtaatgcattatgtaaataggattgtttgtttattttccatgatcaccagttcaagtgagtagttgtgtgcacatgcacttcttaaaggcaacggtggattagataggccaacaaaatatcagtaggtttgagcttgatggtggtttctgagggtaggtcccagtaaacaagctttatcatgatggaatgcgcctttcaaacactactgaccagcaggcagcaaagtacataaatacgtatttattactgattagacacactgcatttattgcttatcagacttatgtttctctttgatccataatgtggagtgattttgcgaactccatacagtatatcaaatccattgatacactgtacatttaactttgttggtcatatggagttatggactggacatgcttcccagcttgtgtctgagttcataaataaaagaacctatgaattactagctacttcctccatcccaaaaaaaacaaatccattgatacactgtacatttaactttgttggtcatatagagttatggacacattctagtacaacgaatctggacagatatatgtccggatttgtagtactagcatgtgtcatatccagtactagattggtttttaagattcaccttctaaaatataccaacaattagtataatatgaattaaaattttattagtgaatattatcattggattgacatttgaatttaatttcatatggttataattttgttgctacaaaccttatagtatatcagaaattataagcaaaagattatttttggagatcgtgacgtgtttgacgtgcgatagagggagtagtgacaatgacttttcactggttcccttataattgaaataatgcctgatatcagactaaagaaacataacaataagtggaagcaagctccagttcaactaattatagtactgcaactgagatatcacgagtaattagagaatactgacaaattctatgaagataactcaaccagaaggagattggcaaaaaaaaatgatcttactttaattttacagcatcaaagactgctccacttttgttgacacgatttatagtgaatttttccactggaaatgagatataacagcaaagaatgggtaaatggatggtgactgtaattttcaaaaactgtgcagggaaagtaactgaacgaattattcataaactaacctaggtcatcaatggtgaagaactcattttcagtaccatcaccccaaccaagaagtgccaaataatttaccattgcctgaggcaaatagcccatctctttgtactggccaaagaaaagaggacacattgttacatttttctaacattgaaagtgtttcagaaaagatgtgaaatggcgagtaattagctgcaatactatattttgccaaaatctagttggttacctgtcccacagaagtagccccatgacgtttagacagtttacttctatcaggagctagaataagtgatacatgagcaaacgaaggcattggaaatccaagtgcctgcagaagacagtcataggacagtaggcatattatgttgagacatacagttcgaagggtcaaggttgtaaacaatgatacacaagataagaatggcatagaaaattactttataaataagagcctgccgtaatgtgtttggcagatgttcttcagctctgggggagaaacaagaggattgcaaacttcaggaagaaatcatcaaaaggaaagataacaaaataattagtttacattacctgataacatgagagatgcgcatggtagcatcatcaactgtgacacagaagttatacactggctggccattgcttctcataatcacgaaatcaccaagcgtgtctaagttccaactgacctttataaaactatccgatgcttagtgtgtgtgtatcacttctcataatttgcaagcatgaattattgacagtggaaggctaaaaaaaatgcaacgatgtggcagtgctagagtttctagttattacctcaccacgaataaggtcattaattttcaacgacccttccttcggtacacggaaacggtaagtgtaaggtgtccccttctctaactcctgttgtatttctgcatctgaagcagtcccccacttgcccatgtatacaggtggaagttgcatctgctttgcagtttctttcatctgttcaagttcctgaagtaacagaaacagctatcaaatgggcaaatagttgatccagtagaattccagaagtaacctagacaaattgctgacggggtttaaactaactcatcccttagtattcatagttgaataaatcactacgagtgtttcatatgaacacacagaaagatcaagcttttttttttgaaaagcaccaaaataatactccaacattacaacaacctgtgtataagcgcaacacaatgcatcacacatacatgcagatcatgcaaggggagaaatatacctcactggagcaaaagcactgatagactgcaccagactccatcagcttctcggcatactgtttgtacatcgaattgcgctcggactggcgatacggcccaaattccccaccaacatcgggacctaagcaagtacaaatatgagcattcatatcatctaccatcatagaggaaaaagaataactatttcactggtttatccatgcttaataaaaccaaatacacatctccacagttgcacaatatcaataaagataagcaatcagattgtatcaatcagataatcataagaattgagcttgccagaactctcgagtagagtagaattcagcatccaaggcctaactacggtggacagcaatagagcactacatcaaaatgatactccctccgtttcaaaatgtttgacaccgttgactttttagcacatgtttgaccgttcgtcttattaaaaaaattatgaaatatgtaaaactatatgtgtacatgaaagtatatttaagagaaaagtgcataggcggtccttaaacttataaggttgtgtcatctaggtccccaaactctcaaaatgcacatctaggttccagaacttgtcaaagtgtatcatttaggtcccaaatcgacatagcccctatagaatcctatgtggcgctgatatggcatgccatatggacgtgatatgtccttttcttcctttttcccttcttttttcttcgttttcttctcattcttctttttttttcctttcttctactcgggaaaagaaaaaaaaggagaagaaagaaaaaaaagaggaggaggaaaagataagaaaagaagaaaaagataaatgggtttcatttgttagtcaaaatgatgccacgtcttgtccgtgtggcatgccacatcagtgccacgtaggatcctataggggctggggcgatttgggacctaaataacacactatgacaagttctcggacttggatatgtattttgagagtttagagacctagatgacatacccctgcaagtttaaggaccgcccgtgcactttactctatatttaacaatgaatcaaatgatatgaaaagaataaataattacttaaattttttgaataagacgaatgatgaaacacgtaaaaaaaagtcaacggtgtcaaacattttgaaacggagggagtacaacttaacttcctaggcagtaaaacattagagcgatatagagaaatcaggtgggtcaactcaccttcgtcccagtcaaggccgagccaggcgaggtcactgagcacggcctcctcggacttcttggtggacctctcgaggtcggtgtcctcgatgcggagcacgaacttgccccccttggaccgcgcgaagaggtagttgaagagcgcggtgcgggcgccgccgacgtggaggttgcccgtcggcgacggcgcgaagcggacccgcaccgggccgccggcgccgtccggtgacgccgaggcggaggcggaggcgcggacggagagggtccggcggaggtggggccgcaggaggcgcggcggcacctccgggagcagcctgatgcgcagccatggcgaccccattgccgccgccatcatctccggagattgggagtttgttgcgagaagaaaaggaagaagaagaagaagaagatgacgatgcggatagagtttggggatatttgggggcccaacaaagcccacgcgcttacaaactgcagtagcccaacaaccacgaaggaagagagactgacaggtgggacccacaaagcagtgtcttgtgaggcattttatccctcagagcgttttaatccagcaaaatgcggagttggaaagttgcttgcaaagtagagataagagaaattaatctctttgatcttgtgaaaagaaaagaaaagaatatactcaggtggcgtttggatacatcggatgtttggatattaatttaaagtattaaacataaactacttataacactaattatataaatggtgctaattcgcaggacaaattttttaattctaataatccataattagcacatgtttattatagcatcacatagactaatcatagattaattaggctcaatagattcgtctcgcggattagttcagggttatggaataggttttgtcaatagtctacatttaatacttctaattagtgtctaaatattttagtcccatctaaacagccccccaatccattaaaaaaagaataaaccttttatcgttcgtcttattaaaaaatattttatgattagcaggtttgttgttattagatgataaaacatgaatactattttatatatgactgtttaaaaaatcataaacatatgtcaaacgttaaacatagaaactgacgtatgcactttctttaaataggacggaggtagaaggaaaaaataggttaagagcatcaccaacagtctacctatatgatttccaaaactaattttaagagattttagtccaaaaatcagcttcaacagatcccctactctcctaccaagttttggagtttccttctcccggttcctcgctccgtttatatgcgggtgcgaaagtcgctcccaatcacacaatcctgcctctctccttcgttcccgtaaaaaaacagaattttctcttggtagtttaacagaagggtccacttttaagttttggggattaaatttaggctatccattggagggaggagttttttcactttctatttttaatttagaaaaaaaataaatttttagaagaaaattatagataatctgttggtgatgctataagaggatgaaatggtgaggacatggctccaccagcccaccggccaaaacaacgagggcaaggaaatgcataattgcacatgatggatggatggatggatggatgagacgatgcatgggcggccgacgacgaccctgcccagtcttttgttgtgttgtgtgcgttgtttgatccttcgtctgcaccctgccctgcccttgctctgctccgtctcgtctcgtctcgtctttggtattggcctttgtagcatcactgtagtaaattatggattaatatatctcgttagattaatctcgcaaaatagactaaaagttataaaataagttttgtcagtaatctatgtttaatactcttgaataataaaattttggagcactttaatcctagcgtgaagcatccaaacagggccattgttgctgctgccttttcttcccccagccaggtcaggcctgcacccccccccccccccctctttcgtacctaacgacaaacaactcctctatgctcctcccgcctccacgtgtaaaacccgctcaatctacactagtatattcataatactatcacattcgttaaaatcttttatatcatggggaagatgaagcactgaagtgagtagattttgacaaaagatagataaagatgaagatgaaatcagaacacgcaaggtagatgaaaaagtcatcggtatatttttttaaaggaaaagtcatcggtatatgattaattaagtttaattattatacaaactttatatatatatataatagacacatcgtttaacagattaaaaaacacgtgctaacagaaattgagataaaatttgaatcttaaccagaagagaatgaagaacggaccacaggcacaatagtatttagattctaagttatctaattttgagtcgatgatacgtgaatcatttttttttgagaaccttattgattctaaaatccacattgaaaacaagtcaagtctatagctagtgggtttaatttctacatagatgctacaactatgacaaagtttagcttaattagcactcaactagcacaggaatacatatacatatataggagtatccacggtcgtactagcccacagcaaatagtaaattctccccacagcaataggcaggggaatcatacataggagtataaaggtaaaccaccagttgagctgcgatcaggattacagtatatgagcgagaatataatctgttggctccttcggcgagaatcattcaattcacaaggataatgatgatgacattcagcatccatatcgatctcgctgttcaaaaaaagctccacaacgatacgattcgccacaaaaattatgcttacgcgcaacacaaaaagacaagctaccccctctataggtgcgccatccctccatcccgaatcattgccttctttcgtccacaacgcggaaaatattacagaatttacaacgcggagaatttaatcttgccgaatctaatctaactgtaaaattactaacagctctattttttcgcttatacttatcagctaaaatttaattttcgaaccttaaatttggagttgattttatggttttttcatcgaagtttatttttcagccttttcttttagatcgttaagaacacgtatataaaagttttatttgtaaattatttttcgtttgcaaatttgttcagcctaagttttagagctcatttggggcgtaggattcttttacgacgcggagaattttctacatcctccggaatctgaaactagtccctgtaaagtttctgtgttttatgacttgtttgacatacagtactctcaaaatgaagcaaaaaagggataagaatatatcatcagagtatgcaataatataggatttaaaaacaaatgaatgctgaggtaaatatgtttggatggttacgcaaaatagtactccctccgtcccattataagtgcagtgataagtttctgtgtccaacgtttgaccgtccgttttatttgaaaaatttatgaaagatttttaaagttaagtcgcgcataaaatactattcatattttatcatctaaaaataataaaaatactaatcataaaaatatttcaaataatacggatggtcaatgttggacactgaaactcacaactacgcttattatggtacggagggagtacatatgattcttgtaggaaaatatttgcaactttctagtaacatatatgcagaagacaatagagacggaaaggtaggccacattttatctgttttcctttttattttccagatttttgtcctaggttatttggtaaacgcttctagaaaaacttatcaaaaataatttctcatattgcattgttaatttctcctaggacaaagtttctttcataaaaacattgatttaacacgctaatcaagcaatctgcctcaacaatccacataaaaatctgttcaaaaaggaccttggtgtgcattggacttgtcaaaggacaataatagaatactaagaggtaatgagctcatgttaaaattccaacgaaatgaaggtatgtcagaataattttgccattatatttcttgttccaaacaatcctggcccaatttgatggatcttatatgaacatttaaaacacgagaatttaaaaaatgaaaaacacataagtagaatggcatgtcagtgcaatcctatggaatatcaaaatataagaattactccctttgtattgttttgataccacataagaaaatactcctattacagaaatttggagagagaggatgacttttggtgaagtttctcaatgctctaccttttgataaacatttattgtgagcagcaaaccgttttagatgtggttaccgtcatcctatagtcaaaatcacttatattttgagacagagggagtattacagaaatttggcgaaagaggatggctttttggtaaagtttctcaatgctctaccttttaataaaaagttattgtgagtagggtttaccaaactgttttagatagggttaccgtcatcctatgatttggcagtcaccataaaaatcacgcagttattgtgatatatactccactagagagagttaccgcaagtaataatcacgaaatccttacggtttggtaaaccttgattgtaagtcaacgtagtcaagcgaaaccctgggtgcaagatagagagatggacgtggcaatggcaggactgctcctgtgaggatggatgtggcaccagggacagtgagtgcagatgctgatgatcagaagagagagtgtccatgtggagggctggccggccttggagcaaaggaaaggatgagacgacggcaacaaaagcaggagagagggagtgtctctgacagagtgacagataggaaagggtcccatggctgctgctgccttcaggtatccgcacatgtctctctgacacgcaccaccaccccccacacagccaccccaaagattattttagaaaaaataaaaaattaaaaaaaaacttctctttctcctccagtactactcgtgctactactggtagaggagtaaaataaacgtacactcgtctactgctgcatctgctgcctgtcttcgcttttggatcccatcaactgaactgttgggcatatgaacacatgccttcttgcctgcctactgtccactccaccccctactgctgtcaaaacaaaaacaataatctggagtaattgctgattagcacatcaaactatgcagctttcaagtttcaactcccatgctttcttcttttgatcagaaaactgagtggatgttttggatggagtctaactttgtcataactcgatttgccataactgtggcaagccacacaaagtgtgaccaataatttgttggccacaactatgacaaactttagctagcaaatgagagtatgacgcgtgggccaatgtgctaataaaatatggattgactcaactgcggcacgcaaccaaacactagcctgaaaaattgtgacacgcctaaggtttggtgtggtaaaccgagaccaccaaccaaacagcccctgaggctttacccacaaggttattattgttgttaattcaggatttaaatattaacggataccttttgtctggctaccaggccaagtggactacctgcggaactactgaatcaaaaaaattaaaatcactccgagcttctgccacggcttaaataatgaataattttggatcataaatgtcaccttctgccacggcttaaataatgaaacattttggatcctaaatgtcaccatgttagaccatgtgtggcaaatcaacaattccagcagtaaacaattttggcccaaaccatcaaaatgacactagtagtacaatcaatctttttggttaactaaaacaggcatggataggagtaccagacaagtcctgcaataaatccagccgctgcccacccacaacattagaacaaccgcaatagtaaagtaagttgctctctataacacatctacatctcagcaatagactagattaataataaacctccttaatagtatgtctacatgggtatctatagctctctaatccattgcctcgtttttctcgttagtagatagctttgctatctctctttatttaatctcttttaagtagaaaaaaatgctgacatagatatcttgtagatagtatatagataatcattgcgggtgcccttagtactactactgtactagtagatggcaaaatggcactactgtaattttgctaccggttagtacatcttaacattggattgtattcatgatgatgcattaagggagatgatgcacgcagcagagtccgatttggtcaacaagaataattcttctttgcttaaatccatcaaccatggatcttcttttgtactagtagtaccattgatgaactacagtgattgttgcttaaggatggagctaaactggatacaccatgatccgagatcaccaccagatcaaggacaacaaagctactcctactagccaacaaaagaaatccaaaacaacaccagacacaacatgacacccaaggctcagggaactgacaatagtgtcaccccccagattcccagatgcagcaaagctactactcctgtactgtagtactactctcctccctaactactcagaaaacaaaaaaaaaagataatccattgtatgccaaagataatccattgtatgccactgagtttgtcataggtctacaatttaccactgactttgtcacgttctataatatgccatcgatttttgcttaacttctacgatttaccaccgccatccggttagtctccgttagtactgtacactttcatccaaatgaccaaaatacccctgagacaaaaactttcaaattttggataaaaattctgaaatgtcagactttaagtttttggacaaattttgaatgtttacaatcttatgtttataatatggtatttcggaatttttgtccacattttggaagttttatcccaggggtattttggtcatttggacaaaattgtacagtactaacggagactatctggacggcgatggtaaatcatagaagttaagtaaaagtcgatggtatattatagaacgtgacaaagacagtggcaaatcgtagagctatgacaaactcagtggcatataatggattgtctcaaaaaaaaaaaaagtcactgttgtacacaaacaggatgaatgcaacatcttattgatcctaatcaagtcaagcaaccaagatcaagctggatgcaacatcttattgattctaatcaagtcaagcaaccaagatcattagtagtactatcatgtatacaagtaccatcattattaggagtaattggcagcaaatctgtggtattgttagcagtatcatgcaagcatccaggacagagagaatattgatcatatgctgatgatggaatcgacaaggtggtaaaaattatagagtaaccgacaataatcatctttttcatctcggggaaaccacaaaaaggagagagattttgtcaatctcctcgcccaacacacaaaaccaatccagacatcacgtcttcttaacctgaaccagaggaccagaccaactcatagcagcaaaagcatcatcacacgagcagcagcagcagaagttaaaactaaaccgaaatcccaatagcaaaaaaagaaaaagaggtaaaaacaaaaggcaagcggttcctttatagcaggcaacgcgctctccatgtgacccagatcggcggcaaaactaaagcaataattcgacttaggagtgatgaagatttaggcgagatctaagaggaggggggggggagatggtgttgtgaatccatcacttgtggcagtcgcgggcgatgtgtccagcctcgccgcagttgtagcaggagcggtcgcctccaccgccgaatcgcccgcctccgcctccaccgccgccgttgtagcagtccctcgcgaggtggccggtctcgccgcagttgtagcaggcgccgccgccgccgccgccaccaccaccacctccaccaccaccgctgttgaagcagtccctagccatgtggcccatctcgccgcacttgaagcagccaccaccagcgccgccgccgccgccaccgcctccaccaacgccgacaccgccgccgttgaagcagtccctggccatgtggccagactccccacacttgaagcagcccccaccgggtccaccaccgccggatctcctccccccgccccagctaccgccatagctgcggccgccaccgccagatccgcccccaccgcgcgatccgaagcctcccccgccaccgccgccgccgccggcgccgcccttgacgaaggatccgtcggggccggtgacgtcgacggccttggtgcggccgtcctcgctctcggagatggcgaactcgacctgctcgccctcggcgagggagcggaagccgtcggccttgatggaggactggtggacgaagagatcctcgctgccgtcgtcgggggagatgaagccgaaccccttggtgtcgttgaaccacttcaccgtcccccgatgcctcgccgccgccgccatggatcgcccgccgaggagtcgaaaccctagccctcgcctctccctgatctgattagggtttgattgatttttttttcccctcgtctcgctacgcgtgtgcccgatcttatctgtttccttgggagactctatttataggcggcggcgtggtatacgaggaactcgagccgagaggggggggagacgactcgcgggatgggggttgatcggacggccgtgatcgcgcgaccgggatctggacggtcgtgggggagtgggccttggttcggacaccgacgcgtgggcccgtgactcgcacgtgtgggctgacggcccagctgtcagtggggatgggccccgcgcgagggtggcagtctgacgggtggggccatggagagggtggtggtgggattggatgcggtggctacgcgcgtcaatgctcgcgggttgggccgtgatttttgtgattcattgcgtgcgtgattatgtgcgtacgctcgtgtgttgcgtcagcgtgtaccaccacgtaacagagtttcatgcctactactccagtttagaggtgcaatggatacaataccggttaccgctgggttttcttaccccgtatcatctccaaccatacctattcgaaacagtatcctcccacatagtcactgatatatggatccgtgaacggtgaggctcacatgtcaattaccatgtccttctgactccatgttagaaaatcgcaatcccacctatccgtaggtacaagattctctctatactgtatatgtgcgggcaataactacccgttgcaggtcggactcaggtttaaccaaggtcttaggctaactcaatgcatgttgagccaagacatgtctttttacatttgtgaaaatgcatggtttatatggggttttaggcctaggtccgacccatggcctaagtggctcatgacctaggtctgtcattgacctgccgggtaccgatacacgtgacactttgagcacttgcaatttacactatagtcaaatgattagcaatcatccattaacatcataatgtcaggtatacaatgattttaacatcaaagttagcaaataaacagaccaaacaactacattccaaaatcaagaaattaaatgataatgccatacaacagactagggaagaggttgagaggttaaaggagttttatcgaatgtccccgaagagacaggttaaaggagttgggagtagctatatttatggcgccatatttttcaccaaaaaatagtcggcatgtatttatattgtaagtttctaaaatatatatgtaattttagtgcatttacaatgtaaatctcgaaattacatatgtaattttagtgtatttataatgtaagtaccaaaattacatatgtaagtttctaaattacacatgtgtaattactgtgtaaatagactaattgcattctttgatgaccaacacgtgtcacgcaaagcaaaaaggagtcaccaacttaggagcaagttgttcgattagcttatcagatgtactttacatgaatcgtgaagaaaattagatggtagatcgacaaactgactgtatttagcctagaaatatgtcgacataattttagcaaagccgaaggagttttatgctacagatgataactattggcagtttttctatgcatacggtttttttaaccatggattagtgggtgtggatggctaaagaataaacccgtagagtatatccaatactcctcattactataccatatggatataacaattttttctcactagtaaaaaactgttgggtacttgggtctccaaacgcggaccctcgtcgccgtatctactccagacaatgcttatacaagcttttaagaagatgttttcaccttgatatttatgttttcaagtccttaaatttcctttgcctggtgattttgacttgtctcgtcacaaagcaaaagagcagcaaaaatggaatatgttttcaagcccttaaatttctttctcgtgatttaaacttgtttcgtcacaaagcgaaagagcagcaaacatggaaaatatatcgcctcaaaggcacaaaaacactcttaaagaccatcagcctaaaccttgaacttttctcacatcgataccatagaagtttacagttaacacccagttcatcacagaattgagaggcaatgaacacagctgttgcaacttgcaagagacggttggtatacaatcatccagacatccagtacagaccatgcagtgtatttctacggatattttgagcacagcttcaggcatctacaaacatctcacagccagtgacacaaaagcagttcttcattgtgggtgtcactgcagaatctggaaaaggaagaatctcacacggcgagtcgttttccaatttcggataagcagcgaaggcaacatttaacgttactttccccgccaaaaaaaaaaaaaacatttaacgttacttgtaaccaagcaccgtgacagcgtatagcttgcttgtccaggggtgaatgcccacaccagcaagcaaaagatgggcgacaagaattcctgcagcggaagcagcttttcatcacagctcagcacctgtgatctctgtggctaccggccaaggccatggtccatggctgcctcatgattgccaaacattaggctgattagggttcatgattaagtccctaatgatggcctttaactaccgtgccttgctgaggaattccatctttaatgtgtcctctagttgtgagaatgtcgatgagaagatacctgaaaacaaaagaacagtacttttttgtcattgtcaccgagataaaagaaaaactctaattttgtgcatgtactagtaagccagaggagctatcatgcaattggtacaagtatcatacatgcagaagttctgtttggttcacatccagttgcaaccactattggttatacataatacaattggaatttgagggaatgagctaaatgctcatgctgcacatgtatagactagagatgaacagagcaattatataacctaaccaggtttgaaatatgacaagcaatctctatttaacagaaagatcagctagagattcttgtctgcttgtcctactatctatagagcttgatttacttccctctacaacctgaataattgtatcctcaattgcaaggacggtcagtcgacagtcaataacaaaagcagcagcttcaatgccaacatgccatatgatccgtatctacaggctctgcctcctgcaaacttaccagccaaactctctcaatgcgtcaatggtccctagcgttcaagtgtcatttaggagtatgtctccatcgtggaattagcactagcagctgtctagagccagtgacaattcatatgctagagccagctaggcatcagtactactgtcacccttcttttactggatagacaaccaagacaattctcaggaccgtttcatgactataggaccaacacagcttggcagaggagggcatgaacaggattctccatctcgtgctgtacaatgtacatttgacaccatttggtggatcaaaattttctactcgatcaacagatttcattatgattgagcgtttatgcactgtaaaacaacctcacatctacaaaagcaagtgccaatcatcctgaatagcaagagttagtacagataacgaatcaagtttcagctccccatcttgcccttttagtgttttatgcatcctatagaattaaaaggacacaaatagccgatgatacagacatcaggggatttatacatgcttgaatctggaatggagttatatggcaataggggaagataaaagaggttatcactgcaggggttggaacaaggaactgcataaacatgctgcagcagtggcaggagaggtttcctgcagatgcacgaattcaagtgatttcaggctactcttgtgtttaagactcgatgccatcctttctgacttcacaaactggttggtacgttatccaaatctctaggttaacgtggaagtcagctctttccacgcatgccagccagctgcatgctaaataacttgagggtggacatttgtattttctgaatggccacagaccatctggttggtgcccatgattaagcgccagatgctgtattcgttaaaaatcatcacccttaaagattcactcatcaccacttaacctgaatgctctcctgaagatggctatttcaaaggcattgtgtctgctgaatcacatggaattcggcacctatatactagacaacataaatctggctacctctggaaatttcttcaccagtaagctgaccaatggagtaaccttatgtcagttcatactgaaatttgcccctgctaccataaggaacggacaaaatcttacaactcctctccaaatctctgtccgttggtaacaaggctaggctgaggcatacactcgaagtctgattaagatgcaaaataggtttctggaacacaaattaacacatgatgccagaagaagatgggtttgatgggtgacagaaagctttggggcatggacagcagtgagccaatgatagcttcagggtgccaatgccaacggtagttgagggagggtggtagccaggcaccagtgcaccacgaccgtggctggacagtggctacaggcatacagtaaaatcaagtacactgttggcatatctgacaagataaaagaagagtagatcaaatgaaggtgatggtagctggagaattgatgttgctggcaagagggtgatcactctggttgcattgggtgggaaagatagctggaagaacaatagtgagagggaacgaccaagcccccagaggatggattgctgccatgtcacattcatgatttaatagctcaatagttcccattttttagtttttttatacacacagatgaagcatccgtgactgtcagtttcacatggaaataaataatggccaggccagaggcaaagtgggatgccattagactcaataaaatagctcggaactcaaatcaacaacaatggtatatgcactcaattgaaatataacatacagtgaaatttacacaaaactacaagatcaagaaaatggcatgttatgcattgatgaaaaccaacaaaggtgtatctgcatgtttggacaataaatgtgatatcattcacatgaagaacaacgattacctgacagtgctttgttcaataatgaacctctgactaggagtgtgcctggcatttgttcaaacacctatatggaaaaaatacaatgattttttttttgaaatatacacagaaacaactgacaagttcataggaaaaaaacataactaggtaactgatgaacataatatacttcaatttatcctaagcataccgaaatacggaaggatgttccagtaacaccactatgaagctttgtagagttgccttctacagaaccagattcatcgtgcaacattgcagcctgagcctgctcatctgataaggtaacctgaaagaagagtatttcatacaattcttggagatcgatacactatagaatttgtacaacaacaaaaaggtctgtgtactggtgtaatttgacagaaggaatatgcggcagattaataaggaatcttacatcaatagaaaataatgaagaatcagttttacacgatagattagaagcatggaaaaagctctcagctgacttcagcacttgaaatgcaccatattcacgtcgaaggccctgaaagccattatgtaaatgagatattgaagcgaagaagcttgagaaggtgcaatagtagtggaaactcagtatcaataactcacagataaatataagttggctgattagctctttattaataagaggaaagggcgcaggtattgtccaagaacatacaaacataatggtagataagattcgagttggatttctttttcttttggttgctaaagaaaaatagctgtgcaatttatggaggtaaatgataatatgaatcaaagggacaaaaggtgacgtgatactaacttgaagcataaaagaatagttggcttttccaggtgtactggatctaatgaccattttccttggagcaatgaatgaccatgcaaggccccatctagctgtttgaccttgcacgaattcagtagttttcacaactgacaccccagcttcacgaacttttgaaaccaatatttttagatttgcttttctgccaaccatcgaagtaaaccacctaaaacaataaaaggaacaatgagcccagagacaattaaaaggctattatcatgttaggttagtatttgaatcacctgaaagagttcttaagggaaacactgtcttcaattatacgagttataaatgcctgttcaccaccaggacaaaccatctcttcagcagttccaccgcatgaagtttttggattaagaccagcttcctctatactttcaaagaaaggaggattgcacatacagaagtcaaagctctcactatccttcacaacgccaagaaggatagatggtttcgacctcagtacaccatccactggcttcgaagtgttctccctggctgcttcaccatcaactgcttcagattcagaagaacaggacattttgtttgcatttctaatctcaaccagagctgctagctgtggattgctctccacattctttttagcccattcaagggcaacatcagtgacatctacaaacacaggggtaatccgattaaaagagaaatgcaaataaaagttcaactaacataagaaactctaattgatgctttgcaaaacttatattgtacatgatctaaagcataccagatccaacaaagctccagcctagtaaagaagccccaagcagagggtagatgcaattggcacctgtgcctatgtcaaagccccttacagtcttgtttgaactggatattggtggtatgaggtctgatgagagaagatcctcaatccagtggatgtaattggatctgtttggcacagtagggcacagctgtccatccggaatccacctgacggtagttagcgacaaatgtcatgttcatatattagattaaataagatattgatcacaaaccatatgcatgacacttagccaataacatattgagcactagtaaatattttgcatgacaaacgaacatcacgattctctctcttcaaataaacatggcagctaaaacttcttcagagaggccatttgaattttgaactgttagtgcaacaatagtaccatttctgatatagtagcatcatcagaaaaactactgaagttacttagaacaatcaaattccctcaagctcactcctgatagtagcaactagcatcaacagttcatagaatgacaaatgagacgcaacagcttgagctcgatgctgcggatggctgaattgagtggtaccctagtgattcttcagcagagcaataccgggatgcactagaagcacagacggattagggttcagggaagtgagcccagagagtgtaattagtaccaaccagttgacgccgtggtcgtggaggaggaggacgcgcgtgagctcgcgggtggcggcgaagtcggtgaagtcgatggaggcgcggcctccccgggagacggagacgaagggggcgaaggacgggtagagcgacgccagcgacgcgaagtccggcgccgcggcggcgtagcggttgcgcgggtggatcgccggcgcctccgagccgtcccgccgccgccgcttcctcccaccccccatgacgtggatggaccaacggcggcagagctcgagcagagatcgccggagccccgaagcgccgcgggggaagcgacggcgagcggcgcggcggcgcaggtcgggtagaaaagctcggggttttctccggcccaatccttcgtttagatctttacatgggcctcgagtccctatcacggcccatccacaattcatctttgtcaaatgcagacatatgtttggcagggcttcagttccagcttcatctatctcgaaactgaagttcaaccaaatggtttggagtagattaagtggtatgaaaaactatactaagaaggtgaagcggtgttcagctccacaactccgctttaaactcaactccaggagttggaagtcctgctaaatagaccatagcatagtgtttttgaaattcactgagaaaacaagagtatgaagacatggtttgtgttttcatcctacaatgtgatacaggtaaaaatgaaaaagatgtcagtgtcatttatcattaagcaaaatttataaaccaccaagtttagggtatctgtcatgcaaaccacaaatattgtggttttctttaagaaaccttagattttgagtaaaaccacttagggtgtgtttgaggagaaggggattgaggagattgggaagatacgcaaaacgaggtgagctattagctcatgattaattgagtattaactattttaaatttcaaaaatagattaatatgatttttttaaagcaactttcctatagaatttttttgcaaaaaacgcaccgtttaatagtttgggaaacgtgcgcgcggaaaacgaaataaacaaactcactctctctcaccctctcgaatgctgcctaaggaaatgtttggttgatgcctaaccttgccataactaagtttaggctagttgtggcatggtggcataaatgtggcttagaaatagttggccacaagtgtgtcatgcttagctctaaatttgagagcatgacatgtgggtcccaaagttaagaaagtgtggtataacacaattgcggcagcgaaccaaacacatgcctaaaaaactgtggcatggctaaagtgtggcgtggcaaagtgtgacaaccaaccaaacagccctaaatgtttcgtgaaactttgtgtaggcttacattgttcatttaaccaaatttatgaacagcaattgtgttaaaaaaaaggtagtatgagatattttttttaggtacatatacacttcaaccatattttcaatcaacatcgagtattatcaacagtatggaggtacgtgtgtatatgtaatcgactgttttatatcttttttaagtggaagcggcaagagtattgccgaatatattagaaagatagtgtgtgaccctgtttataaggaaaaccgggccaaataacatacaactgcgcgttttgctaaagtgaaaccggcaaaaattttacacagaagacacaaaagcctaaggcaaacacaactacaaaccgcataaggccgtgggaagagtaagatcctaaggcgaagccggagatgaacaacgacataagccgctgtcgacgcccgacctaaacagttggactgttttatatcattattagcgggggattgtattaagtttttcaataatccagcgcaaggataagatagaatataagatgacaaggttgtatttgaactttgtattggaatatgtttattaaaacattttgcccaaaatataatacggatgtcttaataaaaccggttttgggaaatttaatatttatcatgttgagcaattggagggtttcaagatcattttttgcaatggtgagatttccttcaccaactattttttgttattaaaagggaaatgaagtcatcttgtatttatgtaacacaacaaactctccacatcttcttataattttctcctctgtgtttagatcctgaaatgaattggagatcaggttttaggcgccacagccaggtgcatggagattggagacaagacgaaacggcacttgcctgcaaaaagtagtggatactgtctttctacttctccgttcttccaatgatgaattggtgattggccttttcaaggtagttgcagcaagtatctatctatatatcctgaagatgacaattggaatcgatgttcagtgcgtcgtcaccaccacttgtcatgctttcagaacgtcaacgacacacaacctctcgttttttcctttttgtgaagtaattttggcgaatacgagcaccatgagaacagaatttcgcacaacttggaaagctgttcttcaatttttgcgattcctaacgcaaccgcgtgtggaaagagagaaggaaactaaagtgagatcgatcgaatcaagcatctcctgcgtacagtagctgccagccatgatcacttgtggcagccatacttgaggcatctcgatcgttttcaggacgtctctggcttgacagctgagttgagattattcaggttgatctttttgcttggttcagatttcagatccgtcagacttttcaattctgttttcctactcgttttacaggttctgaaattgccaaatgccgaccaaacgaactcaacacaagacgtgattctgttggtattgggaggagataggaaggaaaaacctgtcctgcaaatgcaaaaatgcaatatgccatattgccttccaatgagagtatgtcagcattcaagcaaacagccaaacacagattatagttcgtcccatagaggctggatgtggaacgttagccaaaaactggatttgtaatcctaattttaattcattttaggcgttccttttcaaattttttaaggctgtgtttagttccttctaaaattagaagtttgggttgaaattggtacgatgtaactgaaaatttgcgtgtgtatgtcaggttgatgtgatggaaaaagttggaagtttggatctaaacacagcctaagtttcggctttttaaccaaatatcaatatactaaacgcctaccgtaaaactactttttcgtaacatcgtttttattctatggcttataactcgaagcctatcaatgtgactagtactattttattacttaatgaaacgtctatacattatatatatcaaaatgttataaaaccgtaaaaaagccatgatatcaaactgacaaaataatactctatccatcctaaaatataaggaattttatgtggatgtgacgtatcttatactttgggtgagaggaagaggtactaataccactattatattgtactccctccatactcgtaaaagaaatcgtttaggacagcgacacggtttccaaaacacaactttgacttcttatttctataaaagtatttattgaaaagtgatatatgtatacttttataaaattatttttcaagacaaatctatatatataatttttatattttcaaactcaacaacttaaaagttatttatgatttatattcctaagatttgatttaagcattgtcctaaactactttctttataagtatggagtaatatgtattggtaacagtacagtatatacagcagtagtagtagaatatactgtactgtagggggaggtttgggccggcagaggaatgggccagtcgcacatgccgtctgcgtgcgcttcccgcgacctagaatatcgcccactcgctcaaccgcatatcccttcctaataacctctccgatccgtaaacctcgcccatgcgccacgtcccccctagtgtcctacctcccggaccacccggtcttggtagaccacgtccacctccccaactaaaatatcctccctaacccaaccaccccacggtaacccacgtacttaacgcgagttaccccccgcaaagatccaaccgcctctcgcaccgcccgcctgtccacccacgcctactgacgaacccggcccacctctccgggccccaccatgtcgtcaccacgcaggccaaaatcggggagagcgtgtcgtggtcccacctgtcattggcttcgtgggtgggagcgggtcacgtgcatctcgacatgactcgaggaggtaaccatggttatggtaaccccaccgccttgacacccgtggttaggggtgggggcgcgcgatgccgccacgtgtgacgatcggacggctgcggagggcatcggggttgggcgacccgcctatttaaccgcgggggcctcgtcttcctcaggccacgcagcgatctgaagtgaaacagcaaaaaaaatcaaacaaaaagaaaaaatattccccatctgtgaaattcgcaaaaccctagcgcggcggcgatgtcgaacacgagggtgttcttcgacatgaccgtcggcggagctccggcggggcggatcgtgatggagctgtacgcgaaggacgtgccgcggacggcggagaacttccgcgcgctctgcaccggcgagaagggcgtgggcaagagcggcaagccgctgcactacaaggggagcaccttccaccgcgtgatcccggagttcatgtgccagggcggcgacttcacccgcggcaacggcacgggaggggagtcgatctacggcgagaagttcgccgacgaggtgttcaagttcaagcacgacagccccggcatcctgtccatggcgaacgccgggcccaacactaacgggtcccagttcttcatctgcaccgtgccctgcagctggctggacgggaagcacgtcgtgttcggccgcgtcgtcgagggcatggacgtcgtcaaggccatcgagaaggtgggatcccgcggcgggagcaccgccaagccggtcgtcatcgccgactgcggccagctctcctagatctgtgctgttccccttcgcctttcgccagtatcagtcgtcttgagtcgtcgagtccctaaataaggaggaggtggtggtggtgttagtctttttatgagttcgtgtcgtgttggtgagatgagatcgcccatggtttggttggattaggcggagttcttggatcgattcggtggagttggatctgcgatccttcttggggttggttttaaatcttaattcgtgtcgctgcttctatgatatcgctatcaatcaatgagaacatttgggatccgtggattttctgtgatcttacacctgtgtggttgtttgttcttgcgacagtactaacgttcttgcgattaaagtagattaaactatcttcgtgagatgagcggtttgtcgccgcgtgatgcctgactttgatgtgatttgtgggacttcgtcttatccatttggttattattatttttttattttgcaccgaggctctctctctgatgtgatccactgtttctgatctctgatgttaccaccaccagagggtaatttgatcgcttaccagatctctgaaattatgcttaccggttagaggggtaaatgatcttacaagttgtttacaggttcaagaggtgaacataattgcgtttcaccagaggatactagaaccttttttgtgttgaaaaatctattattaagggcagcagtactaaactgaattattatgtcttgaaaattctattattaagggcaggagtactaaactgaaggtcgccgttattttagtgaaaagacaaaagttgcaacacctgtagtaggagtagtactccactttgaagaatgaccattctgaaatttgctaggtacgctgtcactgccatcatcttgctgccttgcctcccacaaggccacaacccagcgtacaattgtacaatcaattctctctgttttttttaaatcacaactttcattagccatactaataactccctccgtaaaaaaaaaagacaaaccctgatttccgtgcccaacgtttgaccgtccgtcttatctgaaaaaattatgaaaaaaattaaaaagacaagtcacgcataaaatattaatcatgttttatcatctaataacaatgaaaatataaattataaaaaaatttcatataagacggacagttaaagttggacacggaaactcagggtttgcctttttttttacggagtagtacttagtactatagtatttttttaccgcgagcacacaatatatttggatggatcttagatttttttgataaacttagaggttgttcagattgatataatttcaaagcataccaattttaagtaaagttatcaaaaacatgcatccgtttagttttttaccaattgctaaacacataaaaaatcctgtcaaaatttagcaatattgtcaacttgcaaaaatttgttcaagtttgttttgactacaatatgaacatcttatttttagcaacacaacggtagatagctttaccaaatatattttcctatactagcagtgagacttactccctccgtcccaaaaaaaagacaaaccctagttttcgtgtccaacgtttaaccgttcgtcttatttgaaaaagttatgaaaaaattaaaaagataagtcacgcataaagtattaatcatattttatcatctaacaacaatgaaaatactaattataaaaaaattcatataagacggatagtcaaacgttggcacaggaacccacgttttgactttttttttttataagatggagggagtatccttgacatcaatcacgaaatttccctcatcccgagcggtacgaatcgcatctcgtggtagcaccaccagtcaggtctagcggaacaaaaacggagctagtcagatttggaatctgtttatacaattccatctccatttgatcgcagcatattcctttcctgttgcaattaacgctagcgtcatcatcacaaagtgcaactcataatctcatacgcagattgatttgattctccgtgtaaggtgagtttagttccaaacttttttttcaaactttcaactttttcatcacatcaaaatttttttacatacaaactttaaacttttttgtcacatcgttccaattttaattaaattttcaattttggtctaaactaaacacaccctaggtaaaaataccgacaaattaccatcatcttccgaaaacgtgcaagcaaaaaatggcaaaggattgtcatgaaagtttacacgctcggtcgatttttttctccctgtgtgtgtgagccaggtgacggtggggcccacatgggtagagagaatacagggaaaagaggcttgggtcccacgagacagcggctggtggcggtgaaaaggaggacggcgcgcgagattcgaggcagcagaggagggttttgtttggcgtttggctcatgaatgaatggatggatgagggtggggcccacgtacgtgtgcgtgcaggtccaggtcgcgttggtgctacgcagtgtttgacccggggtgggtggttgggtcgggttgggcgggtcggggtcgccgcgcgcgtcggggatcgcgtcgcattggtttggcccaccactactattgctttccctgcccagcccaaatgcaaaatgatgattggcctggccctcgtcgcgtctcgcctgtcagccgcgaaaatattggctcactccgtcccaaaataaatcacagataacatattattatattttattattatataataaaataaatattaagcataaatattattggatgttcaaacgttggacatataaaccacaactacacaacatagtactatttttaggtccccatcgtttcgcttttttttctggcttattaggaaataaaaataaatttgtaggtaaaatttttatatatgtgttcttgatgacttaaaagccaatgctgaaaaagaaagtacgttgaaaatatctcaaaatcaatctcaaaattaagtttgaatatttaaaatttggctttttctttggcttattaggccatccgatgggagccttagtgtatttttttcacgttttaaattgatcttgctgtcaattttactatgcataaaggttgacatatattcctagatataggtacaaatattaggattcaaaatttgtatacaatttaaatgtaaatatacttatagttattatttgagaacacgttgcataaaaaaaagtatagtacgatactcactccttcgaaaaaatctaagacctattttatttttggtttctgtaaaaatctgagtcatatttgtagtcaacatgtgctaaattaaattgttgatcggaaaccaagaaacaattctagtacttattgattgcatgttcattggttttgccatatagtgagtgagttaattgcttcttggttttaatgaaaaagaaatagatctcatatttttggaaggatccatctacttttgatagtcatatttccaaatctgaaaattttatttttgataggcatattttaattcaacaacctatcctcttaatgaatttctcggatttaatgcatgactctccattcttctacacaaaattggctatatgggcatcgagaaatgtaaatattaatgaatcgcttgtttacgagaaatgactattagcatgtttaaatggatgataaatagaataacttattcttaatctatatgccaagatgaaatattactatcaaaagtagatagaaggagtactacgttctagcgctacgagtttgttttttttttatcatacgagttgtacttttatacccaaaaaagtcactctgtcctgtcctgttgaagattacagtactggtgggttgatcttctagaaacagaaaatatactttacaatggattagtagtatggtttggaaattatggagtggtgacgagtagtctgttgaagcagaaatcgctggcaatcaaaagtagattagaaacagtggatttggggcgtgatggcggtgaggttgcaaccgcgcaagcaacggcgtcaatgcctccgccggtctgccgtgattacttcacctgcgaccactcgtctgctctgcgtcattctgcctgacatcctcctccgttcttgtcgctttcacaacgtggaaaatgagggctccattattttgtacgattttcgtaacgtatgaataagaataaaaaaaatataggaacaatatgaaaatatatgtgtaaacttaagaattgaaaaacatcgaaaactttaccatgtatgttcagtaaacaatccaaaaaatttaaaacattgggttggagtggattgttttttccccctataaaagtagagtgataataaattcctttttgctggatccctttaaaacagatggcagtttagtgtcactccaaaggatcccatatttctctatttttcctttaaaatttctttgaaacgaatgagcccggaatggctcatcatcttccattcctcctctcagttccatccaactcacacatggatagagtggagatgcatcactgaacacaagctagtttcagaaacatcactgaaacagccaagcatgctggtggtagtatctatcacaggatttaggagcagctgcaggaagaagagaattcggtttcggtgctacctttcatcctctgatctcagctgtgttcagttcagctcttggcattgctaaaaggaattgttagttctatctagttcagttcagctctgaatatgctggttttacgtttgttgcagatggtgtctgtcactgaagactgaaactacatttaaactgtatatgtatcatgcacgattagatccagatgggctccttttctggcagaaaaccatatacatcaatacatgctggttgctggatcttcatgtctattctttcctgctggatctactatagcttattactagtagatttcccagataatattacctcgatttttcagatagacaaattctgtctttgcacagaaccacacagaagacgacttactttcttcaccctgcatgctggatatatagcccttcaacctataaaatcgatggagatatcatcatcaacagggaactatcatctcatataagttaaaatttgaccttatctgatctgccataaactgaactttggttctacttagtgattatctgggaaaaaaattgttttttatccatcccacacatacctatacaaaatttatcaaatcccaatgcaatgtatttatcctctacttttacaaacttcagtagaataattattttaaaataaatttattttgagattcaaaataaatgggagggatggaaaatgatcatattctgaaacggagggactgagggagtattcgttatactactgctgcttatcttctcttctgggatagggtggcactgtggcagagcatattgaacgttctttggggagagagcccagtttgacaaatagcccaaattggcctactagtcactgggcttaaagctctgagcattttttattgggctcagttcagaattatcgggttttatccctcaattcttcagcttttgatcacaaaggaataagtctattttgccttcctcatctcttgcctttgattgaatcatatctctcaaccataaaactataggtataatgtctcttccaacttcagaaactggtgcaaaatgactccttgaatggtttaggaagctgtttttgttgtcgtgataggtgagacccacatgtcagcgactttcgcctatctcatcctcttacttacctctctcctctcttcaatcttccctcctcctctctcaccttctagtcgctcacctgttgttttgatgccccaacctcctctccctcgctgctgcagccactgcctattgctgcttttgcttcaacaccaccatcgcaacctcctctctccctcatcgtcacagttgtcgtatgttgctgctgctgcttcggggaagtcgagggaaatggaggaggcgctcgcggccacaggaggaccgggtctaacaggcgaccttgggagggtaggatccagctatagggcgatgtccggtggaagagccaaggtgtcggtgaccttatctccttccgagtagcggtggcgccgacatcgagcttgagtggccacattgtctcctctccatcctctcccgatcatcgcggatgacggctttgccatcgttgggcttgagctcttctttatcctccactaccacgccatttgcgtatcttgcccagaccgtctgagcccaaggagagatcttattttgcgcccccggttgcactggatttgattttaaaatcaccatccgcgtacccgacctgattttgcggttaagagatctgattcaaccgagggcaagagacgagggaagcaaatagatttatcccttcacagaaacatgactactgactagtgtcttatttgggtgggcttcaatcctggcccatccacatgtatgggacaaggcctaactagcacatttataattgtcttgtttttcatatatccagatatctatttagccataagtatggcttctttgtgagagatttaccgataaagatctgattattcctaaacggcaaaataggcaggcccccagcggaggactcatcaagggctaaaatcacgcgatgaacaatatcatgggccttaactagcccttgtcccctttctcatgctgaatcaaacattcaaatcagattcgatttaaatagtttcaaacctttcaggacatcctttcattgttctccactgtactggtaagagtaaaacaactgtactggtaagagaaaaacaatacattgagaaaactaggatattgggatattgtggtattgtcttgctcacaaaaagaataatatatgtattttatttccctaaagaatgatgaatatatatgattagcagttgctatcaatcttggctgcatggccaaaatacaatactctcctatggtaagctagctagaactgctaaccagtctcactcacacactattgcaaaacaagatgaacactcgctcaactgtttgatgatgaatatagaagctaacaaaatttgtaattactaataattaaacctttaatcactagctactttgctagtagtaatccgatcgaattcttcttcctcctcctcttcttcttctctcgttgcactgatccaaaaaagttggatttctggcaatggccaatcaggatttcattctacccgcctcatcctgctcgccgcgctgccgccttgtcacgccggatctgttgccgccggagccgcgcctccgcggtcatcgccgccttgcacgccatcgccgcccgcttctgtcccaggtggtaccactccgccgccgccgccgccgccgcggccttggcggcggcgacggcgacggcatcgtcgtcgtcctcctccggcgcccgcgccggctcgttcaggtccagcaccggcgccggccggacaatgtcggctgccgccgccgccgcctccacccgccgcttccgattcacctcctcttcctcctcatgctcccgctgccgcttcagctgcaaatagtaaaaatgaaaaaaaacgtaaaaaaagagaaaatgaaaaaaaagtaagatgaggttgactccgactcaattggggattattcggaaaggtcgcatctttctttccatttggactggttgccaaccatgccggggtgtcaggtgtgtgtccacgcaaacacctcgaccaaagaattgaattgaagcgcaagaaaagagtagcactagtgaagcattgaccttatcatctatctacaacaacgatgaatcgatcgaacataatttgtttttacgattttagaggatgcaaaaattggagatgaatcgatcgaacataatttgtttttacgattttagaggatgcaaaaattggaatatatgtagctgtaaatttttttaccttgcgctgcatctgcttcaatccgtcattggtgctcctcgagctctgcagccggactctgtactcctcgatttgctgtttttttattcaccacaaagatgaacaagtgtgtcaaaatcccaacgatttttgcgatcgggatagttgaactcgagagcgaattcttcatccatccattcagttggagagagagataaagacttggatagatagagagagagagagggtttgataaatctcaccttggatagatgcgagttttcctgcgacaagctcgcgacgacggcgcgctgctcctcaacccactgatgagcaaagcagggaagcaaaaaagaacagatcaatactgcttacaagctaaaatcaaatcgaatccgatcgaattgggaggagaagagagagcgagcgaatcagatctcacctccgcgtgcgacgccggcgccttcctgggcggcgccgccctcgccgccacgtcgtcgccgctgctctcgtcggggacgaggaacgcgagcggcgtgtcggggctggcggcggcctcgtgtcgccgccccacgtccgcgggcggcgccggcttcttctccccaggcgtcgtcctcggccggcgacatccccacgaggggatctcctcgcgctggacgcggcgtctgcggcggcggcgatggcgcgcgcgcacgaggtcggccaggtcgcggaggatggcggccacctcgtgctcctcctcggtgaacgcctcgacgacgacgccaccgctgctcgccatggcggcggcggaatcggcagcgagagcggaggagagatttcttcgtgagcgaggcgagagagagagagagagggagagagagctgagctgcggattggtttggtttatagcgagagcgccacgtggcagcggggagggcgtggggattaggtgaccgcacggtggactccacgggtgactgactggtgggtccctggttttagcgactccgttatggttttgcgtgcggagggagtctggttttaaaggcttcacaataccgccccctgtttcaggtttttttttttcctccgtgtaaacagggaaatctcctattgagtttacatgtcatgaatctaagcaaaaggcttaatttcaaaatgaggggaaatctagtgagttactacaagggaactgtactaatttctaggaaaatttaactaaattttccttaaactagcgagttcgacacggacgagcgatcaaataagatcgagtttttgttgagagcagggatttaataataattttgtaaacaatatccatatgtttcaaaggagggctgaataatttagcactcgcattttcattaattacgcccccatcatttttagattatttgcttcacgctttttaaaatgttttcttaaagaaaattttccctactacatttgctaaaaccatatttgttctaaactattatttgtttttttattttttttcaatgcatctaatttcttcatataaaaaaagtacttcactacactcgagtacctttcgatcgagcaacataaaacatctcaaattaattacagctttttgccacccattggcatctgtgactgtcaaatgtcatgtcaacttgtctgaaaattcctttttgtcagatgaacacacagaaacagcagcagtgacagttttgctatgctaataagctagatcaacctcagctgcggcggctgtctgctgccgccatggtacggcgagcagaagagctccatctgcggcggcggtggcggcggcggcgcaggcagcacggccaccggacgcagggaagagacgtcgtggagccggctgctgtgctgccacgccgccgacacggcggcggcggcggcgtctggccttggatgatggtattgagggaattgaaactgccacatctgctgctgctgctgatgctgatgctgattgggcatgagctgctgctgaatcttcataatggctgggtttggattgcacatgtactgtggcatctgctactcgatggccaagaaacaaactgtgatgagaaattgagaatacaattgaatttgtatagcaaaaaagaaaacaatcatgttgtttgcagtctctcttttatccacatttcgttttgtcggaaaaggaacaggctatgatcaataacgatagaagtggttttttttttctgtattgtaagttgtcacaagaaaaggagtttgtactagtaactgttatgagatgcctataaaaaagttagtggttgtctataaggcattgacagaaaaacgcctcacaaatcttgcaaattctaatagtactattaatgatgtaaatctttcttttgtttcagaagcaatgtgcaaggacaaacctgttgaagtagtagtgcagtgtgcgtcaaattccccctggtgtaagggagatgctgaattggatatggcattgcaccgcggggagcgatcgggggatgtaaatactgaacatgctgcacccctgataacgccgcagaagtgggcaagttcagaaaattaccactgacctgaaagaagcaacacaacatctttcatatagaaacagagatagaaggaaaactgaagtagctgagatggttgaaaaggcggtcactgctcaccatcttttgtcgggcaatggtcgtgtcgcaaacactgcaagatggctgaacaggtagccttacatcgaaatgcaaggcgtagaacttctcgtcttgtgcaccattcttacttatggtagaaccgtctggagaccttgaaatgtgactgtgacaaacttcctcaggttttacccggttttgtgatgccttctctttgtccaaatgcatttggatgagatgacacatgtagacatgggtaatgcttctcttccatgtcttcgagggggtaccatttttattaacgagggaaagctgcagatataaaatttgtcagctcagtagtcaaagaatacaatcatagcagttaacatataaatatcccttcatgatatcagccttaatagaacatagcattcaacttaggagagagagtttccttatccatttattctggaagaaaagaaggcatagaaaaatggatatgttaacaatacttacattctcatgttctccagttcctttcacagtttctgcggcagtattattacacgacgccagtgtgtttgaagatggcctggaaaagggacatatttagagatcgatgatgaaaacaacactgaaggtttaatcgaaagttacttgatcaaatacctatgcgaggcacaaggttttgaagtctggaccggtggcacaatttctgacaatagtgaccatgtattagccaagaaatagtagaagcatcgtgactagttggacaaaacggtatgaactattcaacctataaattgttatgacactataaagctctatgagtaccttgggcagtgttattcttgacatttttcctgtcatgttccagaatatcaggcttcttagaattttcctgcagaaaattcatattggggagaaagcatgaatcgtaaggacagactgaaaagtgaaaaaatgacaccgaggggcacaaagcagtaccaggcaccgaggggcttctatctttgtgggatgaattgtactattatcaaactgcactttcagttgcttccgactgcaaacagaaataatcaaataaacatggagagaccatttaccaaaatacaatacgagatacgacagccatgagcaatttccaacctgttattgtagtctttagatgggctcggtaaattcgttacaattcccaaagaaatatcatgtatttgcccatcatttgacaaagttggatttgtgttgttgcaggtaccaccacaaggcacatgatttatttgtgaaacattgccagttcgttccactggttcatcaagggcaggttggttagctacttccgtaccggcagttggcaatgccgatattttctcatccacctttgttgctcctgtagaagtaaccagtcaattatatatgcaacacattgtcaaaaagatgctgaatatagtgattaatacgataatagcaagtcaaacactcaaactgcaaacatacctgctgaataagacactgaagtaacatttaaatctaagttatcttctgccattcctctgtcggacgacagttcacaaagatggggtatttgagataaagatagcaaagcatccacaactacctcctcctccttcgaaaaatgattcgccaactgctaagcaagaatgaagaaaaaatgattcattttcaatatttggtcctgcctcttgacaaaatgaagagatatttatgagcacaaaaacttaccggaattgcattacatcttgtttctcgatccataaggaaagtctgagagctgatagctgaaagatggcgcctcttcttgacatgccgcggtgatgtagaaacagtttgactggcacgtttatttatggctgaaagtagggggaaaacagaatttaaatattaactcagaaatgtaaatctttaatctataatttgaactgttattttcagtactcaaaacactttagttaataaaacatctaatatgtgtatgcaccagagctcacggaattaaaatgaaaatggtatgttcaaatatcatagcgaaccatcagtttgggttttgtgttctcacaggtgaatagtacccaccttaattaaaaaaatgcactctatattttctatcccgctgtaaaatcttacagtattatatgctaaaagtcttgcgagaaaaaatagcacagcatattcacttagccccaccatagatgtaaactaaaaggaaaaggcatgataaaagcacacgaaataagttgtccctttctatagctctgagagagaggatatacagtgattagtactcctacctgatcttaattttctaggaaccggtggatcaatagcatcacaatcctcagccacctttgaaacagaaaaatgaacaaaaaagatgtacataaagaacaggaagcaaatgattgaacagcagagaaggctaataaacgggacacaaaccttcccaaggctcttcactctcttcctactaatcagactgctgaagctagctgtggtcagtgaggagagcactgtatcatcgtagtctccatcagaacctccttcctcccctttcatgtccatgtcagtgttgcttaatctccacttcaaaacctttgcctttcctttcttctgcctagatatcaggtttagatctccaccttcactcatatttttgttgttgtctgtaaacaatgtacagaggcgactggcattagatatcgtgtgtaactttgtactccggtaactaaagaattttatcttttgaaaggttgtaggtacagtttttagtttcaccgtactccagtttagataaactaatcgtttagaaccaataagcacttcatccaagtgtttagttcagagtctttttaaatagtttttgttgacaaaatatttttaaatagttaagaatcagatgacactcttggaaataatgcactattcatctgatgaaaaggtgtacagctacagaacctgtatattaaaaaaaaagaaaataaaagcaatatatagaatcatttaaaaaggaaaagcaggaggaaaaataagctcattggtgaatgtcatatcatgctgcgaggagaactttgtgttgtgaaaaggatagtaatcacaaggtatggcttggggtgcatatctacacgtaagcagtaggtgacaatcgttaagacccaagacaacatcataatattttggagatttcttcacgaaagtttaacctcatcgaaccatccaaaaccagaaaggtctaaacaataaaactttccccgaaaaaaaggtactaccaaaaaaaaagaggtttcttgtggtgtgtgatcgatggtgaggaaagttggcatattttgtatgagctcatccatccaaagttccaaaccaaaaggccaaaccttatattgactgtttaaacataaattcatgacaaacctagattcactgtctgaacataaactcatgacaaacttaatttgaccttatattgactaatacaaattcatgacaagcttgtacaactactgcttagtgcttactctactcatatatgatgtaatcatttactctagctactatgcagtagtggtggtctctagccaaccccctagcagtagtacactagatggtgtgatcctgcccaaagcaatactacaagggtgctaattttccaagaaaataaccttaaaatggggtttcaaaaagaaaataaccttaaaaccaatcacagcgccatactaggaccctatatcaaggtgatcagtggggcccaccagagtggaacaaaagaacaaaaaagagcaccagaaaagattatttttttatttgtaaggatgcattaggaaaggcaaaggagagataattaagataaggggcattttggggaaagatatatgcatgagtgagaaaggaaagctgctgggttagttcactgtaaccatctggactggacacatgagagagaagagagaagagagagagaccactggggcagaagagaacagaacattacataccagcagcagcagcagcagcagtaggagaggaggaagaggaggagccactccttatcatgtgtcttcttgtgagcccagccaccagcttctccctcttcttctccatatccaccatccaaaaggttatatgcccaaaagatctcagaaaatctccatctccctttctctcctctcctccacacttaccataggcctacactacacacaacaaatgcagcagtaatcagtatgaatgaatacaagaagatatacacacacagagagactcaacaacaaagtgaactccagctttatggaagaggagtaatgctagtattgagacaaggagacagcatccagagggtcagcagtacaatggaagcaaaggcaataccaaaaggttaggataaaaaaagggggagttatgcagcttggtcctgtgtgatgaaatgcagaagaattagatgctagcaaagctgatgagggaaggggggaaaggtgatagaaaaagaagaattttttttctctggtggtgtttcttgactggaaaagattcatggatctttagccccccaagaatctcaaaaagaaaaaaaaagactgcatagagttgcaaatcattatccagatccaaccaaagacaccatctttctgaattcttcagggtaaaaatgaaataagattttggctcccattcgctgcagggaaaagatagagataagatcactctgcgcacatggtcgcatcgcaccttggaaaatgaattcagggtattctcccccacacaaaaggcttgtgaattttaacgtcaaatgctctgtccgtttcaagaaaaggaagtagtaataaactatttaattcatgctactaaactagtcatatgatttgatttgcagtgaactccacatttcatacccttttgtctcgaaatcgaaattatgccaagaagttaatcaaacaaacgatggagacgaagcatgtagcaaaaacataaaccaaaccgcgaaatcaaagccaaccgaaataagatagacagacagaacagcggtcaagcccatcctgaaatcgagacgcaaccacgacatcaaagaaaccgcaagaaacagggcagaattgcagggcagttgatgaagaagaagaagaagaagaagaagaagaagaagaagaagaacacaatccacaaccaaaaccagcagatgaatcccccttcccttcctccaatccatccatccatccatacaaacagaccactccgaagcactaacctccagtcatatgcctatgcaccgatccatctctccctccctctctccaagcttcttgatcagcagcaacagagagagataaagagaaagagaaagagaaagagaagatgcgagatggagatggagaagaaggcgaggaggcgagcgagcgagggagagaagggatgagtaaatgcgaggtggaatggaagagcagcaactgcaggagacgtcgcgctttttgttggccgctttggcgtgggcagaaacggaaaccttgcatctgcatgcgctgcgctgcggctgccactgcacttgcatctgcggctcactgccccacatgtactaccacttcctgtatagaccaaccaaacaccaatacagcaaaggtgaaaccaaggtggatggtggtggtgattggtgcagggtgatctgctcctgcttctatggcaatccctatctcccacttaaaaaatatccccaatctctctttctaactgggtatttagagcaaaatattgttattgtgggttatctattattctagttcttattgttgcctgactattagctctctttgagaggtttttttaataagtagctatagcttcttttaagtaaaggctggaatttatattccattattaaacaagctaaataatttttagaaaaaaccttaataaataattaaaaataaatggtctaatcagtaatgcaatagaacaaagttttagcttttattgcagtcaaggcctaattatctattatataaaaaaatactgaaattttggtatggttggttgcttgattttatctctgctgcatccacagttttaattaatctaaccttattttttaaaaaaaacttaatagatttattagtttattaaaacgagtggtctaagtaatacaatagaatacaattttatgataaaacacatattcttttaggaggtagagcattatagttcatttcggtcatctggtaaacaatatgaaaaggaaaacatggtaacatgtgtgtgattagctagctgtaattaaaagtgcaatcaaggcaaagttatggatgaatctaccacgtgtaaatatggagtcctctctgttggcatgtgattaattgtaccactctttgtacaatctgctctggtccatttacaatatcacatctgaacgtactgattccaattatacaccgcgatatactatatcttttgatttaatggaggagaacatgcaaatatgcaattcaaatggctcaagatgattttcttggaagagagtagaaatgagatcatgcatacacatgagttaggaactcatcccgcgcatacgcaaaacggacaactcattagtacatgattaattatgtattacaaaacagagtagttattttttttagaatagtactaatatgatttttaaaaataacttttctatagagtttttttgaaaaacacaaagtttagtaattaaaaaaaatgtacgcgtgaaaaacgacaaacataaggtggaaaatatggctgccgaacagagccaaaatcagttgcagtgtgcagaggtgtcagtgactcatggattagacagcatgccaccaaaacagagaaaaaaagagatagcaatacgattactatgctagtctcactggcacgtgggccatgcagctgacgcagcacagcaccgtgtctcaagggctgtccagagtttgtgtgggccacaaactaactacgcacagaaggttcaatgggcccatatttgcaatccgttctggcccaatacctgacagcccacagcaagcccaccagagagctgggcccacgcgtcagttacacgtagcgcgtgtcccctctcgtttgcctccgaatcgggtaaagccgccggtggacggaatcgacggcggagatcccatcccttccccttcgccttcacatattccttccccctccaatcccaacacagcagcagcaattctttacttaccgtctttgcaaccttatccacctcctaaccactcactgacatcttggacccacaccccagatctagccctccccgcgccgggtataaaacccgtcacgtttccccccatcctttaccaatgcccccgtcgcgagcgcgtccacgtcagcaaagtccctgcatgacccaccggtgacactgccaggtgggtccttcttcctcctgggcccacagtcagtgactacgcgtagcggacgggaagagaaaaggtaaattatttactcttacgattacgctaatttcctcgcgtcctttgcttgcttagattatccccaaaaaggaaattattaaactcaaaagactcttgtattttctctccccttggttttgaattcgctcgccgccgacgcgggtggcttccgtcgagaagcttctggaagcttccgggaccggggcgccgtcccccgcctcggcgttcgtgcgtgcggcggcgaggcggcccgtggctcggcgatcgatccgttgcttgcttgcttgctgcgggaggaaaggtattcccctctcgttaggattcgatttcccgtacacgttacgaatattagcttgtggttttagatgtggattaggcggctgctgctgccgtagtagtagcggagctgcgatttctgcgcttcggtggtgtttccgctgctgcaatcgccccgcgcgaggtggcgttcggttcaaagctgtgcgcatttggggagatttgcgagtcaaatgtagcgattccctgtgtgctccgttgatttatccgcctaggtaggcattagactcgtctgaattgcggggagcggttttggctgttcgtttgatttctacctgtgtgcttccattttattcgttttcaaacttccgaaactaatatatgttttcagcatgtttaggttatttggtttggtcttgtctgtactagtaatcatgtggattcctcctattgcttgtagtgcttgtagtaatcaaaagggttcctggaagttgctatgatgctaccatgattgaacactgcacttttaaatgcacaattgatcatgcagtaggaaaggagtgcttccatttattcatgtctgctgttctgcaattgctcctgtaaatttgatgctcatagtccatctttgttttcctaggccatttttgctcaaaaaaactgtataccccatgctctaacagatgtttctgtgaaatagggctcaagatggtcgtctcaatcattaccagagctttaatgtaagtagcagcggtagtttccttttaatttctggaaaggggcaatgattttggccacacctgttatgtgttttgctatcttttgattttgcagacttattcttggatatgcatacccagcctatgattgctacaagacagtggagctgaacagacctgaggttgagcagttgcggttctggtgtcagtactggtttgtattggacaccccctttactttagactatcattcttggatttaattctctacttgatcacatgctcagtgatgattttacaggattttactagcagttctaactgtttttgagagagttggggataattttgtatcatggtaatgtggccatctgttattgtggttttttttgtggttgcagtttggagggaactttcatgcttgctgatgatgattttgttatcatacaggttaccaatgtatagtgaagcaaagctggcatttatcgtgtatctatggtatcccaagacacaggtatgaatttcttatctctttttaatttcaaaatcgtatggcttttgtaatggagagcattttcagggcacttcctatgtgtatgagtcattcttcaagccgtacattggcaaacatgaagctgaaattgatcgcaatctacttgagttgaggactagagctggtgatatggcagttcattacttccagaagatcgcagactacagtcacacaaggttctatgaaatcttgcaatatattgcttcgcagtcagaggctcaaagatctcgtcctcaggtacttcagaaaactcttgaagttgcttgccagccataatctctcagttacttccatttgctggtggaagttagaagaataggtctgcagcatcgtctctctcttgggcagatcggaactagtaatcttcatgattcatgattgtatttaaaatttcagaatcaaatgcatgcagtaacatacgcattcagcaaatttgacatacctatgaggttatgacctattggttctatattcctttcagccctgcatttttcacatcccatgtctaccattaggtatttaggttcatatttgtgttgctgttgatgagatgcacaatcattttcataagtaagacttagcttaatcgtggtataaatgtactaccaagcctttctatggaaaggtctgacatatgcatttcagtgcattttttcttcttagtgcttgaagaatttgggttactatatgatatatgaatttgattctgatcctgtgggatatttactgaactaacaatgaaaatccaacttaaaaataatatcgcgaggttccagaaagatagttaacctaatgccatttcagtggattattcactatttctctatcagtggtaccttttttgagaacttatgtgcagctgtttgaaaggctgtgtttgactgcttgttgttgagaagttcacgccaactgaatgtatatgtccggctacgtgatcaccatctagcgacttacatttttcttgtttgtttcatcaatgggtctgttagggggaaccaatagttttaaacacagtagcttattttttaaaatctaaattaagcattgttcttagatgtattagtaatatctgttgttagctggtgtcctttatttctctggattatttctgagcttaggagcttgagctaatttgaccatgctgaatcaatttcttaatatggtagttttactagttcttgttgtaaggtgctggaaagtttctaaaattgcttcagcaagagaagcacaaccaagtggatccgattcatttaggtcgtgtgttattgtggttatcttttgccaagctcccttagcagtgactcctaactagggaagttattttgcgccctaattccatctgtgtttcaaacatgaccctttattttattatcttaacttggttaatcatggtgctgattttaccctccaaataacctgggtccacgaaccaattgttttttgggtctctaggaataggatgtggaaccttgctgatgtcgaaatggacctattatatgtttattaggagtaaatgtataggcgcttcatagttctgaagttgctattttttgtgttccaacctttcttgtcttgttattttaccatatttataatttttttgactgtttcatataaactattcattttgttacatggaaattaccgtgtatagtttggcaatgcaaatatttgtggtcattttctggcagggttcaagttgaacatctccaatttatttttgcttctagcaaagttttttttttttttgcagggatgcttctagcaaagtttgtttcatgcacattttttctcatgttaaattattactaccaccatcacactcattatgatgttacactactcgtcatagtactaatgtatgttcagtttactgacaaagtaggctatctgggcacagtttactgacaaagttggttaaattaaaactaccaccatcacactcattttcagtttactaatgtatgtctagtaaagttgttgacatgatgcatgattgagttgttatctgagcacttagaggtgtaatatccgcttcatgtttctcagttgtatgttcagatgattgtttttgaactagatatttattactaccttcatattttaatgtatgacgccgttgactttttatcaaacgtttgaccattcgtcttattcaaaaaatttatgtaattattatttattttattgtgatttgattcatcattaaatgttctttaagcatgacataaatattttcatatttgcacaaaatttttaaataaaacaaatggtcaaacgttggtcgaaaagtcaacggcgtcatacgttacgatacggagggagtatttattatcgcgtgatgcctgcatcagcttatatctgtgtagagctacgacctgactctcaacgtctctgtttctgcaggcacagcaacaccagcagcgtccaccacctccacggactcggcaggtgaaccctgcaccgccgcctgttccttcaccgtcagcgcctccgctgccgccacagcctccgccgccaaggaaccaagctcaagctgacaaggccccaattccggtcgcccctccaggcgccgccgtgcctcctgcacagccacagccacagccacctcaagcaggcgctgaagccgtcacaacggagagcaccgaggcgacgcaggcggccaatccaccggcgacgacggcgagcaacccgcatcaagcgccggtaatacccgacgaggagacgctcatccaggaggcgatccggatgacacggagccggctcaggaggcgcatgggtggagcttgaactggaccgccgccgatgtacgtaaagctcccacgccacgggatcatttctcgtcatacgtttcgctctcgacgcagggtgcacactgcactgcatgcacatcctgaaatctgaatcctgtgtaaaaaaaaaaaaacaatctgaagcctgttggtttcgtttcgcggtttcgcaattgtgtatagatcccaccaggtcaccaggaagtagaacagtagattgatggacattgtgatggcacgagaagatcagtaaccgagtacattggtaaagaaagaaagatacttggttggtagatgatatgtgaatgtgagcaacttaggacaattgtccctcatctccttgccctgtgacaattgtcctttcctccttgccgacgataagatacaagctgattcttttcttttctatcactctcaagatactcttcggcctgaaaaaattgaggatatattgccaaagctgaagtcacatctttgtcacacacgagaatctcatggtaatgcaagaacttcattgtctgctaaggaaatcaaagtttgcacttagtttcatccctgccaatatgataccttcatatatttcctcataaagtataaggccctgtttagtttgcgaaaagaatttttttttggatgtcacattggacgaccggatgtcggaagcggttttcggacacgaatgaaaaaactaatttcataactcgtctggaaaccgtgaggtaaatttttttagcctaattaaaccgtcattagcacatatgagttactgtagcacttatagctaattatggactaattcgtctcgtgactttcatgtaaactgtgcaattagtttttctttttatttatatttaatgctctatgtatgtatccaaagatttgatgtgatgtttttggggaaaaaaattgggtactaaaccaggcctaaatcactccatatctaaacttccgaggccatctttcagcagacctagataaaagaaaacaacaacaacaaacgaacgaaacttcgacctcgttttatatttcgtttgtgaacttgtgatggcaccccaaaaaagggggaaaaaatgtcaggcaagaagccaacgaaacttcgacctcgttttatatttcagaactaacttcgacctcgttgatagacgatgcttcctatgtgaagatcagctacaggtttacttttgtcattctcgaaagtccctatctgtgtcgctctagttgaaatttcgccaaagcactgagaccaggagccaacctggatcaggtcccagctagctgttgatggcaacctggttggctgcttcctacaaccttatgttccattccgttgtgccagatatttagacatatacagtacttcatccgtttcacaatgtaagtcattatagcatttccctcatttatattaatattaatgaatctagatgtctagatttattaatatcaatatgaatgtgagaaatgttagaatgacttacattgtgaaacggagagagtatcatttgttagaaataataccattaattgttctaaagtaagcgtaattctagaatgtatgcattcaaaccttgattccttaaatcattaataatatatttgttatgaaaaaaacttccttctgattatattttaaataaattttataaatatataaaaacaataatgagacatgtgcattgtgtggatgttcgaaatgacaaagaaaataacgaagccattatagtcgtcaagcttattttccccacataactaaaacgtggttgcaaatgtgggttccatattatcacgtatactcacgtgatcatgtcacatcttgatggggaaaaaaaatcaggagccgcaccgactcaaaggttgcttaggcttcgttcgattgctctggagggggagtctaaaattaattaaatattaattattacaaatttaagaactgaatttatttgtttttaaacaacttctatatataaatatttttttaaaaaattaaatacaccatttatcagtttgaaaaacatgctaatgaaaacgagatagttgaagtttggagttgaagaatataacatggccttagtaggaacttattgttcctttctccgatgatcttcgacctgaagatgggccaggaatgtagtcaaaattgtacatattacccctttccgtattctcgttttataaataggccctctagaaaatttattttaaaatagacccttaactcaacggcattagcaatggaccgaagtatgacacatcggtgttacaaattttgtcgttgagaattgagatcctcgctaagctagcacaaactctatgtcgaattgtcaacaggtggttgccgccaaaaacattggcgcaaacattatacataatttgagaaattagcttacatttagccagaaaccaacgagtgaatggtaatttagtaatctgttgattacgtttacataatatttacatcattacttaagggcatatttgttggttaatctatcagtttacgtcaagctcaggccagctcagtaaggttcttgtattttgatgtcaaggttgatgctgggtttatttttagaacaaatttttagtcggtctatttgtagaacaagaacataagtaggactaagatgtaaaaattccggggtctcgtgaatctgtgatagtgataaatctgtcctaaattgtaatgaggacaagagttcataaatctaaaataggtagtacagcgacaactccccctgcagtgtgaaaaacaacaggtttatggttctatacgtactattaataaacgtgtatgcgcgtgtgaaattgggcataaatacattttgttccagaggaatttggttcagatataaaaggtacacgcatggtgaacctcacgaaatggaacactgttgactgaccagtatgtacagtgcgctccatgtttaacatgcacatgaccatcttgaccaaaactagccctagatactacaaacccatgattgatcttaattaacggcaattatattctctgccctgtttttaccattaacgcttaaacgaaatgttgcgaactgcaagtcgtcctggagcatctccaagctagacatctcttaaaccttgctctccatttacggtcccatctttttacttaatcacggaataagctaaacgatatatttgcaaacgaaaaataatttatgaataaatatatatatgtatatgtatgttcttagtgatttaaaagtataggctaaaaaataaacttcaatgaaaaactctaaaaccaactctaaatttaaagttaaaatttcaaattttggctaatgagtattagcatatcatcttttacccatttgataagctagctagtcaaagattcatctctatatttttcatgtgctctaacatgcaatatcctctccaaactacactcttcattttttttgtgggatccacatttcagtctatatctcatttttccttctcttcagcacaaatgagtgatttgaccagctattattctggcttgctagatttggccagcaaaggagtgattttactagcgggatggctcggtcaaccaaatatagcaagtctcttggtttgtttttttctcggggtttgcctaattttgacgtgacgagagatccacctttcttggagatgctcaaatttttagttgggtgccaatttttttaagtatatggacacacatttaaagtattaaacgtaaactaataacaaaacaaattacagattccgcctgtaaactgcgagacgaatttattaagcctaattaatccgtcattagcaaatgtttactgtagcaccacattatcaaatcatagcgtaattaggctcaaaagattcgtctcgtaatttacatgcaaaatgtgcaattgattttttttcgtacacatttaatactccatgcatgtatccaaacatttaatgtgacggaaaagttggaagtttgatgaaaaaattttgaatctaaacacggccatagtaatgcagctttcgatatttagactgttcggagctctttgttcccaactcctcttttcgttttacgcgcgcacgtttttcaaactgctaaacggtgtgtttttttataaaaagtttctatacgaaagttgcttaaaaaaatcatattgattcatttttttaaaaaaatagtaaaaacttaattaatcatacgctaatggatcgctctgttttatttgcacacaacttgggggttaggaatacgggtttccaaagtccaaacgcagccggctggttgacgaagatgacaatgtgaacgcagtggagtagtgcgtggtggagggacaggagggtgcaacattgtgacatatgcatgcatattcagtagtagtaaggtggcgtatttggatttcccgtcaatcggatctttggatactaatctgagagctactaattgtaacatagagtacttacaaaactaattgcaaaaaataagagctaattcatgagacaaatttttttaacctaattaattcataattaacacatgtttactgtagcatcacatatgctaatatagattaattaagctcaatagatccatctcacgaattagtccaatgttatgtaataggttttgtcattagtctacgtttaatgcttctaattagtgtcacaacatccgatgtggcagggattaaaatttaatccctggatccaaacagagtctaaatctccatcatctagtatatgtttaggttggacattgactgaatagcagaggttatcgttgactctgctctggttcaattaaacaaactaatgttgtatttaggggggaaattatgccaaaattttaaaattataacaagaactcttgtatttgatttagttaatgaaattaaataagtttataatattataataatagtactttttattcaattctatgcatagtatttgttttgttttgttttcaaaataagtgtttgagaaataattgatgatcggagttttaaaacataaaatattattttttttaccggaaaaagtactatacaaaaccaacactgccagccatgtgtgtcatagcaacaggcctaacagaagaccgatggatgggtcagcggatgcagcaacaaatcggcaaaaaatggttccttatctccaggggtatcccttcgatttcgctaattacaacgggaaattccaaaagaaaaactgaaatgatagtagaaatcacgtggtttactgatcattggacagtgggtgatggcactggcctttgttcattccatcgaaggtgacagtgaccggccagcacctgtactgcgagcattttcacgtgttcatgtacccttttattcataaaaataaacattctaagtacttcaaatttattacaaatactaaaatatcatagtactattcgtcttataaattacttcttatttaaatttcgtttatcctactgtcgaaacaagaattcgacaataataaaatagggtagcgcacgagacctaaaagtgaatggatgcggagacaaggatttagacaggttcaggctctctcgatgagatgtaataccctactcctgtttggggatttgaatccgtcgggtgtattatagatctgacgatctagttgtgaattataccccctagagggcctcctgcccaccttatataggatggggggcaggattacaagatagaaaccttaaccaatacgatatcagtttcctaaatctactttacaatattatcaaatcaggactttaggccgttccataatatacaaggaaacgtaatacccaagtcatgatccgttacatatttcataaatataagttatcccctataaccagtcggataaccataccgtgtgtgtatgaggtacccataatctccacacctacatcaacctgtcctcccatcccctatacatttctcattaaatgaggagcgtcaaagttctatcttcttgatcttaatatctacttaaataagctagaaatgcttatatttgtggatgaaagaggatatatcatattatggggatgtttggttattaatgagattggttgacaatatgatattgaatcttatcgaggtaaggtagaagaagacatgaactgattttatgttttattgatttactacgcgatgactttattgaaaaagatcatgctcacaatatcttttttcacttaggactagatatccatattatcaccattagtattataggagtgtttggttcatagccacattttaccaaatgtttagcaaagttcaatcaatctggtctaacgtttagttttttatatcgcttttgtggcatgctacaaaatccttcctaaagtttgtgtaattcaataaggatttcctagccacacaaattatggtaaagcagcacctcagttcaaaacgtttagcaaattgaaacatgcagccaaacaacccaacccaataagacaatgacgccgcacaacgtacagttcatatgggaaagccattttaccaaatagtgatatttttataatgaaaatttgactatcaaaatatgacgtcatacaagtatcataattacttaacacttcacatatataagtttctcaatatgtagattgagttttgagttagaattttcttttggaatgatatgacacaggagagatactcaatattcatcaaaatatttaaatattttttataattaatttgttcgggagtttataactaattaaaccacctgatcagcacagtcagcaactcagcattattcaagcgcttgtggatcccacacacacttcccatcttcgatcttcctataaatgaagtggccatgcattccactttttccatcccatctaaactcgcttgagcttgatatgccacagatcaaggcttagaagagatagctaattactctacgctaattaatccagcagcttagcttagcatagcttatctatggtttgccacgtcttctcgtccttctcctcctccctaattcgtgtgctggaggcgccgctgctccttccagctgcttcggcttcttcttcttcttcttcttctccggcgagccggagcggtggccgccgccgccgtgcagcccacgtccgcccttcgccggcgatctatcccggccgccaagaacttgcctctcactcatccatgctacccaccgacttcgacatcaaggtaagctacgtaccctaattaaacaattatttaggtagctactttctctattttgtactattatagtcattttgttttttccaatcagaatgtcaaatatgtttttatgctactcccttcgtagcaagagttagaaatattttatatttaagttcttttgcaaataagttgttactatttgtaagtctctatatatgcaagactttaatagataagtaaattaaatgtttgatcagagatcatccgatgagtcatcttaatactcattgcatttgttgcatacgtgtgcatgcaattcttgatctttgctatatgtagaataagttaatttttctttgatcatggtgccaaaagtaatatgtataatttttatgaaagaagggagctagtatgtttgttttatattaaaaatgttattaaaagtttaacttacataaaagtcaaaacgaacatgttatcaaatagtgaaaattaggtagctaataatgaacaccatgcatgatactactaatcaatatatttgattaattgctaatctagctcgtgtttaattgatctgcaggtgttgattgagcggcacgaagccctgacggacgacgtgcaggagatgctgcagcatcaacgccggcgacaccagaagacggcgagcggcggccgggagcggatagccaccgtcgaccacctcaggcgcctctgcatggaccactacttccaagacgaggtcgacgacgccatggacgcctgcctgctcgaggagctcgcccatggcggcgacctgcttgacgccaccctcgccttccgcctcatgagagaagctggccaccatgtctcagcaggtgagatgatcactctttatgtgcgaacgcgcgaaagggttgcacgtcaatactttagaagaaaaaaattatagttacacaacgcaatcagctagatcggcttataccaggagaagggagaaaaagcaaaataaaaagctgaagcttaaaaaactacagcggctaaatacaaaactccaagcagttgagaggggccgagccacgctacactcccaacaaatcccaaaaacggcaacaccagctaaagaacacagatggccctccgagggtgtgagatgatcacacactaatgatcatatatcatatgttacagattaatcaatcaactaaccatgattaattgtcaattgcagatgaggttcttggaagattcacagatgataatggcgaattcaggctcgattacagaaaggacatcagagggttactcagcctgcaagacatatcacacatgaacattggacaagaagcctcactctgcaaggcaaaggagttctcaaccaggaaccttgaatctgccatcaactacctcgagccaaatcttgcaagatatgtgaggcagtcgctggatcatccctaccatgtcagcctgaatcagtacaaggccaggcaccatctcagctacctccagaccttgcctatccggtgcactgccatggaggagctcgcacttgcagacttccagctcaacaagctactccatcagatggagatgcaggagatcaaaaggtacatattacagtacatacattattgaatcattgatatacatactagctagctagctactccccccgtcccaaaatataagaacataggattagatgtgatattttccaatactatgaatatggacaaacatcatgtccagatttgtagtgctataaaatatctcatctagtacttgttataatttaatttttgttgtaacaaaacaacaatgattcttacttagttgaaacacacttgtatcgaacaatagtacgattcatagaatcatagaaacttactatctccgttctagaatgtaaaaggctttagtgtttaacacggtaatcaagaaagtaggtagaattaggtggtgtttgaatctcctgaagacgaagatgaagataaagattaagtgtttcatacaaacttgaaagatggattgatctgattttttagaacaactttcatataaaaagttttcgtatgaaacgcaccgtttagtagtatgaaaagcgtgccaatttatccaaaagtttatctacttttttagtggattcgaaagggaccttaaatggagagatgttgtgattagggttgtgaacctataattggttggaaaaagaatatcaatggagaaattataatatgttgggataaattcttagttgtagaaaggaaggaatacatgcatagtcatagctacttgctatagtttaatttcctgtattaattgaacaaccgtgtttcttcttaattagttagttgaaacacacttgtatcaaacaactgtaagaatattcataagtaggagtagtaccttgctcttccatgcatagctacttgctgtaattaatttcctgtattaattgaacaaccgtgtttcttcttaattagttgaaacgtgcacgcttgtatatatcaaacaactgtaagattcatagtaccttactcctagctacttgctgagtaatttcctgtattgactgaacaacagtgtttcttcttaattactttattcattttataatataaaagattttagatagatgtaacatatactagtacaataatgaatctaaacagtctgacacatcctagtaccagattcattgtactaatatgtgtcccatccacctaaaatcttttatattataggacggagagagtatcaaacaacaatgtgattcgtagtaacttacatgcatgccaactacttgctgtattaattgaaacaacagtgattcttcctaattagttgagcagttgtatcaaacagcagtggttcatagttaatttgctggattaaactttgactatgagtgtctgaaaatgataatatgaactatgcatgcagatggtggatggacctgggattggctcaagaaataccagttgccagggaccaggttcagaaatggtttgtgtggatgatgacagccatccagggtgcctccttgtcaagatgcagaattgaactcacaaagatcgtctcctttgtctatattgtggatgatatttttgatctggttggcacacgtgaggagctctcctgcttcactcaggcaatcagaatgtaagtctcagcttaagatagataattaacatgagtcttcaacatacatttgattttccctattctcttttttcttattcactggattatttgctctacacatagagatatgatttttcaaaaacttcttgtctagctattttatttcttagactacttattactaatataagccatttgttacatttataatatttaatatttaatttgtccctataatcaagtagatatataccatcaactttcattcgcgaataatctatttagaacagagccttaatttaaattgttattatgattataagtaacaattaataatgatttttttacaggtgggaccttgcagctgctgattccttacctagctgcatgagatcatgcttcagggctctacacacagttacaaatgacatcgcagatatggtcgagagagaacatggagtaaaccctatcaatcatctgaagaaagctgtaagtaatttttcgtttgtgttagaacatttttttaaaaaaatctcattcacaacgaatttgcagcaggactgaccatgcatatgcaatgcaattgactgaactttctttctaccatgtgtatcttgtgcagtgggcaatgctgtttgatggattcatgacagagacaaaatggttgtctgctggccaggttcctgactcagaggaatacctaagaaatggagttgtcacctcaggagtgccacttgtatttgtacacctgctgttcatgctagggcatgatgtgagccaaaatgcagcagagtttgttgatcacatccctcctgtcatctcctgcccagcaaaaatcttgagactctgggatgacctgggcagtgccaaggtcaatacctttttctcaccatgtcaaacatgctactcccggcccttcaatttctttaatatagataatgtcgttgtcttctgtacatacatcgtctggctactgtatttggtttatactttaagtatgacttacattttttttcatatttacataattttatttctaataatatgaatagttaaacacatgttaaaaatcaacgatgtcatatttattaaaaaccgggggaagtaattactacacacttatacgtagcaaattaatcttattcttctttgaaatcttattctcatgttttaaatcagcgcccacacacacatcaaagcaatatggtatctctgatatcttctctaaggattgtaaaaatataattattttaaaaaaatgtttaaagttgtatgggagattgatctttgctgggcctatcgtgaactgaaaatgtatgaaataaaaattgtaggatgaggcacaagaaggattggacggatcgtacaaggagctatacctcaaggagaacccggggctcgccgctggcgaggcggaggagcacgtgcggcggctgatcgcgggcgagtgggaggagctcaaccgggagtgcttctccgctagccccagtagatcgtcgccggcgacgaccttccccgccggcttcacgcaggcggcgctcaacgccgccaggatggtcggcgtcatgtatggctacgacggcgagcggcggctccccgtcctcgacgactacgtcaggatgctgctcttctgaattcgatcgattgattcgacctgaattttaatttcatccatgtatgaacctcatcatcgtccatgcataatggcgtgtagagattaattgtggattaggtctttgtaaataggattatagttagttgagtgagggagatagtactggtcgattttgtagtaaataaatatgatgaatttttactccctccattatacatattataaggtgttttagtttttttttcctatgataaactaatttcaaattgaatgaatttgggcatgtaatttattgccaaagtttcattttggattactctttaacttatgtttttattttggaccatataattctacattaatttgttgcactttagaccacttcaaaccactttctgtaaccatatatcaactctagcactgtaataaactccctcaccatgctcaagccacaattgataattttgttggcagagtggcgtacatggctagagaaagccttaggatgataaaaaaaacaacaaatgtaaatttacctagtacaaaaatgaaatgattagtcaaagggtggttcagagaaaagacttaacaataaaatgtggtaaaaaagtgccattcactctctttaattttcacagaaaatatagcaatattttttacacaaaacaaatatatatttaatggtgaaatgtagatggtgctatgttttttcataactttgatcgaacttgaaaaaagtttgaagttaaaacaaaccttttcatgccctgcagcatggaacatagagacgcgcaatttttttttctaaaaattatgggcgtgtatttggacaatggatacgaataaaaatcatcaagagccttttgcattcatacgagcgcataataaacttggagtcgaaatactaaaaaatgtgaaaattgaaaacaaaaacatcaatatgaggatgacaagtggggcccaccgggggagggggtcctacatgtcatactggtcacgggccgtgctgccaagctgtcaatcccaaattcacctctcgccgtcacgcgaattccggcggcgacccacctgcccggcggccggctacccccgccacgcaccaccgccggatcaagcctccctgccacaaaccaggagctcttcctcgccggcgctctcctcatccacccgtagcaggtgaccatctctccttcgcgcgctctcctttgcaagggcaaggaagccctaccttgcttggatgacttgaatccaaaccggatctcgcttgtgccgatgtgttttggtttcaatcctctactggtattcgcagctatatttccattcccccaccccgcgtttagtccccatcgcgtctagtatgacgatttttttttttaccatagattgggggtttggaagtagattgtatgttggattccactctgttggattgaaatactctaatcattgtttgcagaacccagattggtgaagtttccctggtgtggaaattttttcattgtgctcttcaatgttgtttgtactatcataaacatcaaaagtagttcagattctctgctgcataattcacactaaatgtcccatcacgaaaatatcctctgcgttgttagtgatacactgataatctgatatacatgtgaataggtatggtatagttatctgcggtagaatactatggaacccatgcctaggcttatttttgtgtatgatttggattttagagaggccctggaaatgtgtgaagtggttagaaattttaggtgtaactgtaattcacaggctaatgttctatgtatgtgtcataatcggcttctgaatcttttcaacactgaatggcaatataaaggtggtgtaattttgactcaccaatcgtgaatcatcatggatttgtgaaccatagcattttttgtcatcttttctgcattccagcctgtgactaacattgtatcttacatggaatttcctggaatgcattactcaatctatgatctgcaaaatgaagcccaacagtttcagttgattttgatatttccaagatgcatttctgttaatatttttttatgatactcagttgacaaaagataatcaatcatattcttttttttgttcaaatttctgtcgatgctgatgtatgattgctttgttattttctgtgtaggaatggagaagtatcacagcaactcccgatttgctcccttcagagatgctccatttgctctccgtggtaagagattttcagtgatttggtatgctatctgtccttctgacgtagttacatgatatcaaacaattacaccacagacacactgaattggtaatattggagacatgcatacatctttttaagtatattcttgtatgtaggaggtaaaactgactgacagttgaggtatcccaaggctggaaactacattagagtgtcagtctgccaaatagtggttcagttgagacaagtctaatactgtgctgatttatcaccatatatagattgtctgcatagctcgagatgatcaaacacagccgtgtagcgctggtcatttattatctgaatgcaaaaggctgttgctggtcatacatgatttatcttttatggggacaagagtttatgcgtgtctgacatgactttgatcacttccggttggatataggtgaataattgatgtgtagttttagtgagaaacagccatctctagtgaatctttagcaagcaactgctaattctgtgtatacatgtatagttcacaatgccttcaatcagatttggtaaaatgcaatcaagaaccccccccccccccaaaagttttttgtgtgctcttgctctatgtatgtttttttttttttttgtttacagttcatttcacacaaccaggaattcctcacatttgttgccaccatactttcaggtgcccttggtagctcaggctcatctttcagcagcatcgacagcctcagacgctcctcaacccttgagcaagctagggggtacacatctcgtcccctaggagctgtgcggccaaagatgctcccatctggatgccgacccctgcacacaagccatcctctgtcggctcctgttgctaaccgccccctgtcaccccaccttcctctgaagaagccacagctgagtgctacattctctatctcgcaccgtatatttggtgctgcgttgggtgctgccattatatccattcctctcgccaccaagttcagcctcatgtttgatgtctgagagagaaatgtggtctgcatgatgagaaagaaatgctatatttctgtgactatctcagcatctgaatttgccttgcaatgcaactgtagctgccgttggaataatatctttgctgtgcttgtagacttgtgaataataaacaaaacatgcaatgaccatactccctgtgagatatgatgttttatgctaagtgttaattttctctaccctttattgttctgctgccttgtggaattccatgattcatttttctcctggcaaaaaatgcttgccatgcgtgcaatttattcactatgagtttgcgttgtttgtataatgctccagttgagctgtagttcttttgctgctgcaaggaagggttggagacaattgaaatgcccaatgagcttatagtgctgaattcaatgtcaatgatcattgccaaaaataaaaataatatattttagtatgtgtaaataatccttgctgaaatctaacataactatttgcacttttttttgtatgtacatcatcattgctaaaatctttaataagtatttacactgttttttttttaaaaaaaagtgtttgtctctgttattagtagggggagcagggtggtagtacctggaaaataaaagttcggtgcaatgaatcgcgcggcgaggtcgaggtcgccggaggacgcgtcggtggcggcggcgcggaagctgcacctcctcctccgctcccgggacctccgcccggcgctctcctacctccgcaccctcccctcgccgctcaccctcctccccaaccacgccctcaacgccctcctccgcgcgctcgccgccgccggccgcgtccgcgccgccgccgccctcttccgccgcatcccttcccccacaccgcactccttcaactccctcctcgccgccctcctccgccgcggccgccgccgcgcggcctccgcgctcttcgccgcgctcctccgctccccctccgcctcccccgacgccgccaccctcaacaccctcctccacggcctttccaccgcatccccgcacccgtccactcccgcgctcctcaggctcttccgcttcttgcccgacacctacgccttcgcgccggacgccatctcgtacaactcgctgctctccgctctctgccgcgccggcgacgtgctcaccgcgcgcaagctgttcgacggaatgcgcgtcggaggagaagaaggcagaggagctgtctttcctaacgttatcacatacacgaccatgatcaaggcgtactgcgccaagaggctcgtgaacgaggctctcgcgatcttcaagctaatggttgcggatggtgtggcgccgaacaggatcacatacaacacgatggtgcaggggttctgcgatgccggcaggatggagctagtgaaggaggtgttggagatggactcgtttaggccggacacttgcacattcaacactctggtggccgtgcattgtagggaaggccggatcgaggatgctatgaaggtgtttaatcagatggtggagctccgtgtgagacgtgattctgcaagctatagcatggtcatccgggtgttgtgtgagaatggggaatttgggcaggctgaggagcttgtggatgagctcttggagaaggaggtgctcaagaagagagggggttgcacgccgctcattgcagcgtacaacccggtttttgtgtacttgtgtgagcatgggaagacaaagaaggcaaggatgctgtttgggcagctgctggaccggaggagcaaggtcgatgttcctgcattcaagacattgatccttgggcattgcagagagggtgatttcgaagaagggtatgcattgctgctctcaatgttgaagcgggatcttgtccctgatgatgaatgctacattgccgtgattgaagggttttcacagaggggaaggatgaagtttgcatgggaagccttgcacaggatgttgaatagcggtcttcggccaagcacaagtacttttcactcggttcttttggggcttttgaacaaagatggttgtgcaaaagaagcagctgatttgattgagataatgctagagaggaagattcgccaaaatgttgatctttcgacaaatttggtagatacattgttcaggaacaacctaaatgaccgtgcttacaagattgttacatctctatatgaccatggctattacatcaagatggaaaagttaatcgcaaacctttgcgaggaaaagaagttcatagaagctgcagattttactttgtttagcttggagaagtctcagaattttggtgtagccattccaagcatggttctggatggtctttgcatgactggtagagcttcagaagcattccggctgttctatgaactcattgagaacagaagtgctttggcttctgtcgctgcacctcgtagtttagttgcacttcatcatgcactggaggaatccgggaaaatgaaggaagctgattttattgctagacagatgagacgtgcaagtgccagaataagggaaagaatctagtgggttgctttgtcccaaggagcatttcaatcgcatgccctttgcttctccaaacaggatggactaataagtgtgaacttaaaagaacgaacaggatgcagaaactgtgcctgatccactgccccataagaaatggatcaaccaactgtatgatgttagaatgcagattaattcagcagatatccttttttttttcagggaaactatggcgggtggattagcaccggcctgaacatttattgataaataaagagatagttacaaataaagataatttacatggaggaaggagaagttgcttgagaattcagaaaatacagaggggggaggatggagtttaagaaattcctatgtcactaagattgttcatccaggtgttcagagcggggcgtagatgctccgggcagcggtgtacccataattcagcagatatccttaaaatattggtccaatcaggactttgtatagccaaacaatcaagccaactttctctgtcactatagtatcaccgatctggatcatttcttctcaaggattgatatctttgggaggaaatgaagtgtgggaagaccagatcacaagagtactctgctcctggactttgaagggcagtagttgcgggagaccaaagaatccggctgaaagaaacatattgtgaaaatgtactgctttccccccccccccccccccctaaatgcatgaggcagagctccttgccctttgtgctcaaaaaaaaaaaggaaaagaagaaaagtggggaatttaactatttgccacttttacatttgacaattaaccaaatacccttcttaagattgtacttaagaatttgccattagagagagaagcttttgtaactttttgccactttttgccctgtggagtgccacatgtgcatgccaacatggaccaacgtgaaaaatgaccaacctaccccttctagctagtggttagtttctcagttgctaagcctgtccgcattgaatcttagtcataattcattcactggaaagataccaagagaaaccagcaacctgcccaatcttcccattttacacttttaaatttataaggcaacaacatcaatggcaccattcatgttacagtcagttcattaactttttgaggctgcattcggatgtcttttttctaacttctactcacagttattaggactgaccagaccggcggttggactggaaaaaaccggaaccagggcctccgccggtctgagttctactccctcatttttttcgcacgtttctttaataactttttaaataaaattaagttactttaaaaatatatattaatctattctttatttattaaaactcaaactaaattagtcatgcgctaattctttgctcagttttacgtgaagagagaaatatttccaaaccatgctatcgcacaccttaattgagctcactccaggtggcaccatcccaacaataccagccaaattggaataccgtttagcagcttgaaaaacgtacacgtgaaaaacgagagagatgagttatgaaagtgaacaaaagaactcaatctaagtatcgttttgaaagtttgttataaccatctcagtggatctattacttcaaatattgatttgttaactgatgtggaggtactcggtctttaatatagtacctcataaaagtgaacagcatccataccgatgcaactgattcgcgaaagcaatttgtccaaatattattcctgactcagcttatattacagacattactaacaagggtagattagtcatttcgtgtgcctggtccatgctggcatgtatatgtggcactgaacagtgcagaaagtggcaaaaaattacaaaagcttctctctccagtggcaaattcttaagtgcaaatctaagaagggtatttggttaattgccaaacctaaaagtggcaaatagttaaatttcccaaaagtgtgaggcaatttctatatcaagcattattattttggaagacaggttggctaacttaccatcagtctgcctatttctttacagaggagtgaccttagctcgactagcaaatattcctaatactttacagaggagtttccttgccagttgccacaagatgtattggttgatgtgtctgaacgtaaagaatcatactacaaaattccaatttcacattgtcgttctcctgttttgatgctgtttgtgagttgtgatagccgtgactcagtttatgtgcatgcattcagatactttgggggctcaccacagaactacacagtatcctgccaactcagttggaaattgaaacactgaaatgtgagaagtaggagatgatcataagaacattatgttccttcacccagttatttagcacagaacacatttaatcctactcggcgcagagaatcaatggaaaacgcgtgatgttcagatctcacagttccaaggaaaccacgaacaggtatataacacgcaatcacatcaaacgttttaagtgttcaacacactcgaaatactgagtgaattccaaggttactaccataacaaacagttctggtatcacgtctctagtactacagagatattcaccaccacaggaaagctgggtaccgccacaggaaagctggattcagcatggtaggcagggagaaacacactatttcgtgaagcagtgtcactcaatagattgcaacactcaagtaatcccctatctgtgaaagaacatagcaaataatcaattgatttttgcctcagaagaatacattgtaataacataatacagctctgacaaatacctggaatcctagctctgcaagagttttagcatcatctccccttccatggccataagagaaggttgaacccaccttcaatcaatatccaattatataagttatcacaaattgaacagttactggtttggaatataaaggaacatgggttgtacaagggaatttactgacatatttagtggtttaatggcacagatagaacttgtaacaagctacgttttagtacagagacaattatcacgatgtgactgaagtggctactggtaagtggtaactacatggggcctagtggtgtaccaatgacatgtgttaggtatgcatacctgagtttgcagaaaagagattttgatgtcattggaagcatgtcatgaatataagcacacaaaatagtaaccataactaaaactaatagcccatgtatagtgaccaaactaatagccaacgtatagtgacagtcaaagcaaaatccaactcattcacgataataacactcattccctattcagattaagaccaacgtgctctgcattttttccatgtttgtgtatcagaggaagaaaaacaggatgagcagaagaatagtcacaatggtcaatggggataaactctcacctctttgacaacgaaacgaccatgcttatcagggtacacgaaagcaaaagaaagccttgcatttctttttcttgctgcaagagcaacctctttcacctgaaacataaccaaaactgtgctgatcagatctccatctaaaaacaacatttagtcaaacgtagtgccaaaccccacttatcatcatcagactagtcaaattttgttgatttctagtttgttaagtagtataaaactaggtaaaatttcattttccccaaagaggacaagaaagcacaatattagaaaaattacaagatcagtgagctctcggagtgtggcatccttccacgtgtatatctgcacttcatctttcggctcctttcctctcacggcaaactcttcattttggtgatggccaccaacctgaaaataaatgaccagtaccacaatcagctttctgtgtcgctgagtgtttactcaagaatctgaagtctgtcctaaatgaatggcttgggatttaattttcaacaacactaccatgagttacttgatcgagttatactgcatagaagtgtgactcaactacaagtgcgatatgaacattacaattccatcaaggcaccagaacctatgattcggtaagattgcacaatgcaaataactagcgcaataaagtttctgactatttatttaacttgtattcaaatgaacatatgctctcctcagtcaaccacactaaacagaagtgtaaatcacataatgtgaacttatcatacatacaggaatacaaatgaacgaagttagcagtaagagagataacaagaggttttacctttgtgaaaacccggagcaggagagggcacgtctgcaaaagaacccgatagtgaacagtaagtaaacaaatcaatcaacatggttaacctagcagaatcgaactggaacacaatgccgtcgaatcgcaaggtagtacgcaatctactgctgttccagcgcatcgattgggaggggggcacggaggaggcctcaccttctcgcgatcgacgggttcgacgcgcgcgcgagccatgggaggaggcccccggtactgcatcggcggccctggccgcacaggcctcatcggcatctcgccccttcccgccatcgcaacgagacctccccctgccctgcccgaggaagaagaaagctagtacgaatcaatctactgctccggaatcaccaatcagcaagcgactgaccttgctcacctgctccgccgccgccgccgccgatcacttcagaaggggatgcgagagaagcaaagaaaaccctagtaaactttttgtagattgcaccctgggttcaaatgaaaatacaattttacaattcagtccacctctaaaaaagggacatttaactccatgccacttttaagatgtagcaattaattattagttattcattgtctatgatacgtgggtctaatggcaaataatttagcaccactagtaagagagtaagggcccgtttagttctcaaaaagtttttcccaaaaacatcacatcgaatctttgcacacatgcatggagtattaaatataaataaaaagaaaaactaattgcacagttatgggagaaatagggagacgaatcttttgagcctaattagtccgtgattagccataagtgctacggtaacccacatgtgctaatgacggcttaattagactcaaaagattcgtctcacggtttcccggcgagttctgaaattagttatttcattcgtgtccgaaaaccccttccgacatccggtcaaacgtccgatgtgacacccaaaaattttcttttccccaactaaacacaccctaacaaaatagttaactattactacctccttccctaaatgtttgatgccattgacttcttttaaacatgtttgaccgtttgtcttattcaaaacttttgtaaaatatgtaaaactatatgtatacataaaaatatatttaacaatgaatgtaggaaaagaattaataattgcttaaatttttttaataaaataaacggtcaaccatgtttaaaaaagtcaacgggttaaacatttagagatggatggagtaccttaaaaaaaagcgttgacttgttgaccacttcgttgaaaaagccaaaaaggaatccgccttcttctccactccacttcactcacgccttcctcgccccgcgtcgcgaaccaccgcgcgccatggtcggcggcgagcccttgcggcggcggcggcatctcgccgacgatggattcttccggttcctcctcccctcgccgaagccggccaccaccaccaccaccacccctcctcccgccgcgctgttcgtcccgccccaccgcctcatcgcgccacccgtgccgctcccccagccaccccgccccgaggagcgcctcttcatcgtgccccccacgcgcccttcctggctcccgcctctctcgatacctccgccggcgacggcgacggccccgccgccgactcgttgccctccgcggcggatgggcaatggtggtggtggttgctttggcggccggagtggggtggtggggtggaggtatggaggtttcgtcgggaatggtggacgtcgtggcttcgagcggcggagggtgggaggaggcttcatcggagcagcgaatgcaggcgaggccaccggcggcgagaggcgggcggtggtgcgtaagagggagaagaaggtgtgggtcgccgtggagaagaagggcgaggactgcggcggcggggatgaggaccaggcggcgatgggcgcgggctatgccggtggagatgagagggacgagcaggtggacgtcgacgacgacgaacaagacgacggcgacggcgatgaccctttcgacgtcgccgccgatcacgacctcctcgccgtcgtcgccgatggcgccggcagcgagaaaccaatggaggtagaggaaaactcgaccgagacttcaccgacgcttcatgctatgaaactcttcaccttgctctccctttcagcagctcggatcgccgccggatcaaccgccgccgccgccgccgcgccagcgagtcggaacgcggcggtggagggtggaacgccgccatgacatcgacgccttcacgcccggattgctctccctctacgaatccctcaatccatcagaggagcacaaggccaagcagaggcagctcatcgaatccctcacgaattctgtgagcaaagagtggcccaacgcccagctgcatctctatggatcgtgtgctaattccttcggaaattcgcatagcgatgtagatgtttgtctccaaattgacactgctgcagaagagaacattgctgagcttcttctcgcattagcagagacattgcgcaaggatgatttcgacaatgttgaggtaattaattaattcttctccagatatatgcaattttgcaagcaagcatctcttccaaatttgaatgattcatcattacttgaaaaatttaatattagctgcataattaatctggaactggaatgtgaagagctagttgcctcatgtaattcttcataaatgccccggtggaaaaaaaattaggcccgggaaaaaataattcttcataattgatgtatttgaaaaatagcttcttaattgacgcaggttgagactgttcatcttctaatgcctgtcaaattcatgcaggctattaccagtgctcgagttccaattgtgaagattgcagatccaggaagtggcttgtcatgtgatatctgtgtcaacaatctctttgctgttgctaacacaaagcttctcaaggattatgcccagatagatgagaggttgcttcagctggccttcattgtaaagcactgggccaaactaaggggcgttaatgaaacatatcgtggaaccctttcgagctatgcgtgagttaaacgactttgcgttcatgattttcccctttttacagctatatgttatttgttgaaaatcttgaacctgatcttgttcttattaatttgcagatatgtgcttatgtgcattagcttcttgcagcaaagagagcccaagattctaccatgtttgcaggttctataccttactttttatctcaccaatatgtttcattcatatgaactactcgctgaagtactgatactttggatgcacacagtttaggataaaatcacttcacgcttgcttcatctgcatttagactcatgatgctgatacaggttaaacgaatggtctgcacacatttttattttcattttcatttttttatctctaaaatacttaacttctatctcttttatttgctggtggaatcgtcctgatttcgcattctcccttcatatatgcatgattctgttttggatggctcgacattcaactatggttggtcaattttctttcctttcttttcttttttttttcactaatgtagcaggtccattttttattctctttgattgatgttactaagagttgcttgcgtctagaattgttcagatgaaatcaggatctgcaaagttgtatatttcagcttcatctatgaattacttccgtcagttttatcctgatgcaatttgtcctctcaactcactccaattgtaggcgatggagccaacatatactgtggttgtcgatggcactgaatgtgcatacttcgaccaagttgaccagcttaaagattttggtgctgaaaacaaggagagcatcgccgagttactgtgggcattcttccactactgggcattccatcacgattacaggaacgatgtcatctccgtccgcatggggaacacaatcaggtgagaattgccaacgagcgtttctcaaaaaccgactaaacttcaaaaattcgattttgaactaatgtcacatatgcttcaaagaatttcgcgtcctttttaacttggttcgatctctggtcgatcgatagcaagcaggagaagaactggacgactcgcgttggaaacgatcgccatctgatatgcatcgaggatcctttcgagaccagccatgacctcggtcgtgttgtcgacaggcagacaatcagggttctcagggaggagtttgagcgagctgccaccattctgcagtacgacgatgacccttgtgtggctctttttgagccctatgattatgaatcttgattattattattagcacataaattaataactagcctggaaaatccagaaaacagtagctatcctaattctaggtagtagtgaagatccagtagcatgcttaaaacacttggtgaacagaagaacaacagcaggttgcattcaagtatgtcaaatttgatagaaagttggatcttaaaatcaaaagtactatgccaacccaaatttttcggaatgcttcccaagacctgtgaggcgtttcacacattctaagaaagttggatcttagaattcctttgtttttacttacagggcaatcctgaagaccacaaagacaaaatagggctttacttttgaagtggtgcatgcataactgaagagtaaaacaatcttatgctacaaaaaccaaaacaatataaaattcatcaccacgcatttagatggaaaaatgtttgtgtaatatatgaagggggtggctggaaattaactgaggcccggaagaagaggagcgatttgctcccaatgagaggccgggaaacctagaccaggccaggccttttaaagcccacaaggcctctactttctcttccagagtagatgggcctcatttcgacccagcccaagatgaagcagagtctttctcttccctttcttttaagagcaaaagcagtgcatcttatcttaaatctaaaatttgccacaacatgctaagctaaattttacacacgccctagtttttttttttgcggttatttgattggtgccacagttttagctagccacattacttaaatgtaaaatttgatgatttgacactttatttcttgtcactttaatttttaaaattgatactttttaggatgacgtatgggaccatgtaagtcaatgaaaatgaatgttaagtaatcgaaagccagctgagtgaaatatcaaattatcacatctcttagaacacatggctccgcatgtcaaaaactcgatttcttgtatataagaatgcataaaggtatggccaaggtgagttgcactgaagctgtgaattagtgacccgaagaaacaacagctgcattatgtggcgtgcacctcaataatattcattttgtgacgcagagctagtataagatattgacatcttttcgcggagaaagatgtggaaatttttgttcttatctatttttgctttcttctgcgtatgctcaattaactgctctttgacagccttcgtgtttgacagtggaaaacatttccttaccgtagcaataatgttgcttgcaggtataattcctaggacaaaactatatactactacctccgtcccaaaatataacaatttttagctatgaatctggacacacagttgtctatatttatagttaaaaatgcttatattttgggacggagggagtatatcatgacaggagaacgaattctaccctacaacttactgatttttcctggtctaatcttctgggccatcatgtcttgaattccgttccaaagatcatactatgaactaagtgcagcttctgtatgagagctgaggtgccactgatcagcagagattgcagaatgatctttctgggcttatgcaactcttttcatctttgttgtcacctcaggaaaacctataattcatactacttcttatgtggccttcaccttgacatactcatcatgatggttattgaagttttcgttatatagcatgcccgttggagaaagaagccgttgtaaagcacttccaaaccgaccctggaaaatggaaacagtattaaaatgtggccaggaaacatttggagtagcgagacattattatatagtgagaagtaagataatgcaaaaaataaggctcgaaacgatagtctgttatctttggtagggaactaaggatacaaatatgagaaaaagaacttgatatattgaaatggtcagatggccttacccactgaaacaagacaagtatccaccagcatccaggcaaactaccaaatttgttgcgaatgatctgttaagaagaaacgagatcagagaagtcgatcattaggatgtgactattgttatttgaacaacaaagaagattaaaggattttcaaattttggacttaagttcttttagttgctagacagccatcacagagctttatgaactgagtgacagcattcaaaagtaggaagaagatacaatgttcacagtaccaatgcttttttttttctcaagctcattcaacataattgaagtagggacaaaaactccatctagcatcgatctaaagaacctatatctaacatcagtacctcaccaaaggagaaagaaaggaaacagtcatacggtcataccattagtagaaaggttccaatgccaaagcatgctcccattgattgactcaaaaacctgagatctcttccagcctgagaatagggagaaagtaccaagggatgtcatcacatttttccagcacgtgccatattcgactttgcattaatgtgctatttatctactccaataaaacgtaaaatatgatccccacttcccagtgttaaactgctagaaacctagtgccttgagccatgcttactagggaagtaatggcacttggaacaagtaaattcattttgacaaggttttcccagactccaaatgtactttccaggataattgctttaaaagtcagccaaaacaaatatatcagcttaccaataatgttccttcaagactatgcactgaaggtgtcaccaataatgcacagaaatatggaatcagcactttatgcatctgtcaacagggtaatggactgtcagtaagttctagacaaaatcgaaagcatttgagactgggggtcgtgaaaataaagcataaaactttctgcagatagactgagttaagccaaggccacgtcataggagacatgcgcaataatatgcaagtaaatttattttacaataatatgcaagtaaaattctatttctctatagagcacaggaaactaaatgtatataaattgaaggtaaagtaattatctaagatcataaggaccaccctaactggacctatgagtcagaatcaaccttttataatcatcatccgattcagtgaacagattctgcaagcatttacaaatccatagtgtacacaaatgatacaaccaaagtatcatatagagcagatgatgccaaattagatgactaacatcagatcagatataggagcactgaattttcttttcttaacagtgcaactgagttagattctaaaaggataaacggtactattgatagataagaaatggtagtattgatagtttctggcatagtgagaagcaatcagaatcgaatgcacttccagaacagtatgcagaatattttataagttatagagcaaacctgttggacaaccataaaatcattagtaaagagactaggaaaaagccacggaacaagtgttcctactgcccccacagtcgttccagttattgctccaatcatgacaagtgatttcaatagcatccttgcctggataaaacggtacctttagactttagtgtctttgtagtaatgaacttaaaaatataaatgcactttaatgtagaaaagaattccagtagaagatatgcactatgttagtcaatcaaagcaccatcagtgccgcacaggatgcatcaagtatgtgtaatgatgctgagcgtacaagcacaagcagaagcaactgttactctagtacaggaaaagaaggtatgtgtatggcaagcaaatgtatagaaacccttgatggcaaatgcacaactccgattcaaatatttattttagttcaatggtagttgtaaaccgtaaagatgcctcatgtcctaagaggcagcaaataagtgatgggatcaagcttttgttaatttcaacgaacaggattaatacaagagtctcagttgacctcttgcttttaccttcagccttttaactgtgtatcaaagctataatttttgtccagttaaattcgacctgccttgaccgccaataaagttgatatttatttgtggatagttttgcagcagatgtaattcaagattctaaatgatttaataagcttagtttgtgatatcagcattttatttagaagaaatgtgagaaggagcatgtactgaaaattacactgttgaaggaaactttgcatatcagttcggtttatcctaagttcttgaccagagaaaagcgtaaaaacatataaagtgtgcaagcatacatcatcaagctttacacatgattcctttggattaatatatcactaaggacaataataatgcagtacagaaattcacgtgaaattgagagctttagataggtaccttcatcaaattgcacttagctccatatatcaactctggcatgaatgactgtgcagtttgtgacaggggctcaccccaaacagtgcacatgcataggacattaaccataaccttcacagcatagattattttgtatgttatccacagaagaaagtacatagtagcactgtgttttcatcatgggtaagcataccaaaagttaaaaggtatgaacctggtgggctgcaagtgttattgctcccatagaagttgcagaatacgtaagtaacgcgtaaaatgctacctgaatggtttcaaataattaggtatagtaaagttgaggagaggacatggaatattagaacaaaaaaaaaagcataccttggaggtcattgttatgaaaacaggagctgcaatttcaaaaatctgcagaagctcacttgatgatgggattgtgaatgaaaaagctcgaaatcctctcttatttagattttgcatcatcataaaagctgcaacaatctgagtgtgtgtcaaaaaatagctatttatgaaaataatatgttgtcagaagactcaattgtgtaaataaattggatttttgtttagcataacaagtagctaaatgtctggcatacaagttgagtagacaaatcataaagaaagatcgacatggataataatatataaaattatgagcatgtggttccatcaaaaacataacattttacaatagataagtgattgctttataacttaactaggtagcatatcttactagaagatcaagaaacatttgtttttgttagtaatgtggtgtttcatccgattcaagtttcaaagaaaaatcaggtagtgtttattaaggctaagcattggtggcaatccacatcttgccaagtctaaagaatcatgctcaagtaaagatgtgcaagaagcaaggtatgatgaggtgattggaaagtatgcctacctgtgaaaccatagttgcccaggcagcgccagcaattccatatccacatacagaacagagaagaaggtccccaacaccattgataacactagcagctgccaatgccttcaagggaccccaagaatctttcatgcctagactgagttatagcaaacatacagtataatatgagaagcctccaatcaaggtagttgtaatgtgaaatcaaatagaagagctcaaagtgtttattgttatcagaaacatcacaaccaaataactatgtagcccatgcgagttggttcaaatggcaatatgaatatttcaatgacgaatagacattaagacaactcaaaacagatgcatctgtaatttggcaaaataaaaggtcaaagaaagaagacatgatagatttgaaggcaaaagaaatataacttctccagaacaaaatagatcccgtgcaacagaagaggagaagaatgagcatggtttttacctagcactttgagcaactaagccaaccagaactgcaggccatgcaaagcctctaatctgaaaatgaatgagtatacatattgatctatgtacttcatataaaacatggaagtcaaaaacttacatcctatagcatagtgcatagaattatcctatagtacagaacaaggtatgcaatatgcctgcagtcagaagcatccatggatttgcataggtttctgaaatcaataggtttgcagtcaggatcatcctcgtgtttgtacttcagtgcaggaaatgtaatcagcgtgcctcatcattcagtatccatacagaggtactagaaaatttcatcatgtttccacttccttgtatatgtatagctatagtatagctctatgaggtttagttcatagatagcatgcaattgaacttttagccatatttgtttatcctcaaaatttattgactatttgactgctttatacagttatattcaagaaagaaacaagcaattcaaaattgccagacaaacatgatttctcttggcgctaccccaagcatggcagatgtccttcaagccattgctagtgagggcgccctttggtgcctagcaggagcttctaagcttcgtgatcttttgtctagggctgtagagctagtgcactaggtttgttttgcttcttgtgggtgtgtggtgttggtgttgtacttctgggtgggtggatgtcagagtttatatctaatgccatccaccttttttcctctatcttgatgaaatgatacgcagatttcctgcgtgttcttaaaaaaaacatgatttctcttgctcattcaactagggcaacaatgaaaacaccctaaacagtgaaattaatgagagaatgctgacatgtacaaacctgtgcatatgtattggcagcagaaatgatatcatagttccccgatccagtaaacactgaaaataaaaatagaggttgcagtaaaattaagaaggtaggtggactcagacatgagacatgtgaaactctagatagcatgataaatacaagggcattcaatctgagaagcaaattaaaaggaaaaaacagaaataaggtgcactgccaaacagggagaaaaacagtgaaggagataatccagtggtgaaagaaatccaccaggttttctccatcaatatgcagtcaggttcttcaaagtatgataaacaaggttgacagtcagtttcatcttattagcacagtttagtttcaacttaccagttaacacttgagtcccaaaaagcttggtgaacaaaaacattcctaaaccacaagtaagagcaacaaacagcaacatagatacttggtgctgtgcaagttcttcatcctgcatatagtaactgtgcttataaatagagtgcggagaaaagacatgaaagtttgtgcgttcattgttcaaagttaataacctttcataaaattataaccaccactaatttccacaaagtagggctctagtaacatgccaagcaccaagccaccaatattctcgccatacagagagttttatagttgaaaacagtttagtttctgaatttctgagtggcctgcaaattgccgagtaatatacatatgtatgtcctgctgcaatgttctcgtttgtagtaagaaaaagtgtatagttcatgcaagagaaatcaaaacattaacttcgaaagttttcaatttcagcttgttattaggcattttttgtacttttgttccatagtcttatagaggaaagggagggagagattgttcacgccgaactaagttataaagctaagtagcttaggttggcaacaatcaaaattggaatgttaaatttgttttaccactaaaattctaacagataaaacagtatgtaaatcatactatcaagagtagctaagttaacaatatatgtttctgataactgcccaagcatagcatattcctgcctatagttgttcatctaacaaagaggaaggtacacctttttagctaaggaggtggccaccatgttggaggtcgcgatcgaaaggaacatgaatatatagcagaggtaatcgcagaacaccgttccaggccctgaaattgaagaaacaacaaccacatgacattgagctgcaaagaccctagcctttgcacgcgatattcatataccacagttcatcagattcagctaattcggttagcaaaatgtcgcctagttccattttggagattagcaggaagcaaacgcagatgacatagactaatttagttaggtagcgagcaaggggagctaggcgttgtacctagggcagcgagctggagggaggaagtctggccgatgaccatggtgtcgatgaggctcatgaggggcccgcagatccagagccccagcgccggcccagcgaacacgacgatgtcccgcacctgctcccacaaccccgccgttccagccgccgccgccgccggctcatccccatccgctcccgccacggccaccccgcggcagcgggcggcggcgccacgggggaggcgcggcggctgtggctcggtaagcgggcggctgaggacgaggcgtgccgcgcgggcggcgagagcgggagtgggcacggcgggaaggcggcgggtggggaggagcgccgggagcggcgcggcggagaggaggcggaggtgggcggacatggcgccgcgctagttgtagcgggagcggacggaacgacgacgaaggtaggcaggcgcgtgccgaaaagacgttagcagtgacaggcaaaagggcatgtgtggttctcgatatgctgctgctggtagagcctgcgtatatacgtctccggtattccaggctctccatttcacttcacacgaatcacctcatttccaacaaaattcctgtgaatttccgacaggaattgcagatgaaatagttttagccttttggcagcaagaggtcgcgcaaaattttcctacacatagtaaaccatccaacattcatcaagttgtgagtagtagcttcctttatttgattaaaggcaacttctgaaattctccgcgcgtcggagaagcaagcttgggatatcatatcagtgaccaacatattacgatcaggaataaccaggaaaacaaacgaggcagcaccaagattcacttgcaggactccaatataaaccagatacacattatactacagttggcaaaaaaatatagatcccaacccatgaacagaccaaaaacacaatgtggattaagaataagaaaaaacgcctatgtgtcgagctcgagcacacaggtgctcttccctattctgtgagagtcaaaatcaacgtcgaacaaatgggcattgttcccatgcaatcgtttcaagtgttcaggtgcctctgaatgaaaataccaactatgccgcaaactctaatctctgcttgccaaggtatacatagaagatgacggttccctcacagccgatcacatgaaatcgtactcatccggatcatcaaaattaccctttccagggatgaaatcatcgtctttattctcaatgtgtagctgcttcttttttgcccctacagatttcgttgcaaacatcagtaccaaaagaatgtgatagaaaaaacagcttacagtttgacatcagcaccgcatgtaggacataaagcgcctttgacctcaccttgtttctttttgcctgctgcagcttctttctcagccttgatcttttcattagcaattgctgcaatggaggacgatatatctttcgcatccgcacctttcaatgatgccatggaaagtctcatgacattcttgagtagacccatatagtggaagcttttctgtatacatgaagacagggatgaaggtcagatcctgcagagacaattccccaataaacgcagatttcaaaatgttcaaaaaacctcatagggacgcagtttgtttgcaataagctctgcatattccgcaaagtcactctcagactttgggatgaaggtatctagggacttttcactgccgtccttctttccaaaaagttccgtagttgacttaaagtcagcttcttccacaagcctacaatatgtattcatcaggtgagcaaaatacatgcacggagatttgaagggcaggatgctgcacaaagctcaaaattggacagtgatatagactaaaatcgggaaacatggtagcggcaagcaaacgggcaaacagcacctacaaagttcttcagcagacctaaaaaaatagcatatacctttgttgacgaagtttctctagagcaggatcatccagagcctcatcttgaactacttcagaactagttgatgcttgttgttttcctttcttcgcagcacctttcccactaggttttggtgcagtcttttctacaggtggtggtttaggtttctgcattgcattaaagtattcaagcacaagtgctgaatcagtattgcactacttttataaatcactccctctagtcaaatttatttggcattgggagaactgggtttagttctcccaaagccaaatattttttactgactactttatataagataatcatcaaggcaagaaatgctaataatcgtgcacaatgtcaaattactacagcaagtatgccaccggttaacactcacaaagattagaattcttctacaagatacaatagggtagatcaatgactacataacaaatgcaagctcgaagcacgtgaacagctgtattgcaaatcttcaatgttacttaactaatttcactcaaattaaaatgaaatgattgtagtaatctaggaggttcctacttcagaaatgcaaattaaaagaataataaaggaaatggcatgaagggaaacaaaaatgtctactgagaaactattgcggatctttcaccctacctcctcctcctcttcttcccatgattcttttacatcatcttcttccacatcttcatctgcccacttacttttaagcggctcagcttttgcactaggcactgcgggctgaaagtcttcagaatctgttgtgatagatttgttccaaatatgacaacaggaaaacataagctattagcaaaccccaacatcagaactcataatgaaattcagtaataagcctaataaattcaaagttgtactgcagcctgcagaaactttgatgcattcatattctcagactagaacgaggtaatatctccttttactacaacaacctttacaattgtaacataagcttaccctcccaaaataaactgcaaaaaaaaaggtaattgtgtgcagacagtggagtcactagatacgttcaaactcttacaacaattttcaagttataagaacatcgaaggtgtaaaccaacaagaaagcagcctaacagaactggtagcaggtgaatgtgcatactatatctatatgatctgcgttctgcctagcatgacaaaattacacagctatacagtttgcaattgctcccaatcattttcagcagcagttcatatatctaattgcagactcagtctttttcaaagtctatgagcgtgaaatcaccagcgactcgcatattttcacgatataatagaacacatcaacacccacaagtacttttgcgtctcaaactaatcaccagaacaataccacaatacccccaacccaaaatctaaactgtaggccaggtaatcgagcaaccgcgcctttagtcttgcgaacaccttgaactaaccaccattgcaatcacaagttcacaacccacaaattgcaagtatattccgatgcagcagttcacgggttcagggtacgtattaccatcatccgatgaaaaaccctaattccaagcccaaaaaaaaacatacggcgacctaacaatcagcgaaagttaacatcacgcaaagcgttcagtcgcgaaccgcgccccctggagcacgagccgtacgcatcggatgggcaagctccgcggcggcagcgcgtccgcggagactccactgaaacgagaggcacagatcgggaagggagagattcgagaggcgctcaccccagtcctccatcgcggcttgacggcgtcgagatctgaccggtcgacggcggcggaggggccggagacgaggagcaggcggaggaggcggagtccggaggtggccggcgagcgagggcgggcgcgagcgcacgctagggtttccgcggccgagtcggcggcgccggcgccggcgggaggcggaaggttctggagggttgggggttcggggagaggaggtgacgcgttggcttcgctggccttttggttttgcttgctgtggcttccctttttctcttgtagttgttgctgcagttggtgatcgcgcccgttgagttctaatcggacggtggatatgaccccacgtgaaaacgggacggtcacggtatcacgcttgcgtgcttgttcctgactttctggattttaaaacttagcaattactaataatttagagttaattttacggggttttttttgccatcgtggtttattttacggtatttacttttatattgttaagtacatgtatataaaaactttatctataattttttttactaataaactgtataaataaataaacaaagggataattgcaaatatgccattactttcaactcctaactcgaaatagccattataaaaacgcaaactgcaaatttgccatcaaagttggttttctatgcttccgtttgtcactgttgtcccaactgatgcaattaaaaggataaaaataattcatagaaatacattgcaacttgaaagactgttttgcccttagctaagtttataccctcccagccctaggacccgacttgaccgcaagctagaatgatcccctccttctacctctatgaaccatagatctcaaatcctctcatccatggcaaggaaagagctaatggattttgatggcggcgggcggcgacgggtaggcagtgggtgttttggcggtcagaactgcaggcgacctcggcttgagcggcggccgcagtagcagcaaatgaaggcggcggcagcaaagctgcatcttgggcagcagcaacattatcaggggatgcagcagcagcaagcaaatgttggccacaacagcagcagccgacaactacatctaagcatcttagctcttaggcaacaacaacaacattagcaggcagtattttcgtgggtagtaggccagtaacagcccacggttgcatctcctaaggcttttatcctccttttttttttcttatacgataagtatgccaaaataatgtttatcttgcaatttggtggataggggtatccttgtcctaaatttgataaaaaccaaccttctaacggtgatagttcaggctgtcggtctaatggtaggcaggttgggttccaactgtttctggtggtaaatatgcaattatactttttgtagtggtagattcacagtactggttgaaaccagtggtaaatttgcaattggcccataaacaaaaggataagcgaatcaatgggtatgttatttttttagacagatagttttccttgtcttatgtgatttatacaaattggcccttcacttatgtgtaaattgttgtatctgcagaaattaggacaatttgagatatactacatgtacatcctcggaaatgtgaaaaggaaaactatgatcagcagttcttggttgaataacaaatttgtctataatattctttagatgtatcagttgttttgcagatatactccatggtagatttatacagattcgtaatactaacatgttcacatcttgtactagattttttttttatttcaaaacggagagaatagtaattaaaaactgcttgttgatagataatgtactaaatttgtttattttaaaatatagtattactagttgatagttttctcatttttccgttcgttttgatttgaccatatagcgctcttagttgtcattttgacaagacctcaatttcaaaatcctacaaagagctttacaggatctacaaccagaaaagagaatttggttaaacaattcaaattttaatctcattaaaatcaatcgattaggtgcatgtcagctttagtcggttcccttttttttttttgaaactcagaagcagaactgtgataaattgatttgtgcatgccagcatgtctgcagaggtttcctctttttatctccaaaagttctgagctagcaataatatagttattacagctaaatacacctacattctttgcgaaaatgaagaacacagggggatctcagcactcatctaacaaaactgtcagaaagaacgaagacatctacactgtctatttacacaatcaaactgaaaggacaagctactgcacactgttctacgacttgaggactgctccttccgttatcttccaccctcctagcttggagaaggccatctcataccgggtagtgtattttgtgtcatatgaatcattgtttctgggctcagtaacatcagtaagttggcctgcctcatcaatcgtagcctccacagtcgctcgtcgaccatctagggagatagtgatgctatcaatcgtcacatcggatagtgtatactcccagaaccacccatgacgctcaatctccgctgctcggtcagtccacacctttagcatgttgccatcaagaacctataagaacatggaaaatcagtaccagcatttgaccgccatcatcacggggatatcatgcagtggcaatagttcttgaaaaattgttcagttgcaattgaagcatgtgtgtgagtcaaacaagaaagattattgtaaccaaacttgtaaaggtacattgcgtgaccaatatatcctataggagagttatatctgaattatctctctataggaagcgtaggtataggtaagagcagtggccagctaggaagcatgaaaagtcaaagttttaaacatcacctcttgcaatgatgcaaccgaatgttctggtcccaaggccttagatttgatactctgccacttgcgaacaatatcttctgccagcttcgcatccattctaggaatatgtactggatcttcatctagtgcaggatcttcaacattcatcatgcaaaagttaactctctatgatatacattacagaattatagtagcattgtgtatgtatgagacaaaaatatttgatgtatagctttgttaaaacattaatgcaaagctataagatcaagaacatactgtaatcagccaacaaggatacccagtaaacacgtgagcagtaaattccagtgttgtttgactactttagcaaatgaaaagcatttactcaccatcagtagagtcgacactattagcaactgccacagatccatgctcactcctaatagcagaaaggggcctcttacgaggcaaatatttggccccaattactgccaacagtgcaaacagtgcgccagcagagataatcttcaaggcggcatttctcgaatcatgagcaggtgcattttcctggtcaaaattttcaagatatcccccagggccatctttagtattttccatggctgacctgtctaactgttctatcaatggaaaaaccttgttgaacgcttgaatagcatttgatttcacagtaccaagtgcagctgtagcttgagcaccaagttttgcaatagcagcagcagcagccaaatgagaagcaccaccaccctccatcctttctaggtagcttaaaacttctggatcatcgtagtaatctccaagtctgaactgcatgccccgagtatctctgctcctaggaaaaacctcaaagataagccaagtctccaaaagcttgcacagccctggaagaagatcattctcttcactgatgctagagttggtcacaataaactctagaattttggggtctctgtatggtgaagactcattatcaattccaagccacattctgcacttgctaacatctccgactagcaatgagcagaatgccctttccaatgcaaggtccatctcattatcataagcataatgagaacctatgttgaacttctggagttgttcaaaaagatcatccgccatcatgatgaattgtggccttttacttataattgcttgagcgacatgtgcaagtgctacattgtaaatttcaaaccattcaggaggaatgctattcggtgtttttgaaaagaaatccatctgggaggtgtaacagaaagggagttaacatgttttcaaagatgtgctcctgcaatataaataggcagctgcttcataaaaacaaacatgtacgaacctgttcaattgatgtcatcctcaaaaaagcctcgttcatgaaggcttcacgagaaaatcctcctccaacggtagcaatacctcctctgccaacgctccacaaaatgtttctcgcaccttgaagcccttcttggcgcttcttatgatgctctgtgtcaataggaagggagagaagctccaatacacagcgaggtgtaatctcctcgagagtttcatcaatctgtgaaagcagatcaggtgcgagattgcttgctccatcttcctacagtatgaagttcctattaatattgcttcaaggaaatcaccattcttattaaaaaaatatagcccatgtgtcccaaaccaatcttcacagggttatttaatcttatcctattcaaatataagcccaatgaaaaagtagggagtaaaaaagcaaacagttcacctgcaagagcttgagagccctctcgagcacctcgcagcagccaattacatctggagggcttgctgccatagcatcccttgatagatccacataagccagagccatcgctagcaccacgtcctgcttgaagcgcttgggtggccgatccagaagcaactgttctccagttacaagcacagcaagtgcctccccagcctcctgaagcgcacacaacacacctggaacctgcttcacaagacacccaatatattataagcagagagagattatacactagtgctatttgacaagatccaaacacaccctttgctgccccctaaagcctcaccttgtcccaagcaatatccatggtgagagcttcttcacggttctcagaaagcgcacgatcatactgagtgcgggagttctggttcatgagagtgtcatgggcaatctgcagcatttgtcgacgaccaacaagagcatccgtgctgtagccatactgcggtggcttggctatccgtgcctcgaacgccctcctgatgccatcgccaaggaaatgtggctctgcccctagaacctgagcaaagccagattcaacaaaacatttcggaaatagtcaaaaaggcatgatctctcactagccccacacacacatgatataggcataattcgtatcatagtatgcagtggatcacaaatgcgatggattcggcattgtagtcagttaataacctagtgaagtgacactacggaaatagcaaataactcgatttcatggaactgagggatcagtaacctagcaaaagacttgcaggtggaataacgtttcaacgatttagcagtgacaatgtatcatcacctaccaagaaggcaagaatcatgcgcttttttttatctacgggatgatattccgaggtccaaatgatgaacaaaccgcagcagattcacggggcctcaccttgtagaaatcgacttggagcgggagggagcgttcggcggcgtcggggaagagcgggacgaagggggaggcggagggcgcggcggccggggccggggccggggacggcgggtcggagggcgcggcggtggggaggaggtggaagtcggcgaagaggcgttcggcccagcggctcgcggcgcggcaggcagcggaggggtgaggcggcggcctgcggcgcgggcgcgggcgcgggcgagggagggagaaggcgaatggcgccgagttggggcgggcgaggaggttgtggaagccctccattagccgccgcggcggcggcggcggagatggagggggcggaggagagagaggttttaggagtgagggggagaagagggggagccttgctggctttggcccttgtttttttttttgctgttgttttcttgttgctggatgatctgggtgcatgattggagacttgggcactttgggagattttgctaggtccagtattgagacaccaatttcaaaactaatcttgctaagtctaatattttagggtgtgtttgaaaggagaggaaagaagaaggttaaggagatatgcaaagcgaagtgagtcattagtgcatgattaattgagtattaattattttatagtaaaaaatagattaatatgattttaaaaacaacgttcctacttaaaaaataataaaaaaatatattgtttaaaacttcagaaagcgtgcgcgtaaagaacaagggatttttttttcaatcaatcagatgcaaacaaacaacacattataacctcatgttcaaaaatagactacagatttaagtctcggattttaaattttggttatatttaataagctaacaggcatatgaggaaaggctagactttgtttaagagccaagttttttactggtttggagtcgggtgtgaaagtggaaaggcttgtttaaagttgtaatcagttttggtttgtttaaaagcaaggttcttatcgaatggttgtttgggttgaagctttttacccaaagcccatcatcttgctaattagactaaaggctttcaagtttcaaccaaatataagcaagagatccttcatcaagtcatttaaaggcaactttggctgatcagtttaagcatgttgattgacactttttagattacaatgctaccaagtgacaaggatataccccctcccccaccccacaaagttgacgatgttgggctatgatgggatatcatcaaatcctccatctaaaaagtggcaaaccatcaaactctcatgtttcaaatgttttttttggcttaaatttagatttttgggggctagttcttttcaggtcaatggataaattgatgatgagttatattacttcacagtaataatacttgacgacaaacgaacggattaactattaaaaaacaaaaatattgttttagaaaatattataggagagtgaaactcatatatagaaaacttttgcaacaattacactgtataaaaacttacgaagtgtgttcgtggtaattcataatccataagagagaaaaagggacccttaagagttgattatccatgtccattttctcaagctcaagttacagatgacaacaatatgtgaatcacttatctctacagaaaatgcaccgggcatacgtaattaaagtcattatgatttacctcattaccttgtgggtgaactaatatgcagtcttgagaaccaagcataaaaaacgagattttgagggagagatgtccctctaaacaatttttaagaataaattataagcttgttgaggattgaacactaaatctcagggttaaaaccaagagaggttgaaatcaaacaccccttgtcactgcactattaagtgtaactctcgagaactcgagaactaagcatagctcaggtggcgtgatgtgatggtgttcgccagcttcttcaggttattccgcttttgttccttcaaactatttaaacagtcttcaacagaaaattacacaatgaaagaaggttttgcagtgatccacgttacacggtcatctcagacaaatatgtatgccgctcgaagcattgtaatttggagaatgccactggaaaattctgaggatttacaatttggagtttgagagtttgagacacagtttcgaaatctgtaaaataccactaggaatcaaggttgattcaacacgtcttattttcaagtgtattgtaatttgatactcgtatagcttatgtagtagaaagttaatactccctgtatatatgggctgctgtcagcaccgattctaagtctgaagatcttgcagaaaacaatcagtcgacatctgaacatctgaactccgatattcaataaagcctatgatcaaatttggacaaatcgttgagaattcaaaccgtttgcacatctgaactctttcatgtcattcattcactatattttttgaacagagacgaaccaatgaagtttgagagtttgagagttgagacacagtttcaaaatctataaaataccaccgggaatcaaggttgattcaataccgtcttattttcaaatgtattgtaatttgatactcgtatagcctatgcagtacaaagttactactccctgtatatatgggctgctgtcagcaccgattctaagtctgaagatcttgcagaaaacaatcagttgatcaatgatcatgcgtcatctgaacatctgaactccgatattcaatagaacctatgatcaaatttggaccaatcgttaagaattcaaaccgtttgcacatctgaattctttcatgtcattcattcactatattttttgaacagggacgaaccaatgaacactgtggaaggtgaagcagctgaacacacgcaagatcggctatggagtcaaaagaaaacctaattaagaggagaatggaattgcagcactgcattgtgttgtgttgtgttgtttgttcatggccatgtggtgaactcgaagaccttgccgacgatctcgaggccggtggggatctgccagatgaagaggaggacgttgatggcgttgagcgcgatgtgcaggctccgcgccgtctcgttccccttctgcatcgccgggaccagcgccgccgcggcggcccagagcacggtgatggcggcgccggcgaagaggtgcggccccgggaagagcttgccggtgcggaaccacgtgttgagcgcgccgccgacggactcggtgacccccagcccgagcaggatggagccggcgttgaaatgccggtcccggaacgatcccttgatcagcttcttcctctcctgcatcacgcggattcaccatttcatcgatcgatccatggcgccatggcgaagcttgagcgagctggatgatggagtggttggggagagtttgattatacctcggtgagttcgtcgatcttgatttcgacaggcgacttgggtgcggaagggggaggtgaggaggaggaggaggaggagtcaccggcggcgacggcggcgggcgtggcggcggcggcggcgggcttgagctgcttcttgagctcgttgatctcgtcctggatggtgcgcaccctgcgccactgccacccgaggtagcccgcccagagcgtgtaggcgaagaggccgcccatgacgagcgggtgcagcagcgcgacgctccggccctcgaggatcccgaactcgccgcccgcggccagcgcgtccggcggcgccagcgccagcgccgccgtcgccgccgccgccgccgtcgtcctcagcaacgacggcagggcagcaggcgagccacgcgtcgccgtcgtcgtcgtcgtctgctgctgctgcctggcgctgggggggctgttcttgttggaggcggagcaggtgatgatggcgtggacggcggcgagcggcgcggccatcatggtcgccgtggtgttggccggagtacgcgaggtggttggtgaaatggtgaggtgaggacggggataaggaggggagagagcggagtggtggaaacgagcgggcgaggtggggagggggagggagacgagacgagaagagtagtgtggtgttgcgtcgatatcgaacattcgaggggacgtggcggactcgcacgcgcgggcgagcggccaagtttgtgtccgttggctctgatggcgcttttccgtgcaaaagatgacgtttttttatgggtgacgccgacgccacgcgtttcggtccctgtctccgtcgaccaccggcgatccatccaagcaccgatcgccggttggatggatacccaaaaaaaaaaaaaatactctctccattccataatataagttattttaagattcaactattaaaacatttaataaacacttagtataatataaaattaattttatttattaaaaattatatgattagattgggatttaaatttacttttatatggttacaaatttattgctacaaaccttataatatatgaaaaattataaattaaaaattagttttgtagactgtgccaattttaacggcgtataggacagagagagtaatacggttggatcggaatcatcactcaatccttgcatgtactgttggttggttggttccacgtcacggcatttcaccgtgactcctcctccccttggcccaaccacgcaaaaatagatcaccttaggcccaacctaatagctatttggaccgcacattacgttccctgtgccctactatctgggccgtgtgttctcctccgactagccgaggccggaaatctttgggccttgacatttctctccatccatttttttttgagtttttttttcttttgaaaaggacggatggtttgaaattcaaaattggaatggaatttagaatgccatcgtttgcaaagatcatgactcgatgagaaacagacacaagaaatacaagtcacgtgttactaccagttattattaccacgaaacaacgacgatacatacatacgcatcgagatgccctgcaatatcatcagtcatatataaatttcactgatggattaccgcggtaattaactaattaacctcaagcaggattaatatgcagagatgacggtctaggccggcggcggcggcggcagcgagcggaggagctcgtcggcgatggcctcctcgagccatccctcggcgtcgcccatgatgccggggctgagccgcaccatcagcacgcagaactccgcctcgctcagcgcgccgtcgccgtcctggtcgccctcccgcaccatggccgccgcctcctccaccgtcatctcgccgccgccgccgcccaggcccagcacgctcgccgcgctccgccgcaggctctccgcggtgatggcgcccctcgccgggtcggcgaggaggcggaacccggcgcggagctccgacagcaggccctccgcgcccagccgcccggccatcaccggcatcaggtcctcgtactcctcgccgccgccgcctccggcagacgcctcctgctgctccgccgccgtcgtggatcgaatctgctggtgatggttcatgctgccggccggcgagggaagccaagaagatcaagagtggtgttgagagttcgtgttgacatttttgcgggtgcggctttgtatataaaacgaagggcgttggattggacggcacggggataatgtgatgtggtggtggtgtgctgcacccaaagcttttccatggaccatcagtgacagtgatattactgccccagatgattagttattagtaacaactattatgatcattaaattaaactgcatacataatagtggagaaccagttaaaaaatagaatattacaatactaatttcttttcgattacatcgcacacgcttattgatgtgactcttaaccctatacaaagagatggagggccgccatggatccttaatcttgctaaaatcctgtagaaagtatatccgtgtatgcgtactccagaaaatcatacatactttagacttcattgccacaccaaacagatgcttcgcaaatatctacacgaataatgtgcgtacatcgatcctcaatattgattttttttaaagtttgacttaaaacatatctaaaactagataatgaacaacagcttagtagtagtatatattagggtctcctctagaagagaagatttttgcgggaatttcattgaaatttgaactgattcgtgtaaattaaattcttaccgcctgagattgttttacttccccgaccaaagactaagtaatgcgtaatgtgtgaaaaattacaagacgattggtagagcaggttaacgagaagagagacagcgtaaacctactataaacttacgtggaggagagagattacaaaatataaaggatgttgtctctcatgcaagagctagcttaatacaaactcctatgtaaatatattgaatgcataggtgagagatagagagaggaaaagaaagttgtagccaaccttatagctaatccattatatatgttggctttaagatgtgctaatagtaggaagtgagctctactatctagtattatccttgctctaagcgtcgttaggacgatcgcatcagaggagagcttccaggaagcttcagctgatctgactggcgataatccctgcatggtttggtttgctcacgtccctatcgtcctaaccatccccaccgccctgactagctcatgatcaatgatgcacgtacgaaaaagaaagtgttaaaaattactactacctctatattaatgtatatattaatgtataacgccgttgactttttatccaatgtttaaccattcgtattattcaaaaaatttatacaattatcatttattttattgtgactcgattcatcatcaaatgttctttaaacatgatataaatactttcatatttgcatgaaaattttaaataaaacgaatggtcaaacgttggtcgaaaagtcaacggcgtcatacattaaaatacggatggagcagtaattaacccactgtgatggccacgcgtatatatagaaccttctttttgaaacacaaacacacggacaattgagacattttcacacgaaaacgaattcaaaatcaataatctctcaatcgcttcacacctgatgacaaaaaaaaagagagtgattttttgtgtgttgcaaattgaagaggagatgcgtgccaagttgtgattgatgcaaagaggcctagctagcatcgattggcatcgtccttttcaaaggaagcttccgagaaggtagccatatgcatcgtcatctgcttcacattaacggatcatatccgatcgatggaatggtcatctcattcaaccagctccaccagtatactcgtcccctaatataagaaattttaatattttaattgcactgtttgaccacttgccttattcaaaatatttatgtaaatataaaaaataaaaagttatatttaaagtactttggataacaaaataagtcacaaataaaataaataataattttaatttttttaataaaatgaatggtcaaacaatataagtaaaatgtcaaaatgcctttcttttctgcagtagcagctataggtcagaatgcctttcttttcttttttgcaggagtagataggttaggtcagtgtactatggcaggattaaccggcatcggcacggccagttttacttttactatctttgttaaatttgacttgcacagatcgatggttctttgcatgagctcaacctaacccctaaattaaacaggagataaactacgtagattttttttgtcaccgattcgattcgacttctgtagctggtagaaaatataatagcgacctgtatggtgaaggtgaagcttcctcaaacaatccattttttcatccaagtcatcagaaactataattatagaatcaagttaataaactaaaaatcaaaacctaattttttggcttctctagattttcactaactgaattcccattagctaaatctaaagttgtcccaaacatcgatcccctagtaattaatagtacggtggtaaagaacaacttgattgatgaaaaagaaaaaaaaaaggcacaactgaattgtgctttataaggcggacgtgaacgtgatgtccgtcgcacagcggctgcccgcgcgacaagaggaacaccgtgtcgggggagaaacatgggagggagtcaatttggccaaacagacatgacatgtctacggagcaaaggcctggagctcagcccactcgacaagaaatgaggcccatactctcttagcccagcccacccacagaatattcagatccaggcacccaaaaataaaaaaaaaaaacaagaaaacttggcgcgcctcggctcccggctcggaacggcttcccgcgaagccgaaatccctgttcccgccaaatcctctcccctctcccgccgccgcctgctcgcctcctgtttttttaatctctacgcgcgccacctcctcttccacagtggcgccgcctcctcgccttctccatctctcctcctcctctcgccaccacggccgtgctcgcgtgcgcgatggggcccgcgacgccgctgcgccgccggacgagggcgcggccggccgccaccagggcggagggcggcagcggcggcgacggcgacgacgacgacgttcgctgcgaggcgtgcgggtccggggagtcggcggcggagctgctgctgtgcgatggctgcgaccgtggcctccacatcttctgcctccgccccatcctcccgcgcgtccccgccggcgactggttctgcccctcctgcgcctcgccgtcgccgcactccaagaaatcacacgcggccaagaagcccaagcgtgagtagccgatgatgcaagaacggataccatttcctctcgccgaattcgaacgaatttcggttggattttgagattcactctgcttctcttcctgcagagttcccgctggtccagacgaagatcgtggatttcttcaagatccagaggggcccggcggcggcgctggcggcggcggcggagtcgtcggaggggaagaagaggaagcggaaggtgggtggcatccgcttggtctccaagaagaagaggaagcttctccccttcaaccccagcgacgacccggcgaggcgcctccgccagatggcgtcgctcgccacggcgctcaccgccaccggcgccgtcttcagcaacgagctcacctacgtccccggcatggctccccgcgccgccaaccgcgccgccctcgaatccggcggaatgcaggtcacctccgaccccgccccaaattccaaatcgcccatctcgtcgcctcctcgtcgctgctaaatctcgccgccattttcgtctcaggtgctaccaaaggaggacgtcgagacgctgaatctgtgcaagaggatgatggcgagaggcgagtggccgcctctcctcgtcgtctacgaccccgtcgaggggttcaccgtggaggcggacaggttcatcaaggatctcaccatcatcaccgagtacgtcggcgacgtcgactacctgacccgccgcgagcacgacgacggcgacagcatgatgaccctgctgtcggcggccacgccgtcgaggagcctcgtcatctgccccgacaagcggagcaacatcgctcgcttcatcaatggcatcaacaaccacactccgtaagcatctcacactgaaagcatatgtgagtcaacacgatgattagattgatcacggacacaagtacatatagggacggtacatccttatctctataaccgacttatagatacagaattgggataggattacggaaaccgaaccggatacaatacaaacacccccgcagttggaacgtgtatggaacgaacgttcaaactggaacggaactcacaaaccgcctggcccttgcagaatttttgccacattgcaaattcagagcagcagtagcagtagcagtagcagcattgggaatttgggatcattgttgcctgaaagaaacatatcttgttgtgcttgcagagatggccggaagaagcagaatctcaagtgcgtccgcttcgacgtcggcggcgagtgccgggtgctcttggtggcgaacagggacatctccaaaggggagaggctgtactacgattacaatggatcggagcatgagtacccaacccaccattttgtatgaaccctgaaaattctttgattggtgttagcttgcaggttatttatgttttgtagttacaaaagggaaaaggaatgaactgatgagatccatgatccatcctcaagagatggggatctggtttgtgaaatctgaatgttgacctgggaagaagagaattgtattgttcttttgttgaaatgaaatgtgtatgtatgcaatggaacagtatctgaggaaagcggttgaaatgaaatgtgtatgtatccaatggaacagtatctgaggaaaccagtggaaaaggggttatgttaatctcttaattggtttttatctgtcagtcttctcgctgtgcaataaaaaatgattgtacaattaaatctcgttgtgcaataagaaagggttgtagaattaattttgtgggattgttaacttgacgtgttgagaagatgctgtttatgcaacaatatattttctgacgcatcatcatcttcagagtaaagatttcttttggagagtgaagctgagacaggaaaaaatgattgtacaattaaatctcgttgtgcaataagaaagggttgtagaattaattttgtgtgggattgttaacttgacgtgttgagaagatgctgtttatgcaataatatattttctgacgcatcatcatcttcagagtaaagatttcttttggagagtgaaactgagacaggatgacgaagattgcaaaatgtcgttgtggcatctgtgctacccttcacagttcaccaacgacttgcacagtgttgaggtcagcatgcgctttatagctgcatacttgcattcccgggagcatatcgcagtcatttgacagtacaatttgcaacagcagctagaggacggcagtccaccgtgagagcaccagcgagcgtgcttctaagagagaatgtaataaggacaggaaaaaaaatgttgaacagacaaatgacaaagagcaaattcgttttggtgcagcaatctaccatagtgtcaggctgtcagccaaaatagtcaatactggaagtttaagcatctcatatcaaagcgggaaaagaggtgtaagctaacaacacgagttgagatccacaaaacattgttctagagctagctagtacacgaatcgtctgctaccaattactaatacaactttcagagagacaacatcagcagttcagtacataataatagtgcgtccattgatctgaagcaggaaggtgcagcgcaggcatcatgtggagcaacttcattctctctcgtacctcgcaggtgagcgactgcacaaatgtattgcaaacaagttttcagcgcaaggtttctatagagtttcaaagatagttgtgaaaacaacatggaatttcagcatacaaacctgcggggcctatcatagccagggctggcttcacggcgttcacggtcgtagttgttaggggggctgcccctctcatcacctttgttgcccccttgcggacttgcaccacggtgataatcagggctacctctgtcaccacccctgccatagtccgggctgcccctctccctgcctcttccatagtcagggctgcccctctcacgccctctgccataaggacttgcagaccgcccgcgatagtccctcctgtctggagatcgatcacggcctcttctttctgggctgtatccattccttttctcatcatcatcacgaagtgcatattccacagagataaccctgtccataagagtgctgccacaagaatgatgaaagcagttaaggcataagatgacagtcatatagttactaaaggtgatgtggtaataaagtggcacaaattagtactcccggtaagcacatgacaagaaagcaagtgttagtaccttccatttgtaccctccagtgctttagtagcatcttcctgtaactcatactggacaaaggcaaagttccttctgattctgacattcgagatcttgccatattgatcgaagtgcctctccagatctcttgtccttgtgttgattggatcaaaattgatcacaaacaaagttttggttggccttgtattgtttggagatctctttgagttccctcttctaccaccactgcgatcctcctgcacaaacaatagatgagacttgagcataaataggtaaatatgtctaaaaggagaccggaaatatttcatttacaggatcacacctttgtccattcaaccctaagtctcctcccttttctgccaaattcaattctgtcaagcctatggatagcttcatcagcatcacgttcatcttccatgtagacaaaggcaaaccctgccatgttgaacatgataaagtagctagttagttaaaaagatatcatagtggcacaaactctaggatggatcatgattgataaaatccctgcactgaaaagattttaagatcacctcactaggctacaaactaatacgccagaataaacaggaacagaccttgcatatgtcgaactaaatgacgtcaatgtacattaatccaaacattcgtggtacatcaaagaggtggtggtggcaacctccactcgtctccagccggccgtgtggttggcatggttggattggcgtgggaaattgtaatcggacgggggaggagagtgcaacgcagaggagggtgcaatgctgatcgtaaaagtaaggcatcattcacgaggtggttgtttccaagtgaacagatgccaggatggactctgagctcctggagatggacaagagatgagcggggctcaggcaggaaaggtagagcccagtccatcatccaggaagagcagagatgctccatgatatcctgcggcaaagaaataattgagtactggacctaaacttaaagaaataacttcttttttttttctaaatgtaccctgatgtgcacttgtccaatgttttgataattaacattaagataatctggtcctgctgaaacttcttttgcttcacagtgaatgcaaaataacctcatgcatttcacatcttacaacaagctgctggctgctgcaccagggagcgtgttgaacgaaataagtcagagtctcgcatcaaggatatagcagtgaaacatgctagcccctgctatatcaaatggagtacccactcgcttttgagactcatgtacttacggtgcagtacatactacaaacagtttcaggttaataatcaaacagtgaaaaaaaggaggaaaaaacatatcaatttttaatctgtacaccatttgaacccatgagtgtttgcaacaatacgattccacaagaattatcgtatgaatctacctggattaacagtttagcaaacaaaataggaaaagttaatatggaaattttcattttagtgtgaaattcatcagcagccacttgtcagctgactcttttaaaagcctctgttgctggcttgaccagtcgaattcttttgatgcgaaacaccagataggtgcaatatggataaacaaatttgaaaacagtgcagcttaaatttaagaaaaaacaattgagagcaactgccttacccgacttcatgtcaacacgctccacacgtccatatttgctgaagaggcgctcaatctcagattggcgagcatcatagtcaaggtttccacagaaaactggcctcattttaggacaagcaactcttctcaaacctatcccagtaaaacgaacagttaccttatggagatacaagagtgaaactgatataaagtcaatattctaacataaaaatggtaatcaataaatgttaaagaacatgggcaacactcgtagctttgcaaaagacaaacatattcatattttttttgctacctataggccaataccaccatagccaatgctaggtttactttcatagaaaaagctatgaagtgatgtcagtattgggtcaagaattgggatatagtcactccatacttttttaactttaagcatattcaaaaatagagactggagtcaatcctaaaaactcaaaaccccttacagttaggtcagggattaccaaggcaaacatcaaggtgcccaaaatcaaactaaaaccagcatctatgcagacaatcatagagaccatattgacacttgaggttttctctctctcccccctactattcccctcttcccatgtcacgaaggttttggaattagcatcagaacaccaaccgaatctaaaacatcaccagtttcccctcaacagcagcttcatcccgagcgagcgaccaaccaaatcccgcccaaccaacaaccaccagagccccacccaccttgtcgcgctcaaacggaaccgcctcaagctctaaaggaccgaatcccagctagctagaaccctatgaaacttcgtaaagcgacagatctgagaaaaacctaaccgtgtaacactagccccagatccaaaccccccatcccccaaaattcaaaacagaaccccacacacacagcgccacctccgtcgtagcacgcgtacctccggggatagacgaagggaggagcgggcggcggcgcgggggaagacgacgacgacgaggacgaggaaaccctaggtctcctcctcctcggggcgattggttcgggcggcgccggcgaatggagaagcggagaggaggagagagtggggattggtccgttgcggcgtagcgagggtttttataggcgacgacgtggacaaggtggggatggatgagttggatgggggtagatattttccctggcgctggatggatgtgggcccacctgcagtgaccggtcggagagctgctggagcctatcacttactcctattcattatgcttgtgcttataaaaatttgtaaataaaacttttatatatgcgattttagctatctaaaagcaaatgttaaaaaataaattttaataaaatattcttaaaatcatctttaaatttaagattgaaaattctaaatttagctgataaagataatgatagacgaaaagatgagaccatgagtggtggtgacatgtgatggttaggctgatagggaccgtcttcttgataggtattggatgctacagtgttagacagaaaatccgataaaaaaacacccggttttcacttttttttttttgctcatattgctttggatgagttgacaaaccggtcaaattgttaaaaaaaatacaaaccgaattttttttgggtaaatttgttctaatcccactttacagattttcacacaaatcgacaaaaccgttcctgtttgcaaaaggttcttttgtgaacctagtactatgtacagacgaattgttttgagatgtatataaagtcttttcaataccaatagaggcgggctaccgcttctcgttgatatcaatagtaaccaatcggttaccaacaaaaaaaccgaagaaattttacccattatttaattttttgtttgattccttttgaacttcttgtaatcaaaatatcgagtggtttcctctaccactgcactgctggtaaaccctgttattgaaaaccctgcccttttggaagaaaaaaaaaagttggcaacacactacagtgataagaaatgaagtgagcaagaagatggatgccttatatttccattttcaagcaatcagccaaccatatgcatccaatttgaaccagccgttgtcaatttgtgattagtaaaacaaaacgctgtgccaaaacaatgtttaccaggaaatgaactaaatataaactgtcttaatgtcttaccaccgtgccacggttgacaagtacgtacatgtctaagggcatcaagcatgacgagtagaatttacattttccagacttcactacagtttatgaacaaagttcaagcccaaaatctgtataatacagcatggatgcctctacctacatctctggtttattataaatagctgaattctttggtcttcgcaccgttccttccaacatctctggtttttgcaatttgcattgcccagattgcctactccagtttgtgaagatgtcagaagaggatatccggaaattatgcacacatcgcctttccaaaattttgtacatgacacagttttcatttgtccaacgatgaaatgccatatatcagatagagataggcctgcaactctcatgcaaatgaatgctagcaaatcgtggcatgcaggtctgctagtctgctactgcttcgaagttggaacttggaacacaaacatcaaggtcatccatgcaagggcacttcaaaattcagacaggtaccatcaccactattgttgcaactgaagcctgaaggccgtgcaacgactggagaaaatcgggcgagcactggcagtgtcagctaacagaacctgaaatggttatatatcgttattgttacctctactttgagccattcaactttgaatcttttaggatatggtttacctgcagtcggtagtgatactatggggacaaaatttcttaggcgatatgcttagagggcagccggcaaaccaacagatagttccatgagcattaggaaggcaccaaatattcatgcttttgtcaaatgattgtgcaacctcacaaaatcatccaacaacagatcagaaggtctagcctgccaggatggacaattagatgcatgttttttcttcgtgtgtgtgtgtgtgtgagagagagagagagagagagagagagagaggtgttactgtaactggaagaccaatgttggccagagcagcctcaatctcagaggaagaacacaggtgctggagtgatttacgaagcatcttgcgcttcccattgaaagcagagttcacctgaaattgaaggataattataaggcaactagcttataaggacatcagggatcaactagcttagaaggcaaaaatacaggaaacttttatatgcaatgtgacttgccattgaaaagaaacctttgtgagaaccaactggtggataatcccctgaattctttagcttaaagcttataacagcaccatcaacctgaagataaaatcagctataagactacaagtaatgtttacagaaccaaaaacatcgcctttttcaaatgctaagcaatgtgtaacacataagtcataactggttaccttcggttgagggaaaaaatttgtcctctcaactttgaacttgtattctggttctacaaagaacaaaggaagtacacaagcgattagatgcgaaataatggctaaatgatatgtgcggtacatatgctgaaaataagcagaactttgaagtagattcctttactgtttaaggcatggacgcaatgccttacaaaaattgcactggtgcatatgacatcaattatctaagcaaatttttttacgcattccaaaaagaattcgatgaaactcttttaatataatcataagaggtggttttcatcattttaaggacacttccatggctatgcacatctaaaagtcaaaagtagaaaacagagcagataatccgtatagaagcatgaacggttattcactttaaatattttttcgccaacacgcaagagctttgcacatcagtatattagaagaagagctgaatacagatgtgaccctccagaggctgtcacacagagataagaggagctaacttgcacagtttgattattacgaaacagaagaaggaaaaaagagtagtaaacttagtggcctcttagatgataagatcatatgaagttggccaactacgaaggaagtccctcacagaacattgtaaacagcttacctgagtagaaattcacaaacacattgataggtcggtactctggtgtttgtattgaagcatctgcaaagcgcaatgccgtttcatcctgaaaatgaaatttatagttatgtattttttgtactacatatataatgaattatggtccagaactacacatccaataaaaaaataatcagaggtagcaggaatacatggaagataaaaagcatttgtgtatcaaaacagatagataaacaaaaaccagtgggacttaaatacaaactatacctaaacaatggatactagagcaaacatccaaaattaaaaaaaaaaatcaaccagcactaaccaagagttaattgtaaatgatatattgctaatacacgtgtaaatgggaggagattcacacctgaagcaaaagcaccatgacagaaaagacatctcccattgggagaagaagtttgacaacttcagtacttacattgaatggtaaatttgacaccacctgcaaagtacaaagtgtcatgttcaccacaaaccagcttcattatgctaaacagttatctaattatgtacacacttcaatgaaaaaacaacgattctgaacatagataattaccttggcatattttctcgtgtgatgggatttttcctccaggaaaggaagaaaatgggagcggacattaaattttgtgatatcttcttcaatgatctgcattatattcttaaaatcattacacatcagatgaagactagattttggtaaaggcaacagcatattgtccatatcacattcgcatttctagtttcataaaatatgcaataggattatccacatatcaatcttcaatgactggaagaagagtggatagtttaaatggcagtattggtcatattggatgtcaagaagagcaactatagaaacacggaaacataaaaaaaaatgcttactgaccatgacaagagcaaagtgctattagaatcttaagagcttagatcttactacaaccatctgttacaacgtatacttgttcatatgctcaagtcctgagacccaactagactatgtagtaaaacccgttttaagtttattttgtccataagtcacgagaagccataatatgtgaatcttattaccatgtatgggacatgcctgatttggttattagaatgtaaagcaggttaagctagcgtgcaatttggtcataagagcattatgctatagcagaaggaaactgtgtacaacaaatgctggacagggaaatattgaaactagaagaattcacacttcagagcttttccataatgcagcatgtgtagataagtagcattatttttatctcagcacagcataagagtggtcctgcacttggacttggggaaaaaaatcagagttataaactaagggtggttattctgaggaacaaataagcaacatcatggattaccatgtaaccaattctagaaacaccaatagtcaaagaaatggatgaaacaatccaacgtgttggtctaagaacatgaaactaccttcaattgttctgtggatccaaacctatcattcacaagggtggccatatgcttatcctgttaccaaagcaaacatgatatatggcattgcagattatggaccaaataaactagtgaaaaggaacaatgacacggtctcagcagctcttagcccaattcaagccaatgactagcaatgccgccgaccttctctacggcgaagacggtggcgccggcatcgaggagagcggccgtaagagacccagtccccgggccgatctcgagcacgacgtccccctcctccacccccgccgccgccaccagctcctcgttcaccttcgagttcagcatgtagttctgcacggagacgaggggccagcgtcggcatggcgcacgatcaaaccgagggtttcgcggcttgggggggggggaatcggggacgggggggaggacgaccggaactacctggccgagggatttgcgggggacgtggcggccgcgggagttgagggagcggatggtggagtggtagccgtcggtgacaccggaggcggcggacacgacggtggcaggccggctccggacgcggtgtgaaggggtagcatgaggcggcggcggcggaggtggccggcggcgaggtgtggccggagacggggaaggacgcggtggcggtggggataaggaaggaagcgccaccattttgcaacgctttgcctttctccttttcccgttttgccctttttcacatcttttccgttccgttacgtgggccgggccgggcctggccttgaaaggctattctcaagcccaaatgaaataaattatgggctcttgttcttttccctgttacgaccggggccgggccttgaagggctagtctcgagtccaaaaccaagaaattatgtttttaaattttttttataaaacaaaatccgttgtacaaaaccttcatatcgaaatatcatcagatagttgtggtagttctgaaagtatttctcgaccgttgattaaattggtatatattgtttaaaaaaaactagtataaactcctcttacatatcaagaaaaactaagtaaatcagggataacaatggtactgcattggtgttatgttaaattgtatttctttttcctcgttgtgtaattacaataatgtgtttttcctagttgtgcatactgcatactatatgtcgcgataacctctccatcacctttggtgccttgaggcggacttctgaatgttcggaatagcgaatatgatattccaaatgtcatggccttttaaaaagtgtcgcattggaagtttcatactggcatggctttcttcggtggcaaagttcgtgtcaacagcttgagctacgaagcggtggcaatatatggacgaatggttgattacagttgagttactcttcggtattatcttctactatggtttgatattggttgctagtggcggtgcaagtgacataatcgatacaatgatcaattgctaaattcagagattatggtgtctagcttgagaaaggtaataagaagtaaatacaactggttagttgttgggggaaacaatggttacatattctcatatactatagatagaagtttagcaatatgtgctatctctatctttaaagtggtattttagtatttttcttgtttttagcaaattgtgattttatagatcgctgacgtttatcccataatatcaataataattggttgtaactttttgaaagtagaggatggaatgaattggtatgttgagtttagagttgtttttttaatggtagattgagtttagagttgattttttctaatctgtctttttcctacacaatccatattactaaaagaatttctaaacacatcatcatcatcatgatgtaatgaatgaagaatctttattcattctcccattaagccacatatactaatataagatgagccgtcggatttgaaaagaacggttagaaaacaaagagcatctggaggttctctcgcgccgctctcacgcgggcggctcgggagcgaaaccctagccgcccgtgctgccccctcccaacgcctccagccacctcgctgccgccggagcccgctaccggaaatcgtgcggccggccgggaaggcggcggcagggaaaacgtgccggcggcggagcaccccctcggcgtgggaggcggtacgacgcacgcacggcggaaggcggcggacggagcggccggcggggcggatccggtcgcgccggacacggattcggcctccccggtggaggatctggccccctgccggccagatcgggagaggggtggcggcagcgcggcaagacggcgggcggcctcgagctcgcggcgacggcgacgcggcaagtcggcgggcggcccgagctcgcggcgacagcggcgctgcaagatggtgggcggcctcaagctcccgacgacggcggcgcggcaagacggcgggcgacctcgtgcttgcgcgcgacggcggcgcgacctcgagctcgcggcagcgggggcgcgactcggcggaacagctcgcggcggcggcggccgcgacggcgcggcaacgcggctcggaggagcaacccggtcggcacgcagcggaggctgaccggccaaacggctgttggtgacggcggcgacggtcgtgcccgccgtggtgctcgtggcagtttgcggcggtgtcggctagcaacggtggtgtcgggctggctacttggtggcagaggacgacggcgcagcggtttgcggaggcggaggctggcatcggtagcagcggtgacggcggccgtggctgtggacggtggcgacgtcagcggatgcgggttgctagcgaggtggctgggcgttcggcagcagcggctgcggtggcggtgactgtgtctgcggtcaccggaggcatggcggacttggatggctagccgagggcgtggcagacggctgcttttggccggtgtggcgtcgtttggtggaggggtcggagaccggcttggcgcagagaggcgcagccgatggcagtggaggccggcttggcgcgagaggtgcggccgatggagggaggaggaggccggaatggcgcgagaggcgcatccggtggaggaggccggtttggcgcgagtggtgcggccggcggtggaggaggcgacctaggtgtgaggaggagctgccggtgagagtggcgcagtcttcggcgcacgaaggctggccggcgggggacgccggtgcaggggttccacatgttggcagagcttgtgtggtggtggagcatcgatgtgtcagccgtggattcgcagggtgagcggcgggtgaaaacctagtctggcctcggccggaccgacaacgatggttcattccccctcctgagggcattgtcgtgttgtctcacccctcaagggtggttgccgggcgaaagcccggtcttggctcctttgagcttcgacggacggcgccagcggtttttctatcgcttctcttcttaaagacgtcgttttggcatcccctagggggggcgatctcgtctgtgtcgctttgttggtctagtggtgatcggtcatgcttagcggcggccgttccggtgctagccttctcctggacttgtgtgttggcgatgtcggtgtgttggtggtggtttttttccttttttctggttacgaccctttagggttgtaatcttataattttttcttgctttatcaatagaacttcgcaccgtctcgtgtgagtcgttaaaaaaaaagaacggttagatgaatgtatagagagaagagaaggggaagagttaggattcaggagacttccatcggaaggatctagaaaatgatatgggagttttattaaaaaaagatacttctatgcagtaaaatgggaaaaatgggaatatttgtgaagcaaatacatgaatggacctacagccctactgatggacctctgtagagactagaaatggactttctatgtaaaatttatttatgcaatattagatcggctaaattttaacactattattactaatggcacataatggtgttacacgtagaaaaagacaggtcatcgtcgcgcgaatgcgctacttgatagctagtactagtagtgactagtgagcaaccaagttacaggcagacaaactgtgggaggcaaaaatattcgaacttcgagtttcggtaccacatgactctcgaggcctttgtctcaccaactaaggctgtgttcgtttggacgttttccagcgcgctacagtgttttgcccccgcgcacgcttttcaaactactacacggtgtacttttttgcaaaaagtttctatacaaaagttgcttaaaaaaatcaaattaatccatttttgaaaaaaaaattagctaatacttaattaatcacgtgttaataaaccgttccgttttccgtgttactgtagtgcgctgggaaaacgtccaaacgaacacagcctaaatccaaagtcaatgccatatggacctatcaagtactatttctgcaatgcagtcacctaatcaagcccaatcactaaaatcactgttgcagcagaggcaagacacacatggctgatggcaattccctctcatcatcacaaaaagccagatttggcgcgcttaatgagctccacttgggtgccaaatccccatcaagcaacacggccgcgttgactgacctgacctaacctccccgcgcggatcccgtcacccgctcggtggcgcgaaccacacgccgctcctgcggatttggcgcgaaacgaggccgaaattttgtccacgtggccagcggtgaccgcaccaccccccccctttcccgcgccacgtcgcccgccagaacgagcgtggaccaggtcacggacagcgacgcacaactcccggtctacgtggaccgcgcgtgagatactcagatgggaggggtcgtggcgttggtggaccgggtgcatggaagtcgggggggatgacgtggggttgaccccgcgatttgttcgcgctactcagtggctgggcttcccgcgattcagcttcaaaagagcgcaccacatgagtcacctaacaaaatgaagactcgggtcacttgtgttgacatggtaatggtatgccatatatatttgccatgtcagtggcaatgattgatgatctggtgggctatgtctatagaattggatttcgattattatgttaccgtcacatgtcaccatgttgtgagtaactatcataagtaacaaatacgattattagttattttagttttaattgacacacacacacatatatatttatatatatatatatatattattttcttaaaatatacaaataatatataaatcctatttttatcgtgaaatccgataaaaaaacatttactcatttaagcacaatttattatcaagatgtacgagaaaagagttgtgaatcacggctgatctagcaatgcgtctttcttgtcatcaccataattttgtatggaggcattacgccgcgtaccgaacgccccttccaaacgatttataacaacgacgagaaaaataatgtcgactatcactaacacctaatgacattcatttaaaaaatacaacataagtgtacattgggttcttaccttttagtgggagaaaatttattagcacattcaagatgcacaagaatagagctatgaaacatgactgacttggcaatacgtattcctcatcttcaccataataccgtgtaggcgcattacgctgcacacgcgtcacatccttacacatccatattacacataaaaacgacacgtaaataatatccaccaaccttacaccaatagtactattattcatccaaacaatattgaatgtacaaaggttcctcacgggcaaaaatttatcagcgcatacagggttacacgagaatagagccgtgaaccacgaccgacgtggcaatgcgcattccccgtcaccaccacaatctcgtgttcgtgtggaggcattacgccgcgcacgaggcgcgcacgcccccgcccatatgaatcgcgtatatgaggagagagcgacaatgccacaagcccaacccaattcatccccaagtccaccaccacacacacacacacacgcacaccactcctctccccacaacccatccactcccacgccgccgccgccgcccggatcgccgcgagatggagcaggtgagcacccctcgacctccgcgatgacgatgccctttgctgtatccgatccatccgcgagcgtggaggaaatggtcgctgctgctgctgctgatgatgagtgtgtttgtgtgtggctggaggagcagtacgagaaggtggagaagatcggggaggggacgtacggggtggtgtacaagggcaagcaccggcataccaacgagacgatcgcgctcaagaagatccgcctggagcaggaggacgagggcgtcccctccaccgccatccgcgagatctcgctgctcaaggagatgcagcatcgcaacatcgtcaggtgacccacctcctccctccctgctagctccatctctctctgcggctgttggttgggtgggtgggtggattgatggattgcgtgatttgcgatttgtgaatgctttgggaatttggattgtgccgtgcaggctgcaggacgtcgtgcacaaggagaaatgcatatacctcgtcttcgagtacctcgaccttgacctcaagaagcacatggactcatccccggatttcaagaaccaccgcatagtcaaagtaagatgttgaaactaacatcctcttttcattgatgcaagtatcacgccatttagtgatagtaacttcgctgaaagtgtgggatgagctagccattgcttccattttgtgcatggtttatgttgaaacgggaaatgtgatgctgtcctttgcgcctgtgtgcagtcgttcctctaccagattctccggggcattgcgtactgccactcgcaccgtgttctccaccgagatttgaagccccagaacctgctgatagatcggcgtaccaactcattgaagctcgcggactttgggttggccagggcatttggcattcctgtccggacatttactcacgaggtacattttacagcccgacacgtttttcgtttggtacactgtgatttatagtccttgcacatcacactacagaagaggggaactgtctaatggtgaaaacgtgcagttaatttagatgagtacatcaaaaaattaactttgcctccttcactgcaatgcattttgtaggtgctctattaagtaggccacatgtgtactctttttgctacatgttgtgctactgtctgtttcattgaatatcacgcatgtattcacggagatatggtacaaattgtggactatgaccctatgtcatggctgccaactgaagattaatgtcacccattagtgctcactgtttttatggtacatcttaagactgcttgtatctctcttccctctactgccttttataactgttaagaatcaatggtagataattttccaagcctactgtcatagtgcttctttgtcagtttgaattttactctcatggcaatatctggtgaaacctataaaccagcacaaatacctggacctttttctgtactgtacaccatccatttctacctaactacctttacgacaactcctgcaaaaagaaaaaaaaaagcaattgatgaacttagaaaggtggactacgaaaatgaatgcatgcatacagaacataggcatttgtaagaaccgaattagttaaccagaataggtacagagcaatttctacatctcctgaatctggaatgctgcacacgtagtttaaactgttgttaatctagataatggagaacaaaatgagaacccctctgtcttaaggcaaacctagagccaggtttgactggagcaggcataagtatcaacgaggtcttcttgtgatatacaccttttgcccctccatgtttacatcatttcatctttaacataacccactttggtttgttaggtggtgacattgtggtatagagcacctgaaattcttcttggtgcaaggcattattccacccctgttgacatgtggtcagttggttgcatttttgctgaaatggtgaatcagaagccactatttcctggagattctgagattgatgaactctttaagattttcaggtcttaattttcaaatgttattaagtcttcatgttcttccatgtttctgaacaaagacaggaagacctaacactgctctatacattttcatgtgttcatgtcaatgaagtattatgggcactccaaatgaagaaacttggccaggtgttgcttcactacctgactacatatcaactttcccaaagtggccatctgtggtaaatcatgaatgacttttgttattactcttaaaaattaatatagtttgaatatgtggatagaggcaaaaataaaatcatgcactgtgatccttgcaatcacgttatgacagtgcaccattttttttattgggatgctggatgtttttggttctaacatagtgtccatgttgcaggatcttgcaaccgtggtcccaacacttgattcttcaggactcgatcttctctctgtaagtgacctgtgaatatttttggattcgattatgcaactcatgttatcatatgatttccctagagacagtccattgtttgtgttctatatattcagctgttgatatttgagttgcttagtgaattcttgggattttataccagggttctataattgagttcccaaattaattcaggcacacaaatgtacccgtttgttttctttagtacatacctccatgctgtgtaagcagtatagtagatagcgggcgcagcttgattgtcaggatgtagccatgtattcatttctcttgtaatgttggtcctggtgcactttgttagttgtatgtaggcaagggaatcctctagtatagatattgcagtttctccatcctcattatatggctgtatcgccatctacattgaacatcaaacagaagattgcatagcttgttgtatgaatgttagaagtcttgcatttgggctgcaatctgcgtatgaatttattattttttttaaataaagttgtatgaagcactatattccaaatctatcagtgacattattttcttggcatcctttaattgtcagttgatatgcatccatagccttgctgactgctatgtttgcctcatgcagaaaatgctccgtttagatccaagcaaaagaatcaatgcccgtgctgccctcgagcacgagtacttcaaggacctggaagtggcgtagattatgcctcatcttgtccatttgtaaattaagattgcattgtttgctcagccgagttcttttttggctttccttaatctaagttggtgtgctcctcccccaactctatttttgcccttttggttgtgtagagatgagaacagaaggtacctcctggctatccctctgtgtaattcaagccaattgaaagatccttattgcgggagctctacattgcaattttgctctcttgcctatatccagttccaggactgctgggattttaagctgccaatgtggcatggacttctccagtcattcaaccagttaatttaaactcttttgccaacattttccaactgatgtgacaatgtttcctttatctgctgtaaggatttcgacacatctttagttagtcacagccgtaaccagtcagtggtaaggcgaatactgcaaatgattgggccgaacatactgatcatgtgcaaatggaacacatccacgtctccgttcttttcttcttctttttttgcgaggagtctacgttcttttctgagaaatccctgcatccacactggtcatacgaatcaagctgacagcttcgtcaacgaagcacgtgtgctatcattcatattattttccagtctaaccttccaacgaatgaaagaagcttcattcattgacgaagctggacaagtatgcattcattgacgaaggcacgaagctggacaaagtatgcaagtagagcgagaaacacatagggttatttcggctagctccacaaggtgatagacgatctgggttcgaaacctcatctcttctaattatttgatattagtttcttccataatattagctttttaagtatgcaagcagagcaacgagcctacgagaggcagagttagctagtatcacttggaataggcttccaattgccatcatctcaatcttggaattcaagctcatgggaatggaccattggagacagaaagaaaatttactactgcatttgacctcacacttgtatgctgctatggattaatggatgggaggaccaatggcaatgaatctgtgttgtatgcaagcgatgggcgatgttcttgtccaggcattgcagtagaaatgcaagagcaagattcaacaggagtgagttaatatgcaagatttaatggtgtcctcaagaagcagcgaaaacagttggacactactgttgcaggtgtagcgcagggtaaaacataagtgaggcacaggtaccgtgtgcaatggcactatggcagcagtgtcacgaaaaggacgagacggcgtttgatctggatatttcataggaatatttaaccttttgccactttttcggacaggtgagctgcaaaggatttaccacttcgtgagaggaattaaacttgtttggtgtaaaggataattgacaaaaagacaatttcatatatcaaacacatactatcttctcttgatcaatgtagtagtacaaaataataaaggataaaaagacaaacagcacagtatccttgcatacgtatagttgaaaatccttttgtccggggatttaggttcccaacccttttcacgtgcacgcttttcaaactaataaacggtgtatttttttacaaaaagtttctatacgaaagttgcttaaaaaatcatattgatctatttttgaaaaaaatagttaatagctaattaatcacgcattaatagaccactttgttttccgtacgcactattccagttggaaactcagccagccgaacacaaccaatattatacgctaggtttgagtacagcattcctcgtcattgatctgttgattgaaagatctcacatggaaaattggctcttccggtttgaagaaaaagtaaaagatttggatttctaaggattatttctactaatatcatttgttctgtaggaatgaagtataaaaaaacaaaatgaatcttttttttctataaagttgtaaagagacacgaaaaacggagcaatagattaatgcgtgattaattaattattagcttaaaaaacttcaaaaatgtattaatataatttttaaagtaactcttctatagattttttttttgcaaaacacgtaatgtttagaagtttgaaaagtgtgcgcgcagtaaataagagagtgaggttggggacttgaactcaagaacacaaatctcttgaaaaaaaatcctttggattgatacgtgcatacatttctaatcctctttttttttctattcatatgaattgaaattcctctaaaccaaataaacgctaaatttagactcactcgatgataaaaaaagggtaaattggaaccatgccattataattttgcaaagtttaagatataccattggtatctcaatgacatgtaggacccacatgagtcaatgatatgtgggtcagtatagcatatctcaaattttctaaaattataatggtatggttccaattttccctaaaaaaattatgctcgttccgttctacagagtaaaatataacaccatacttggctgctgggttgggttggagtagctacgaatccagaccacagtaaaaaaacggaccggaggtcgacccgctctggtcgtcggttcaccggtttactggtcgaaccgccggttatttatttattaatattatatttaatttgcattattttaaatatagtaccatcataaattggtgaaaatatgcacgaagaaactagtatatctattattatataatatggtcacaatgtcaaaaaaaaatgtagtatgataacataataaattcataacgcatacggctatgacaaattaaaaaccggttcaattcttaaaataaccactaccaattcactggttcccatgaaaacggcccggttcatttttttttacttgttcgattgaaagggcggtctttttgttgaaacgagcctttggtttttttccggtgcaccgccggtccggtcggttttttttactatgatccagacaggatatttccaatcgctgacgaggtgggccccacctgccaggggagcaaccaaagccgccacgcgcccacgctgccgcgacggggaggcggaggagagctcgcatcgcaccaagtaggagtatattacaacgacggcttctacgaagaaaaccaatcctccccgatagccgaagccgaagccgaagccgccctgctctgacacctcgattcaccccgcctcgccgccggccaccgccgccgcagatcaggcggctccagcgggcggtagggctcctcctgtaggaggagttggtgggtaccgtcgcgttcttctttcccctagctaggtctcgccagaaggaggaggaggcggtggctgcggcgcggtcgccatggaggcatacaagctctgggtgcgcaagaaccgggacctcgtccgctccctcgagtcgttggccaatgtaaaccgtaacctctgatccccaatcgaatcgactgtttccttttgtttggggggggggggggggggtctggagcttcgggagttcgtgatccgtagttcgttgtgtggagctcgtcgatccggagggagctcttgttgggggtttgtagggggggtgtgggttttggttggaatcgactgaattggggcgccgtggtggctgactgggagttggagctggggccagctgggttttgggcgaattcgtgtggtttgtgctgtctcttgtcgagcacaacatgagagggttaattcaacttcgttattttcctgcaaattttcatcttgattcaatgattctattccagtgtcatggaatttggttagaggggtgcagatttattgtaataacattacttgaatcgtaccaggatatcactcatctgaagtatttttatcaggggctaacgtggatacttcctgagcgctttgccaactctgagatcgcaccagaagcaggttcggtaaatgatcttttagtagaagtaacatttagcatcactacatcactatttgatatgcttgctgctttgtcttgtgcttcacctttgagccacactaacgtgttatatttgcaagcgcaaaacgctatttccatatcatgtgttattcagatgaaaaatagggtacaagtatcttggcatggtaactggtatttttggatgctagaaagtatagtatattggaataaatattatctaagatgtagacgttgtatatctaatgagttttgagatgatggatactcaaatgtcagtttgggcgttatgttttgacatgtgatgcacagtggccattaccacatgatgcatgtgactgaatattgatatgcccatggttccatcgccaagtactgttctctagaatgatatctagttacacataattttccaactttgtattgtgtctgggtgttagcataactgcttcttgtttgtatgtttgtgtaaccactctcctaggtcttggataacacatgccgtgaagctggaagaaatcattagccttttgtggatcaggcaaagattgtgatcaatatcgttgacacaaaaatactccattatatgttgcttctgaccatcttctagtcgttgaacattgttaactatttagtgctaatacaatcactgcttactagatttggccttttgtgtcatatagaggaaacaaacatggttcttactatcatctcgttatttatttatgcaaattattaagtatacgaccttgtattaagtaaaaaagctggacacctgttccttgtatacggccttgtagacaaattcttataacaataacactgaaaaaaccttgagttataccgaaaggatatgtaagtgttttgccgatactattataattttctttgcatcacaaggtgacagtcttcagccacaaaatcttgagtatgttcacattctgaaaagatatgtaactgttttgacgatactattctccggcgaacttgtattgttaaatgcactggcagtaaaactattcattgctaacttaggaatatgagtaccttccagttttgttattattccaaatcaaaccattatagggcctagctctttaattttgctaaggttttcccaaggatactttatgctgtacgaaacaaatcaacacttgttcactttgcaaacacatgatagattgttcttgggcactgttttcttctcttacttaaatgatgtattttgagtgttacaggcttgatcatttcacattaagacatcttttttttcctgaacagtatatgcatttctgggtatcgtgagttctgtcaatcagcacataattgaaacgccaactgatggtcagacattggcctccaaagagcaatctatcccatggtcccttgttgtctcagtacttaaggatattgaggcagttgttgaggtggctgcccagcactttgttggagatgatcgcaaatggagctttcttgctgttacagaagctgtgaagtaagatgataacttacgtatcattttcttggttgcataactcataactagtctgcgtttcaggcattgctcagaaaaatgataatggttgtgcaacatttcagagcaggtgtcaggttagctgctttcggggagagtggctacaagatgctcttacaaggaggagaggtggcaaatgaagaggagattaatattcttgatgaaaattttggagccaaaagtaatggagtaccagtcatttatccgatgaatggccatttccaaaatggtcatggggttgcatctaatggtcttgatggaaaggctggatttgtatcaaagagtctggagggaagagctgtagctgctcttaacaagtttggccagaatgcaaagatgacgtcagatcccatgtggatgaagaaggctctgcctcctcctgatcctcctggtaaaataatgattccctattggagtgtcatgtgtcgtgatctttgcatcgtattaccatttgaatcatgtatctctatgagtctattcacacagcgagttatttgttgtctgctgtgcagcgatggtggttgagaagccaactttggcaagtatttggtctgctaaaggaatttcagggcggttatttttgttaggagaagttgtccacatattcagaccactgctatacgtacttttgatcaaaaaatttggaatcaaatcatggaccccatggttagtgtcattagctgtggagatcacaagtcttggcatccattcacgtgcaactgatcttcatcaaagagggggaaaagttcatcagctctcatctgctgagagggacgaggcaagattattttagttttctaccttgttcaattttgtttgatcattttttctcttcttctgagttatctttttcttcattggttcaatttcatcagttgaaaaggcgaaagatgatgtgggccctttatgtcatgagagatccattctttaccagatacaccaagtaatgatctatgaaaccttatgataatagttgagtggtttgattttccgttttcttcccctgctcttacacttctttgatgacaggcgccatctccagaaggctgagaaagtgttggatccagtgcctcttattggtttccttacaggtacacgcaccttctccacatctataaaattcttccctacataaattcaaggaggaaacattttgtaacataagctctgcatgctcaattcattgcaggcaaactcgtagagctagtggagggggctcagacacgatatacatacacatcgggctcataaggataatggacaagcaggcagatgtcatgtctgagagtttccttaacgatttgccatgattaaccttttgtggttcatgtgatctggttgatgggttttgttttgagcttgatcctaatcctatctgtacatgccatttccttagcaagatttggcattcctacctgatgtcttggggctgcaaagctgttgcggccactgtaaactctcctctctcctctggtggcagctcagctgagaatctaactatactatagtatatcggtgtaatattaagaataggcacatcatccctgcaacgataccgtgtatttatttaccaattaccatgcaggacatactggaacccagaacaagtccaagagaaaattgcttgggtttttcatgattctgttgattctgtgttgcaatctagtgtcgatgcttgtgctctgtgctatgtaatagtaacatgtttgtatgatgtccactttgcccagctcgatcgccattgatggccattaggccatatgggttcgtattccgtagagaaacggtatgcatagcagatgaaaatgaaaaatgacacgcgtacaaaaacttgcttacaaacatcgtaaaatttgatatggcctgctgtaaccaaatattgtttttttatgattacccattaattaaatctaacggttgagattttgttttttaagttttttgtaaagatttttttaaatacgtatagcatttactcagagcaaatatttcacttgaaatattgctaagatcctctgtttgaaacacactttccttgttccaaaataaattatcctattaatatgaatctacacagacatactaaatatacgatgatatgatgatattctacattaagttaatttattttgggacgaaagtattattactctttcaaatgcaattcggatcaggacaaggagtaaggtggcccaaatttgatgggaccggcccatattgcgatgcaccgccataggcccaatcttcttaaggcccaacttaggaacctaatcccccacttcctccatcgcaggagaagccagcgagtacacaactcccgcgccgccgccgccgtcctcctctcttcctctcttctcccccgccgccgcgcctcccggaccacgctcctctccgctccctcccgcgtcgaggtgacctcccttcccctctctcccccccccaatctctcgaaggtgcagtcctgcgctgagctcggatcggtagtgtctagggctccgcccccgcttctagcgcgattagtccgggtgttttccgccccattggctggatgtagagctcggatctagatttatgttttctgatttcgccggtagattcttgtgttcgattcgggacccctgacgctcggtctccctggcaggttgatgcgatttttttaaaaattttttactatatacttgatttagctcttttcaccgatccatgccacgattcggtggtattttgccccttcgcgtttcgatatgtgaatgcttctcgatttagggtaaatttgttctgtatgaatttatacctttatgttttagcttatgagtttggtttctgttcatacaccttttctattttcaagttaaggccaattatatttttgtatcattttcttgattataactgttgcccaatttatagaatcagcagagcttgtagccatctgaaggaaaagaccaagcagcagccatggcatctcgtttctggggacaggtaatcgcctttccgtttgtactggcagtgattcttctttgtatcaatattgcagtaacagatatgaacccttttatcattggttacaataatttaatactcttgcatggatctactcaacttcagggagacagcgactctgaggaggaggagcaggagattgagtcagaagcaggaagtgaaagtgaagatgaaggcggtgatgccgggggccgttctggcaaccagaaccgctatttgaggactactaatgcgagtgacagtgacgagtccgattctggtcagcgtgtggttcgctctttgaaggataagcgcaatgaagagttgaaaattaccgttgatcagatgcgcaatgcaatgaagatcaatgactgggtgaacttacaagagagtttcgagaagctcaacaagcagcttgagaaggtggttcgtgtcaatgaatcctccacagttccaaatatgtatatcaaggctcttgtattactggaggacttccttgctgaagcacttgcaaataaagaggccaagaagaagatgagcagcagcaatgcaaaggcactcaatgcaatgaaacaaaaactaaagaagaacaacaagcagtatgagaatctgatccaggaatgcagagagcatccagagcgttttgaggatgatgatgtggaagacaaggatgatgatgatgagacagaggatgaggatagtgatgcagaggaggatcctgaaaagatagcaatgtctgaatcagatgaaggagatgatgatgaggaggatgaccaggatggtggagactgggtaaggcatacgaataagaaagataagcttatggacaagcagtttctgaaagaccccagtgaaattacatgggatattgttgataaaaagctcaaagagattgtggcatcaaggggtaaaaagggcacggggagggttgagcgtgttgagcagctaacctttttaacccgtgtggcaaaaacacctgctcagaagcttgaaattctctttcatgtgatttctgcccaatttgatgtgaaccctagcttacttggtcacatgccagtcaacatgtggaagaagtgtgttaataacatgcttcttgtgcttgatatactgcaacagtatcctaatattgtagtagacacctcagtggagcctgatgagaaggaaactcagaagggtgctgactatgatggaaaaatccatgtgacgggtgacctggttgcgttcctagagagacttgattctgaattttttaagagtttgcagtgcactgatccatatacgaaagattatgttcagaggctcagggatgaacctttgtttctggttgttgcacagaatgtccaagattacctggaacatgttggtaactttaaggctgaagctaaggttgcactgcgtcgtgttgaattggtatactacaaacctcaagaagtatacgattcaatgagaaagctggcagagcaggatgaagatagtagggaggatgaagacgcagaggctgatgaggagcgtcaagtatctgataacaataggggccctccgccgtttgttgtgatccctgaggtcgtgcctaggaagcctactttcccagagagtggcagagctttgatggatgcattgatgtctgtgatttacaagtatggagatgaaaggaccaaagcccgggcaatgctgtgtgacatttatcaccatgctatctctgatgaattttctgttgctcgtgacttgcttttaatgagccatttgcaagatggggttcaactcatggacatatcgtcacagatattgttcaacagagtcatggcccagctggggctgtgtgcttttagggctggtttgataatcgaagcgcatggttgcttgtctgagttatattcaactgggagagtgaaggagttgcttgcacaaggtgtccaacaaagccgataccatgagaaaactcctgaacaggtttacttctgaactccctgcaatatgcactgcttttttcccatgtaaatttacctgcacacatgtcaattctcctcacaaaactattgttttgttggaaagaggtcaatgtgaattacatctggcactgcaattactaatcagttgactgtattctaacatagttatgttcttgcatttcctacatcttttgatttattattgttattatcatatttgttttttttaaggatagccacatactgattttagcattaaatgctttgattgctctatcacttataaagttataatgttagtgtctccatcattatctgcctttttattttgtttatctagacctagaaatttcattacatatgctgaggctcatcgcagagctgatcttattctactaggaataatacttcaacagtaatctaaagaggtaccacacatcttctgtacttttttttatcataagtgctaatattgtaattgctctaattcctgcaggaaaggcttgagagaagaaggcagatgccttaccatatgcatataaaccttgaacttttggaagccacacacttgatttgcgccatgctgattgaggtccccaatatggcagccagtacttacgataagaggaagtttatgaacagaacattccgcaggcttcttgaaatcagtgagaggcaaacttttgtcgggccaccagaaaatgtgagggaccatgtaatggctgcgacaagggccctcagcaagggtgaccaccagaaggctttcgatgtcattaattcgctggagatctggaagcttttgaggaacaaggagcatgttcttgagatgctgaaactcaagatcaaagaagaagctcttagaacctatctcttttcatactcttcttgttaccagtccctgagccttgaccagctcacgacaatgtttgaccttagtgagcaacaagcgcacagcattgttagcaagatgatgatgcatgaggagcttcatgccagctgggatcaacctaccaagtgcatcattttccacaacgttgatcaaactagacttcagggactactcttccagatggctgataagctctcagtccttgtggagagcaatgagagggcatacgaggctaaaactggtggtacctttgagggagcaccacccaggcgtaggggtgatgctcaggactcatccaacttgggcaagtggcaggagaacttcgtatcatcacaagggcggcaaggcggcgggaggtccggatactctggcagaggtggaggctctggaagaggtggtggtggctaccagagggacaggggcagtcagggttctcgtggaggctatggtggtggttcacgcttccaggatggtggaagatctcgcactggttcgatggcgaagggaggaggtgatggcggtgcacgcatggtgagcctgaacagggctggtagaggttagagaactagttctccaggatagtattcagcgcaaagttttgcaagttctgaagcaccaatcaagtttctggcattttggaagtcgcatctgttctaaacctggtcttgtttcttaatttcgttgcagcttacagtttaaaacattaaatttgtcgaacacttggacaaagagctctctggtttgtaccatgggagtgaggattatgtattcgctcctatattggttatcatgctggcactattttctgctgttattgtactgctttatgctaaatttaccttgtttatctatgcgcatgtgtgattcattaatctgttggaaattacgtgttgatcggaaccgatgtaatgttgaaaaattatgattgcgtttgttaaaatgcaatgagcgatggatccttttggtattaagttgttgaagataaacctgaagacgatccatggctgaacgcctgaaccaatattgtgatttccggaaggagtatcaaggttgtgttatttggaacactaacccaattttactctcatgtactgttgtttttgcctaatagttacatcacttgatgcgttgatgtttaactttggccatttatccaaacaatatttacaaggaaaaaagaattctcgttgcattgtacttagaatctgagatgctgctcctgtattgctgtctgtaattgcatacattttctggcagaaatttcacctctggtgatcgatgacaagaatgcccgtcattgtgtatgtgctcaagatgttggtttccctgtgtatcagcttcatggcatttgagttagctcagatactatgcttttggagggtagagatgtgaattatgaatatatgagattgtctgaaatgtaaaattatgaatttatgagattgtcagaaatgttggtgtgtgtctcatgttatcaaatcagatagtgaatgagtgattgcatctctaatcttccattctactctataccattgtagtggcagtgtacatacaatactagtatgacttctgaaaaaaaaaaaagaagcatagcacacaaggcaagctgatatcacaaccttgccatagttctgttcaggtttagttcatcgcttcctacattatcgagagatttatgacgggtagcttgtgagcttatgtaggagagggactgcaaccaagagacaagtaccggcttccgtgtgacatcatcagattctgcaacatgagcatgcatgtcgtcaaggagcacatcctgaccttccttcggtagcagactgacgaattccgccagctccttcagcagataagggaatgactgcagagagggcaaaagagggtgttagtagtgcatggtatctgcaacttcaaaggcttatgcactctcaagactcaagagatgaaaaacattggaattgaatgatagcctcaataaagccggttgaaacatagctaccgagtatggaacacagtggttcgcgagtcattcaatcaccaaagatacagattttcctagctagtgaagtttgtaatgtgacaaataaatttgtttgtgattccatgattctgcagtaaaattatcgtcctagaaactaagtaccatcctgaatacaaccatggaacaacacatgaatattccagaaaataaatactactctacacatgaacaaaatattggtcaagagagagatcttacctgaatatccacgaggaagatgagccgcagcaacaggtctaatattttcttacaaggttctgtgctaccttcccatgacctccacaaggatttgtcctctaccattgaggtatggcaaagatctttagccttgacaacaaggttatggatacagaaaagagtggctggactcccagcaggaagatgtcgggcgagtgctgcaactcctgatgctaatccttcaaagggagttaccccaggataggcctattaagttaaaagaaaatagccaactaaattagtcttccagatagaaatcaaatatgggaatagtagccaatgagttacctccaaagttctcttgatatagtaaaaagcaagttgttctttcaaagccattcgatcatccggatcagtatcattgccggatgacaagaaagataccaccactgagtgtgaggcacgtgttactttctcatttgaatgctgtatgtatctgacaattttatgataaggacactttttcttaatatcgaaaatctagatagccaagaacaaattaaatatcaagacaaaaaataacaaactgcagtttgaaaggatacaagaacatgatcgaagctaacttgtcctgaatcatgtgggctggaatgaggctaatgcaagttggtataacccgcagataaaacaatatgcgtgatgtctgaaccacatctccgtgccagatatatcttgttccatccaaggttaataaatctacaatatgccaaaaaaaggaccttaatgaacagtatcagaatcagaacggtaaaatgagacaaatgggaattaaaaaatcaacctggtttacttgtcaattcagcataagaaggaattgactcaatgaacaaagcagcaactgccgcattttcctgattgacaagaacagcacgccggactgcctcagtgtactcaggaaggcgcaagcgtcgcagatgttccaaacaagagaaggacaccaagatcttaacagcaacatctggttggaatccctctgaggacttagcattcaacctgtgcttagtgacctcggctgaaaagactacaaccataaggaatgcagcctcggcgatcttctcaatatctgtgatcaaatcatcctgcttcccctgatgcaaaattactgctgcacgaagatgacaatacagcacttgtgcatattcccatacacacgtttcaacagaagttttagccttatcactggcaaatgaatactgattacagagaattccagcaacaggtccagcctccttgaaaagcacactatccagatgttgcttcacccgattcttgacaatttcaggtgaattcccatctggacattgcacagacatcttgagcaaatctggcagaggaagaagctcctccagtagcgccatacagacacaacgcaacactgactcatgaggagtgacctgcccacactgcgtcaagcccaatgcaacacattgaagaagtaaacgcctatcatcgacgtgtttcccttctaaaactgccttctcagctgcaaatcggatagtccgctcaggcgcctccttcaaccgtggatcaaaatccagccggtatctcgctgaagcaaccctcaatgccctcagggcaccacaagctaccatcaccaccggagacataacatagccctggctctgacacgactccggtgaaatcatctcgaatagaacctgaactttgcgcatcttcctcgactcaatgaagcccagcaacaaccactccaccagcttaagcatcctaacaccaacagacaggctcccgatcctcccgcaaatcgtaagcaaggatccaataattcttctaaactgcagctcatcagcagatgccaacacgcaaccaataccagcaagagccaggtgatcaagatcatggcagctctcgctccccttctccatgtcatcaagaatgcgagctacagccacaacaggatcgctatcatggccatcgccggactcgccgccgccgccgccgagattctctgctgctgtgctccccgaattggcatggctggagaggctcttagcactcctagaggaggcgagtgcgccgaggaggaggaggcgaggtgagacggggagagaggcggggagagacggcgggaggaggtgcgggctggtggcgagcagcggcgagacgaggcgcgggtggagcgggagcagcgggaggaggagcgcgacgtgggcggaggagaggcggagcgagcggcggtggaggtggagggtctccagggcggcgagggcgtcggcggcggcgggggaggtggggttgcggaggtgcgaccacgcggagaggatggtggtcggggcggggggtcgaggcggcgacggtggcgcgaaggtgccggactcgaggaggtcggcgagggccacggcggcggccggcggcggcgtcgccatggctgggcttggaattggattggagttttggggattaattgagaggagttgagactgacacgacgacgacggcgacgctgagagttcaggctcgcgacgacaaattcgaaccgaattctgctcggtttgtgaatagttttgaattttgaccaccaatctaatcggcttgtgaatgattttgtattttgaccaccagtctgcacgatttgtgaataattttgaattatgcactattttattttatttcgagggaatggacagtagctctgcctttcatatacgtactacttaataggtttacataaaaaggagaaaacggtatgcaattagcaatcctgcactgttctacgagacaatctacccaggtattccgtagttaattttctcttattctgaatacaaggtgcagtctggaagaattcttgtagattgtgttttagctagcagtttatgaagtaatttgctgaataagagtcgaatcgaatatgaaatttcatgatacttagcagggatgctaaaaatttattgattaggcgggctgcagaagcgcaaatacacgaaatatagatacaattcaagttcacactttttttttccctttgaataacaattcaagttcacacgatcccaacaacttcatccttcagcacaagaagtttcagttcagagaaaaatgattgcacaagaagctcccagggacagtagaaaagcccccattattgttcgtgctaaagactcataattcatcaagcaaacaggtcgattccccagaacttggcaggctggttggtgcggtacttccggtcgatggatctcatcttctccatgtcctcgtcggagatggcgaaatcgaagaccgcaaagttctcctgcaatctctcctccttggatgtcttggggatcaccactgtgttcctctgaagcccccaccggagcaccagctgcgccggtgtcttgccatatttctcagccagagactgcaccggcatagaagtaagctgagaaattactaccaggttttcacaatgtgacactgaaatgtgatgctatgcaaaaacagtggtgatggtttggaatgtcatatcatacaaccttgatgacagggtcgtcgaggcatgagacggacccaaaccactcagtattggcagtggagccacccagaggggtatgggcagtgactaagatcccatgcttctggcagaacttgacaagacagtcgcgctggaagtagggatgtgtctcgatttgattcactgcgggctttatcttagcataagccaaacaatctctggtaaggaatatgtcatagttgctgcatgaacaacaactcactggttagattcaagaagttgacttcctctgtcatgacagatgagcaaacagcagtatgaaaattgcaagatctacgatttctcccaaaattttttttgcaagatctacagctaccttttggttcttctgtatgtcgacagctcaagtgattgaaattatctcatagacctaggagctagtatccatagtggttactaaaaagaatgacattactatcggacaagaaaacctggattatcaagatggtgataataacaacgtacaaggaataaccaaatattgtaaggatgcttccagagattaaagaaactaatctatgattatagctagagaacaattggtaatattgatttacttcacctaatcccaatgctgcgaaccagtcccatggaaacaagatcctccatagcgtgccatgttgtctccaatgagatagtggtatcaatgtctagcacaccatcatcaccaagagcactagcagtcgtaccaactcctgtaaatgacagaaatgttcatattgtcagtaatccaatgaaaatgaatcaatgttcttccactatactagataaaacaagaacagagtctataccagtatgacgggtagctactgggaagtggataaggtagagatctagataatctagccgcaactttttcaagctatccttacatgcttcaaccacatgcccatgatctgagttccacaactacaaccaaaaaaaagatacagaaccttcaatcaaataacatataaatgtggagaaaagaatagcgcactagatgaaacaagggctaattaattgcctgatagtacacttgctaagtgaaaatcaggtgtaaaacaacatgatagtagttttgtagtttcattcagaacgacatcagggggtagctcccatagtcccaagtacaacagatgtgtgcaataacaattccaaagaaaggtaaagaaaatgcaatacatcatgagaaaaaaaaaggaattccataatgtaacactcatatttaggctaatcatgccaaccacctgtacgagtcgggggaattgggttcataacattgtactataccccttttctaatgaggcagtagaaactaaccagtaggtgaatatatatatatatttttcagcagtaagaaaaaagtagtatattcatggtttgaaaggaagacaattgtattgtccaatcttaataaccttggttgtgatgaaaagatcctccctcttgacaagtccagtttggaatgcctctgcaagtgcatccccaacttcagcctcgttttggtaatcagctgcaggaccagcaagcaagcacagttagcaaatcacctaaactaggcaaaatttcccaaaagacttggaaccatgattcataatccctatcaattactccagaatatatgattgaacccccaaaaaaagaaaaggaaaaggattcataaatccgctacctattcaagacaaacttcatagagtactcgctagaatgaacatgatatgtttacatctccaaacaacacgaggccaaaacgattgccaattttaacttccacagtgacgcacaagcacacaagcaaattattgcagattggcaattctggaaccgaccaactcgtagtcgtagcaactccggctcggctcgatcggagcaacaggcgggaggaggagaagggaagtgaagggaagctatggaggtcgctaggttgggggtggtgttgttcaataccggcgcagtcgaagtggcggtagccgatgcggagtgcggagtggatgaggtcgcggatggcgggggagtccatccgccacacgcccaaccccaccgacggcatcgtgtggccgctgctcagcgccagcgccgccggcactccgctcccctgcgccgccgccatcccgcgcctctgctctgctccgccgcctcgttggaatcggagacgagaagaagaagaagagtgcgtccttcttctgatgtgatgcactaccagtgagattctcgatgtgcctctcgtctccaagtagattggcatcttcacaagatagatagacactgtgatggccattgctgaggtgtgcaagaattttgtagatataataaccttatttcttgtatctaacatttcatcgttcgtattatttaaattttttttatgattagtatttttatggttattagatggtaaaagataaatattactttatgcatggtttatcttttttattttttcataaattttttaaataagatggatgatcaaacgttagacacagaaatccacaattgtacttaaaatgagacggatgagtatgtatttatttccttcactacaatcatttcttgtactccctccgtttcataatgtaaatcattctagtatttcccacattaatattgatgttaatgaatatatatatatatataatatatatatatatatatatatattcattaacatcaatattaatgtaggaaatgctagaatgacttacattgtgaaacggaggaagttggtatttatttcctccattacaaaatattttttgtaggtatttccgtgatagtacaaaatttgtaccacgatataagcaattctaatgtacatgaatccatgcatttccaatcgcaattgagacgactgagtatttactaaacagcttagaaatgcttatacggatagagtaaaagacatccattccaaatcaagagaaatttggggggcaatacagattgatttgaagttcttaaaaaataatagaaacctggttttgagtgaatttggggtgtgctggtgttgatatatgatttctgaaaggggattggttatacttatacatctgtgtacagcagtaatgcaaaagcaagcaatagaggagatacttgaatacattccatggagtaatattagtgtaaacaaattacaacggagtgaaatgctaaacgatgggattcatgccctccaaatttccagaggtgagaatggtattcacaaataaccagctaaaaatactgtcaacaaacatcaagctcataaagaaacaaagatcgcgctgattcatcgctgttgtaaaaagaaacatacaaaatctgactaaaaccctgttttcctcaaatacatctgatctctctccttttcttttcatgctgttaatgcacagcatgccctccctcagtgtcaaggacatgtcaaaatcttacattaggtttgtacagccttggtacatcaagcctcatggaatattttcttcgacatgccaaacacaagctaaacgaaatcgttgtgcatttctgctcacttgccgcgcttcaaatcaaacacaacgcacgcgtctgcggctgatttcatctgcactcgggaaagatacatgaatgttaagaaacaagtcattattaaagtagcactattattattgctagaatcatataaatgaacactctaaatgaagaatacaatgtattagcagttgatctagctacctaatgtaaaaatatatgagctaaccactgcattgacactttttctttacctctagatcagacctattattagtgtcataattacaactcaatacttgcagacatccaaatatcaagcgcctgcaactgcaagaaattttaaagttgttttcagcaatacctggataacattgatcacttgtttcaacgcccaaccaactagagttgaaatgaaaacaaagacagtgagaggactttgcttcagaaggtttccgcacacctgttacatacagaaataccatatattaaccactacaacaggactgttgattggataaggcaactgtggagatgatgtcttcttacattaagcaagcttgttgacttctcatcggcgaacagaaaaagaactatgtacagaacctgaattttggaaacttccttgttagaaggtgaaacatttaagagcagttcagtcagcagcgtaagggtgctggacatgatgagatggtaactcatcaactatatcaaatgcctattcagtgctacatgggcagatgtaagataggttcgttaggattgttttgagcacataaacacatcaattcatgcccatcgttcagctaaagtagtcaaaaaccatccagcacagcactcatgttgtgcatgcaaccaggcaaacacccatgtagatattgcaaaatatggattaatcatgtacctccgaagcaacacaacagaaggccatgaatggtcggtgtccataatataacttcagaagccaattgcctgtgtcttttacatccttgtggctagtcttacctgataggaacgaactaataaaaaaaaggcgccatcaagtagttagcaacatgtagaagtaactagagacgcataacaaaactatagagcataactcttgtctttgaacaaaaaaaatgcatcatgaaaaaaggcattctgtctttctgaacaacacgatagtaagtgataatattctgctccctttaataccttccggaagaggatgcacctactaggtgaagaaaactataaagtggcactaactgaaaaaatggttagaaaactaacctgtacatttgaaaccaatggcttgtaatatccaacccaagcaacatcaagaaaactaagccaggtctgcaaagaacatgcaaatacaatttgtatcaggtatctagatccaaggtacaacaattgaagtgttttctgctgtcacttacctgtaaaactgggagagaagtgccaacaaacaggcagtgctaaccctgaggaaaagcaatgtgaacagtgaattatttcaggatgcagaatgtattcaccctgcatattcaatgaatgattcgaggagtacctatctgttaccatgtccagcacagctccaaatgttgatgctgatacatagaatggcattaactgatcagataatgagtgaggataaaccaagatttaactgttgagcagtatttcaacaatagctttttagaagttcatcctataatttactcttcattgaataactagtgctacaaagtctcaaggcagaaggcaaaagaaatagaaataatattttctgcagaaggacaaaatatgactttgaacacataaggaacacttattagttattaccttggttaaactttcgtgcaaaccaaccatccaagccatcgcagaaaaagctgatagattctgatgatgttaaatttccagagatacaacaaattgccaagtagtctggataaatttataacactcacctgaagaagtataggatagcaaagagcaccctattggaataacatacggcaaaagcaatgaagtttatgatgatcctaaaatatcctgcattaaagcaagatgccgaacagtttgtaagaatttttttccatcacctctattcaaccatatgtattctgttacgctatttccaaatattgtgtttctagttctcctgggttggtattattacaaaaataaaattttcccagtacatttagtaacaatagcatagtgtattaaacaagaaatcgtacagaagctcaccaatgatattagggatgtaaagatagactgacggcgtcttcttagaagaaggttgtgccattggagatcagtagttattacttgctagaagcctgaaagcttctcccttaaattgtagtcctatataggaattcctgtaaaataattgcatcagtttatagactagtccaaataataatgtcacagtgcaacaagcaacaaattttaaggaaacaaactagtaccataacaattgacatttatgacaaacacaagctctcgagcactagccttgaaaatcagagcaccaacagagggtgccttgcagatcactaacctactaactcacgacatcttttttcgacctaatgaaaagaaaaccctctaactaaattaaacaaccagaccaaatttccaattttccataggagcaaacccaacccaaccgcatatgttcccgaacccaaactactttgggtggcaaaacagcaagagccgcaagccctcaaaacccgctaacatcatcgattcccccccccctcgcagaattcctttggtgggcaacaaacaaaaagagggaagggcgccgcgcccgcgccaccttacctcacctcacgaaggggtcggggaggaagacctagccgtcgccgacgctagggcggccgcgccgccgcgccgcgattccggggagtcgccggagaggaggggggcgcggggatggatgcgtggaagcgagagccgagtcgccgccgccgccgatggattgattcgatttgtcgttcgattcgatgcttccttccttgtgcagatggatcgattcgatttcgatgctgctccacgtcacccgcacaggaaaaataaaaaggagacaaaaggaaaagggaaaagcggaaaaccgcgtcgtgggctggcggcaaagccgtggtcgagtcgatatcgtactgggccgaacaagggtcgagtcgatatcgtattgggccgaacgagggtaacgtactgttgaatgtcacttataggcctccatttcggcccttataaatgagcccaaattaagcatggtgacacgaaaaacgaacagggacactagaacgtcattaatcgattattatactaactattattattattattattactataaacttataaaaaatactttttaattttttaataaaaatttctatattgatttttaaaaagagtaccatttaacagtttggatatagtacatacttacggaaaatgagttagcatatttgagatattgagtagaatgtagcttaaggctgagttcgtaagagatggttgagaagctctttctccctacatgcaaaacataatggtgtattagtgcttctctccacgcacgcaaaatgtagcggtgtattagcgcataattaatgaagtactagcttaaaaaattcaaaaattagaataacatgatttttttaaagcacttttatatattttccttatttaaaaaacataccgtttaacaatttgagaattgtatgcacatgcggaaaaaaagtacttcatccattttataatataagacttttagtattgcctatatttatgtagatgttaataaatttagatatatattgctaacaaatcttatattataaaatagaagaagtagaagttttgaaaagtacacagcctaatgatgcatacaagagaccattggagtacgcaacaaacaggtccatcccgtgcttattagcggtagcggcggtcgtggatgaggtgagaaatatggacgtgcacgtgaaggaaccgatccccgccccgcccgtgatcgagttgaagctatagccattgcaagcggccgtaattagcgacgcaattacggccgcattgacagagttgaaaaatgcagagagagagagagagcagcagcagcaggatgagaggctgaattcacgcgcgcctcccgcccggcgaatcgacggaaatgcggcatccattcaggtaggcgggcggccggccggccggagaatggaatcaatgtcgtacgtacgccgccgtcgtcttcagataagagcaattaattaagcagccattatgttttgtcggatcgactagttgcattgacgactttcactctactacctagagttagatagagacaacagcatttgtatttgtggagataaaaacaagcggacacaaagaaaatgccctccaacgccaaagacaaatctcagtaaatcaagccgagaatgcatgctacggtttatctacacaccatgttgctttgccaatcactccatctttcttggatacgccagtaccacatgaagacttcaactataaaattaagtatatataggagtagtatagtatactttggggaggtattttcatccttaaaacaatactccctccgtcccataatataagaaattttggagggatgtgacactttatagcactatgaatctgacttctagattcatagtactatgaagtgtcacatctctccaaaatctcttctattatgggacagaaggagtatcttcttgtttttcatgtcatttcaaccatcattgtttttttttaaaaaaatgatatgataaatcagtatgaaatatgtcaaacattgaaaaaaaacattttctccttactcgtacaagttaagtttgaacttacatacttatgaatgaagtgatactacatataacaggttaatctctcttaatacttttataaataaattaattatgttttagtgctatgcataaaactgggatgtcctctgacaatcacctcctagccatgttcaattgctccgatgtgttttaatttgactcattgactgatacgaagcaatggctgcatataacacggtccctgctgcatctgcacataacgtggcttgcgcactggcactagcgcctaacgtaactgccacaactgtcagtcagcacaagttgaatcatccgtccgtgacccccgtggctgcacctgcatctgtacgtaatggttgaccacatgcatgcatgcatccaatccaccagctagtatctccatctaactaaaatataaaaatttataaccgaataaaacatattttagtagtattgatcaaaaagtgcttctatccatactcgtaatacaacgatatatcacattcaattataaatcatttttatatttaattttgaaacgatgtaagtagctaatgtatacatctgcccgtctcgtaacagacgtcacgtaattcttatatttttagataaggtaatagctaatgtacctgtcccataacagataccatatgattcttatattttggtacgagagtaagtagctaatgtaccagtccactaacagacgccactctccgttgcttatgctgttatgcatgcttcatgcttccaaccaacaaataactgccactaaccgctatatatatcgcatctcgcactgacactagctaaccaaccatgcatgttaattaactcgtgcacatacatacgccacgtactagcatctgtctgatctgccaccatgtccagggcttgcttgctcctcgtcgtcgccgccgtctgcctcgccggccgcgaggcggcggcgttcaactacgccgacgccctcgacaaggccatcctcttcttcgaggcgcagcgctccggcaagctgccgccggggcagcgcgtcgcgtggcgcgccgactccggcctctccgacggctccgccgacggcgtggacctcgccggcggctactacgacgccggcgacaacgtcaagttcggcctgcccatggcgttcacggtgaccatgctgtcgtggagcgtcatcgagttcggcgacatgatgccggcgcgccgctcgtcgttcctcggcggcatcttcggcggcggcggcgtcgcgcagctcgacaacgccagggccgccgtgcggtggggcgccgactacctgctcaaggcggcgacggcgacgccggacaccctgtacgtccaggtcgccgacccgtaccaggaccaccggtgctgggagcggccggaggacatggacacgccgcggagcgtgtacaaggtgacgccccagagccccggctccgacgtcgccggcgagaccgccgccgcgctcgccgccgcctccatcgtcttccgcgtctccgacccctcctactccgccaagctgctcgacgcagctcaactggtaggcacagacagctagctgtcacatactcacattcatcttgatttgattttaaatttgagaaactccccagagtcttccgctatggtggattagacgatctgggtagtctcaccccttctaattatttgatattaagtactttcttaatatttatgtctttttatttgattttaaatttgatttgattcttgtgttgtgcattggcgcgcatgcattgatgcatatgcaggtgtttgatttcgcggacaaatacaggggatcatacagcgactcgctgagctcagtggtgtgtccgttctactgctcccactcctaccatgtaagctacgcaacctgcagcacgcagccaccgataatttgttcctagtcttggaccttttctcttgtccctttactcttttcaatacatcacaatatgcactgcaattttgtcttactcatgcacgggcgatataccatccctaccaactttttttcaagtcttgtctgaatcgatcggccagtagaatgcagagcacacaccagtggacacatactgctccctgcacatatacagatttctctgaattttctgaattctgtcatagatctgtttcaattgaccaagatgatcggttgagagtgtagcacggctctacccctcccgctgtttggagtagagttacccgtcgtacgagtttttctttttctcccttgttttttatctttgttttcttccttccttggtataggtcggtctggctgattgcgttgtgtaacaaaaactctattcttctaatatattagtgtgcaatctttttatgcgcttgcgaaaaaattgaccaagatgatctgattggttgatcgaggtgtgatgtggatgcaggatgagctgctgtgggcggcgtcgtggctgcacctggcgtcgccggagaagaaggacgtgtacctgtcgtacatcgggtcgaacggccacgcactgggcgccgagcaggacgacttcaccttcagctgggacgacaagcgcgtcgccaccaaagtgctcctctccaaggcactttcagaaatcagattcatcgtttcgcttatgctaatgaatttacagaattaacttgtgcaactctgtctcagggattcttgcagagcagagcggacgggctgcagctgtacaaagcgcacactgacaactacatctgctcccttgtccccggagccaacggcttccagtcccagtacacgccaggtacgtagtgcaacttaggtggtatttaaaactcatttagatgagtatcaacattaagattaaatgttttacgtaaaaatgagatggtgtctgattaattgagatgtaattattataaattttttaaaaaatatttatctaatattttatagcaactttcatataaaaagtttttatacgaaacgcaccgtttagcagtttaaaaaacgtgtcacgaatatccaaaatttcatccaacttttgttggagaaaacagaaaagagcataacctatttctttcgtcacaaaataagttaatatggtatgctagattaacttattttagacaaaaaaaaagtaattaatatggtgatttggtgtcgttttcagctgctgagtaaattactgaactgaatttcaatgcaattaatgcagggggtctcctgttcaaagaaggcgacagcaacatgcagtacgtgacatccaccgccttcctcctcctcacctacgccaagtacctctcctccagcgccgccaccgtctcctgcggctccaccgccgtctccccctccaccctcatctccctcgccaagaaacaggtagtactaacaaaattcactcgaattcgacaaaattcaaccaaacagctcactaaaactgaacaaataaactcatctgatccaggtggactacatactcggggcgaatccggcggggatgtcgtacatggtggggttcggggcgaggtacccgcggcacgtgcaccaccgcggcgcgtccatgccgtcggtgcgcgaccacccggcgaggatcggctgcgacgaggggttccgctacctgcactcgccggagccggacaggaacctgctcgccggcgccgtcgtcggcggccccgacgccggcgacgccttcgccgacggccgcgacaactacgcgcaggccgagccgtccacctacaccaacgcgccgctcgtcggcgcgctcgccttcttcgccggagcgcacaagatcttcacgccatgatcgatgaactcgatctagcttacgattaagcttaattatgtacgctacgagatgcatgtgagtgacgatggtgtcacttcgattaattgattaattaattggcgggtgaatgcaattgtttcgcgcctcgatatgattatcctcgcgtgatttgcatgattgtgtttgaaatcagtacgaaattgttggatcacaacgtacagttaacttggcagttcgcaacccaattgaacctctgaattgagacaaatatgggtgcaaaactgaaattttcttctaaaaccgtaatcaaatattccctctgtcccgtagaaaacgaatctaacaccggatgtaacgtattatagtactatgaatctagacagatgttcgtccagatccgtagtactaacatgtgtcacatcctgtagcgcccgttccgtcgtggcgcatagcgggaaaatgtaattcctaaaaaccctaattgcgaaaattgtttcttcgcttgcagtcagtctctgtgccattccagatctcaaatccccgatctatcgtcaagttcattcccaaatccaaatccttcccaaatcaaatccctccgcaaaagtctattttgcctccctcaggttcgatgggccgaattcctctcggcccatctctccctccctccctatctctctctctctctctctctctctctctccctccctctctcccccgctctgcccgtgcgccgcgcgcgcgtgcgcgtgagccgcgccgagccgagcgccctccgtcctcgctgccgcttcccgccgacgccgcccaaatcgccacgccgcccgttgcttcccgcgcgtgcatgccgtggtggccgaccgcctggtcgccgccgccgtcagcctctgccgcgcctgtccgcgcctgccgcccgtgtcgccgctccgctccacaccgcccccgccgtcatcgccgtcgtcacaacccggctccgccactctgcgcgctagcttccaagggacggaggcagagctccccccttctgccgcgtcgccctctctccctcctccttttccccaaagtggcaagggggcaagcccactttccctcctcctttttcccttttctctcccgccggcgtcattcctccctgtcaccgttttggccgcgatcgccgagcgctagctctctcccttgaccgccctaggtcggttcccaaaccgacgttgccatcctataaagcccaggcgccctccctcccttctcctctcgttttgtcccatcgcctccactccattgtcgccgcctcccgtgctctgttcgccgtcgccgttcgtcgtcgtgcgtgtcagaggagccggcacgagcgaggacgcggaaggggactccgggtgcgccctcttcttcctcttccccggcccgaggctggagagatcactcccgtgccgtcggcctctcgtcacagcgccccgcctcatctcggtagtgcattcccccgttctccctcctcgatccatctcctccccttagactcggttagtagcgtgtgtagtaccccagtagctagctggcgccgccccgactgctgctgtcgctcgccgtgtgctcaccgccgtcgccgcccgagctcggaagcgcctctcgtcgccggcctccctcggtgcgtttccccctaatccggcgcaagggatggattcccgcagccgcgtagatgctctcaccgccgggaatcagcccctcgtgacctcgtcgccgtttcccccttttctcgccgccggttgccgccgccgcaatccgccgccgacgaactccctccggcgaatccaagccgttggctcgcaccctctcgttctccctcgtcattccggtgtacaccccgtcgcccctcgtcatcgcacggcgtcccggagaaaccgccgccgcccgccgtccattcgcggccggcgccttcgtcttcctccagccggcccgcgtggcagccacgtcggagccacctcggcacgaccggatcggctgacccggtcagccgctccctccgttccaccctccccgtgcgcgtggtccacggtgagccgtaaggctgcgcgtgggcccgccgcacccgcgtcctccacgagccgcgcgcgtgcgccgtgccccggccaaaccctagcgccgccccgcgtgcacctcactcacggtgagccgagccgccaacaagcgggtcccacccggatccacgcgagatggacccggcccaccggcttcttctctcctccccgcccgcgcgcgcgctttgggccgccttctcgggccggccggcccgttaagttcggccgagccgcccctttctctcgggccgcgccctagccgcccgaggaaagtctaatttccctccctctttcttttcttttcctttctttttcaaaaaggatttaaataaatccttttcctttagatcaaaaatccaataatcttagaaattcaatatcttcccaaccgtaagaccgtttgactccgttcaacttccaaaattcctcaaatctcgagatctatctaatggcatgcttagaggtcaatattagggctttatttttgccatttgttgagttgtcccgtttcgcgtgtagtttcggagcccgaagacctgcaatgcgaggatttcgaggatcaagctcaagatatcgagcaaggcaagccacctttgaatatattgagcctatatttgaacttaattatattgcttgcaaaatattatgcattgataggattgcacttaatctgtttgccccgtctgcaagacagaccggtgggcctacctaacttgttgcatctgatccatccattgttaatcgttataccatgttcccttgtaaccacctagttgcgtctcggtaatcatgcactctgcacgagtatcgacggtcgccttcaaacttaaaatctgagaaacatcttgggtaaaacttgggttttacaaaagatttggaaaacccgacacctaggtcggtgcctgcgaactaaatgaatttccaaaatcgcggaccggggaatgtaccgggtgtacggtttcccgctcttgcacttaaggaccgtttccttggaatttcatccgaacataagacaagtgcgaccacatgggtggaatgagacacccctggctgagtaactagctaatcgggggagccttgatgccgagagacatgtggattcaacggggtggtgtcggggagaacccccgggcttcctggcacagtatggtctgggacctaacctgttgttggtctgggacccctctcgtcggcatatggcaaccctgtgtctgctctcgaaatgccttgtcatgaaagcccttaggtcaccagacgtggccgttctacacgggctgggtgattcgggttagtaatgtcgtgtgggtaaagtgtaccccctctgcagaggttattaaactgttcgaacagccgtgcctatggtcatgggcggatgtgaggtgattcctagcgtagttttgtttgactactgctttgtgaaatttgctgttgtggaattgggttcgatgtttggaaaatctgcggctgatgggatcagccaggcccgggtggccgtttgaaagctgttggccaggtgccaaccttgatcaaatcaaaagactgatacattgcacatactccgaccagacgagacgcactgtctcatccgtgtcgtttgagaagcactcacttagttgtttcagaaaagagtttaaataaaatcaattgcaaaaacaatagcctttccttcgaagcctgcattaaacacttatttcccatggcttgctaagtactcctgtactcacccttgctctatataaataattcccccccagttgctgaagaggatgatgtggatcccgctgacgaggagttcttctaggagcaagtcggttacgaagagttttagggtttcggcctagttcccaagtcgtgcctgtgatgtttggtccaagtcttggcttccgcttttctcttttgtaatacagttgtgagctcgggatctgtccgtagcccaacatgactgtactcctactctataataaagagaccactgttgctgtgatattctgtcttcctgtgataccagcactgtttcctgggactggtatcgattaacaggttaatttggagcgtcacgggctagttccgttcggggctagttcggggcgtgacacatccagtactagttttgattttttatacgatggatggattactctctatgtttttatttgctttgagtggaatactccttttttaatttttatacaccatttgtctttctaaaaaaaattaatgaaaataaaatatgtagatattcttaaaatgcatttaatgatacaaacaagtaaaataaataaatgttattgataaataatagttttttaataagccgggtgttcaaatgcctatatttaagaatcaatactatgaaatacgagtttttatttaagaacggagttaatacaatgaaatatgagtgggaacatgtacgttatattacttgaccgtgcgcacgaggttgaatttttggctcctcccatccagtagttaatatgaaaattaatcaagtcggcattcaaacataattttgagtacatgtctccttgtttttctgccgaatttgtcaactaagtggcggcgttcttgacaatcatgcattgtcttggtattcggctgcatacttttctacaggttcccttttgttttgtgatatgattgtgctgacccaacacaaacaatctgcaaaataagttatgtttaatgtttatctgaacagtgataaatagcgcacaaagtcttctttctttgacaaggtcagtggagcatttcgaatggcattagttgcgtacgtgtattatgttttcatagtctctgatctcaagctagcaagtactcccttcaatttaaaatataagaatctctatgatttaaacttttacataatatatacatttatttactgatttttacaattctcattattatttcaataatttcaaagccaaccagatattgggaaagaaaatctaagtaattcaaaaattaaaaaaatattgaccagtgaagtgacgaaataaaaatattttgacctaaacaagtattttgctaataatttaaaaatacttatattttagaacaaagcaagttgtacatatataaagactttgcctctgtttgattttgtatatatccactgaaatactgcgtacatatatttactcccccagctagagttctgctgacaaagcaagataaacactgtgatttgaacgaggaaaaacttgcatctctgacgatgatggtcgatatgatattgaccttgattttgaaaaaaaaaagagggactaaaatcaacacaaatagtaagaaattgtggcggcgtgagaaaaatggtactgtaccgtgcatgcaaggccagtctccactaccgagtctataaatacagccctaaccaaaatggaacataagcaaacagcaagaactgcaactagatcttacctgaattaaagaagaaaaatctgtagagttgcagaggcattgcagggtatcagagatgatgaggaagcaatactctttcactctttgcctgatgctcctgcttgtggctgctctgctttgcaccatgaacaccatctccgtcgaagcaggtaattagccgcgtatgtttgcatgcatgctaatttatctgtgaacatttctctatgtttaagcaatcatttagaaacttctgcacgtgtgtaataaatatattttttgttatccacgtaggaaggggcggttacaattcagtgaatcccgatggtatatgaaccgcgaaaaacccacaacttaattaagcctacacttagagcatctccaatagatgactaaaattaaactcccaaaaatcatgtattggggacagccaaaaacatatttagcctaaaatacacccccttctccaagagaggactaaaatttgggagcgcttctagttgcccaatatttggttcaggttggtcctggttttggaggtggctaaattttgggaccatgcttaggagtctgttggagggctgattttcaccaaattcctaaaatttatgttttagtaacctgtttagcattctcttggagatgcccttagatgtgttttcactcctaaattttctacatttttacaccatatgtatatgggaagttgtttacaaattttgcatgtgtatacttaaataaccttttgttgtccatgcaggaaggagcggttacaattcagtgaatcccgatggtatatgaactacgaaaaccaaacttaattaagcctctatttagatgtgttttccctctgaaaatttccacatttttacacatgcatacatatgtttttaagttgtagtttagacaatttgcatgtatgtactaaatatgtttaattgatgttcttgcaggaaggagtgggtacaattcagtgaatcctgatggtatgcactgtaaaaaaaaaagccaaaaagccaacttaattaagcctccacttagatgtgtttttgctcttaaattttccacatttttacaccatatatacatatgtttttaagttgtttagaaattttacatatgtatttatactaatcgtgtttaattgttgttcctgtaggaaggagcggctacaattcagtcaatcccgatggtatgggctgaggatggcacgaaaacccaactatagctagccttcacttgattaatatgcacataaactaaactcaaagttatttatgtgcatatcccatttttccgccataacacataggtttttaaattgctatagatatttttccatatgtatattaaatatttttgttgtctttgtaggaaggagtggttacaattcagtcaatccgaatggtatgaaccgtatttacgaaaacccaattcaataaagccccctctttgatgtgtttttttcctctaaaaattccctaatacttaacgtgaaatataaaatggtttctgaattatttttgaaaattttgcatgtgtacaatgaataattttaatttgttgtccttgtagggaggggtggctacaattcggtcaatcccaatggtatgaaccgaggacgatgcaaatacccaacttgagctcgcacttgctgattaacttgtgcagaaactaaactcaaatttatcttatttttgcatttattacaattgacatatggcctggtgataatgcaggaaggagtggctacaattctgtccctagaaacggcggtggaagcccatagctctaactgggccaatgaagcaagcaaagcattcatgatccagtccaccagctaatatacagcccaagtttggatgaatatatctgtctatgtatgcagatatatacagtgtattctaaataaatacgtacgatctagttgatcggcgttgcatggtttgaaaaattatgtgtggaatttgtacaagtattgtataatgtattggtctaccgtgtacgtatgtaattaagcatcttgcttctttatttcacttgttcctaggagagagagaaagagtccattttagtattaaaaaaaactcccttcgtctgtcatattacaagttattttaattttttatattcaaacttagttaagtttaatcgagtttataaaaaaattagcaatgtctacaatagcaaattagtttattaaaaccaatatttaatatattttgataatatgtttattccgtgttcaaaatgttgctatattttcatagaaacttgataaaaacttcgtcacttcagcaacaatgcgccaatcgacgtgtgtatatgcatttggtcagttgacagttcacctgaatcacccctcgcaatgcgaagctttctgcattcaccaaacatgagagctcagtaaacaaaacaatggcatatctcaaactttaaaaaattataatggcatggttccaaattacccaattaactactgaggagtacactatagatctgaatgctgcctgccaatctcgaccggaaaaatacttaatcacacagcaaatggttggacattgtataaatcgatcagcagcaagcagtatacattcagaattccggagagtaagatcgatgttcagtaaattcaggcatcccggcagatagtgatcatcagaacacattcaccaatcaaccaaatctcttcttttcaccataaatcgatcgatcagattgcgatggtgagggttgccgctgttgctgctgctaactgggtgctagaacaaattcacggcgcaccagtagaagcattgaggcaatgcgatgaacacagtgatggaatcaatgcttataaatattcaactataatttggttagttagtaccaggatcttacgtttgatatgtgttcctttttagcaatttttctctttatgcaacattcctttttagcaatttttctctctatacacaaatctcaatgtgattcgatgatcacaaacctcaaagtttcagatataattacattataactataatgtaattgcattgtaactacacggtaaatacgatataacttatataaaacttgaattcaactctgatttggttacttagcaccggaatcttacgtttggtatgtgtgaaaatttctttttagcattttttttctctttatgcacatatctcgatgtgatccgatgatcacaaaccttaaagttttgggggcaaaaagaacttgcaaaagttctctctctatatattgtccagttcaggttctatagagagatcgattatgccagcaacaacaatcaacgatatgccctgcgctacgcatcccctgcatgctggctgctgcgcccgtcggtaacattcttgcagatagtgtacgcaattttttttataccaaactttatttcctctatattaaaaatcaaatcaaaccatatatggagtaattaagaaatcaaataagttcgctgaggatatgtgagtaaaatggttgcaaattggaaggaacagtacaatatagtggctcgaattaatggcgccgaccggagtaattaactaactagccgacgaagggggtgcgcatgacggggccgacggcgtcgccggcgttgaagaagacgcggacgcggttggcgtcgaagcccggcggcacggtggcgccgtcggggataacctcgatggagacgtcgggccggtcgccgttgatctgcgtcaccgccgccgtcgccggccacccgaccacctccggccacgacgccttcttctcgctgctcatcctcgatctgcgccctttctacttaatttctaccagcaagctgcagagataactagttaattagttgcatgcaagtgtgtgctcttgtgctattgattaagctggtatatataggatcagatcagagttaagccgagcatggatgcatttgctgattttgcattgggcatgtcaccgttgccggagcaagctttggttgtaactcctaatttgatgatttgcatctgtcctagctagtgtactatagttagtaccactagcttaattagtacgtaacaaacaatcaaacagccgggtcagttgcatggatatgttctgttctgaagagcatcatcggagcggctgcgcagaaaccccaaattttaggcaaaataatttattgacaaatatacctatcaaaatcgcccacacgtacgggaggtaccagcctgaaacgaacgtcgttcccaaaagcatcgatcgccaatatgttcttgggcgacggggctaccgatcgatcgagatggtgtgataccgatggacgatgatcgatatgggtatgtaaacaacacaaggttaatttctagcaatgcagatgcagatggctttcgcattttccagtggatatcctatcctcctatgaactataaatgttccccatctcgttacgcgtgattaaaattcgagatatattataattggatcgccggatcatcagctagctaattaggtcagctagagaggccggagttaacaacaagaaggagcaatggagaagaagaaggtgaggtgggcggaggtgctgggcgagctggcgccgctggcggtgacgcagatcagcaacgacaggccggacgtggcggtggaggtgctcctgcgggacgccgccgccgtcgtctcgccggagttcaaccccaagcgcgtccgtgtcttcgtggacaacaacttcatcgtcgtcaaggtccccgtcatcagttaattaattactaatatactccctcagtattttaatgtatgacatcgttgacttttcaatcaacgtttgaccattcgttttattcaaaaattttatgcaaatataaaaatatttatgtcatacttaaaaaacatttgatgacgaatcaagtcacaataaaataaatgataattacataaaatttttgaataagacaaatggtcaaacgttgaaaaaaaatcaatggcttcatacatttaaaatatggaggtagtatgtatgataaggcacgtacgcctgccttatgctccatttgtactgtatttatgcgtatctcagactcagcatcgatcatctctctgtgtgtgaagcaaacagcaactcaaaattaacatgcatgtatatcatggaataaataaatcggtaccggaacattggtatcttcaataattcaattcgtcctagctagatagctagtcaggttgcattgctagtagcaatgctagccgcctgctgatgcatattcttgcatactccagctaatgcatccaattaatccaattaagtcatgaccaatttaatcaatcgagatcggcagacatatatatgtagatgcggcaattaagcggcatatccttgatctggactgcttgctgatggacggtggatgaaagcaggagagtatagaaccattttctcttgagacgtcagaaactgaattttatagacatattaatggtaggctaataattcaaatataattagtgcaaacaccacagaatgatgttattttacaaacaaaacatacatgactatttaagcgaaaatcatattttaaacaaagtaaaaatctagttcaccgcgcttgtactccctccgtcccacttaataaggcatacacatattttaaaatttaaatctttaaatatttaaccaacaatattttataaattagatttcttttattaaaaatagtattttgattggtatttgaatttactttaatataattatgattttgttgctacaaacatcatagtatttgagaaattcaaagtcaagtagttctaaagaccacaccttagtttttttcgcgaacgcgcaaagaccacaccttagtaagtaggatggaagtagtatgcgttaagtaaaatctacagcattttcaagttcataaaatctcatactttacggccctccctggcatattcaaaatcttttatgtgtgttttcatgaaaaatagtcatgaggatcatcggtgataggttcggcaatgaggtctgaggtgagcctctccgggtgcctatgtgacggtgcctaagtgcctatctgattttggttggaggcctttgtcacagatgatttgattgggatgttaagttatgtacttgtaatataacatctatcttatgtttatcatcagtgcattacgttctattatctctatctcaaaatattatatttggttgtattttatttaatactaaattgttatattttgatattgatgagtatctggtcttaactgacagaaacgccaccactctcgcttgttcgcttcctctgaccacgtccgatcgccggcatttctagtactcactaattaacttaaagcataaatattaatcacctcatctttacttagtacaaaaccagcaaatataaatcagctactgatcatatcgtttgattagcccaaccagtaatacgggtacaacaaggtaataaaacaagttaggagagccaataacaattaactgggcgatgtaggcaatgcaattgacctatataaataatgaccaagctagccatctagcccacacatcatatcactccctatctaagctgattaatcacctgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcgcagtagagatcgtgcgggcgccctgatcaagcgacctttctctatataaaccgacccgccgtcttcacgcaatatatgcgaaaatcaatctagggtttgccttctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgacttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgtttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaggttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaacattgaggtgataaatgaggttaaatcattcttgtctcaaaattttgatatgaaagatttgggagtagctgatgttattttaaacattaagctaattagaggtgagaatgggattacactcttgcagtctcattatgtggagaagatcttgaatcgctttggctacattgatagtaagccttctccaacaccttatgatcctagcttgtcgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctatcggcactggatactgctactgttgaggcagaatggttgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctctaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtccatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcctgggcagggcaggcggcgcgcgtgcacgacgtacgcgtcgaatggtccgaaaaattggctcctcacccttgcgcagatgcagcctctttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcaatatatgcgaaaatcaatctagggtttgccttctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgacttatttatggaataaattaaatcattatatgcccataatctcaacatcacctaattaaacacactgatagctattttagtttagtgtttccgatcatcctctgagggagagagagagagatggggagggcggcggcggccggcgacggggatagtctgaagacggcgtggccggagttggtggggtgggtggagctgaacgcggcgttccagatcaaccgcgacaggccggacgtccacgtggccttctacatggtgggcacccagttgccgacggaccacgacgacctccgcgtcatcatcgtctccgacgccggcaccgtcgtcgtcaggacacccgtcgtcggctaataagctttctagctagccacgccggctagccgtctagtactgaaataattaattacacataagataaaagaaaaaaaatcaattctagggtctctgaacacgcacgagtccagattcataattagtattgagttttttgtagcacgaggtgttgtgctgtgtagctgtgcgcacgcttgtatccgtctgtatctgtgtatggctgcatgtttacacgcgtgcagtagttctggtcgattggtcaatacgtgctatatatgttccttttatttttgtgagcgagatatttcacttaaaaaaaattatgaacgagatatgagagtacatttaggacacattattcatcgtatcttactcaacacgtatgtgtaattctcgattatacctcttggatggtcaggaataaaaagatccagaatttagcaaagggcatatccctccatttccattaaagaaatgtaggatttctacgcagagtagagtgttgaaccaggaggggggacgaccgcccaggtactcattgctcacaggtaacgaattgaagtgcaagaaaacataagatgagaagcaaaacgaccgggatgcatgttgcatgcttatttcgagtgtgccgattgttgtacaggaacgaacgtacgtattgtaagtcaccgattggtgacttggtacgtagtgagacttgttaatttacacccttattaagttcttatgtaattgatactagtgattttttttaatatatcatttatcttatctaatttttttctagatataaaaagacttaagccatgtttaaagaacatttgatgataaatcaaaataaataaaataaatgataattgcatgattattctgataagacaaacagtcaaacgtatcttaaaaaaattaacaacattatatattaaaaaagatggaatataatgtaattctctctctatatatatctttggtttacacggaatagctagagaatggagtatatgctcgtcaatggaagtttaattacccagcctagctagtaacaacggctggatatataattatcacaacatttattaaacaatcgaatcactataataaaatagcggtatgtgtgtaggagaagatgtcgttagttccggcactcatcgagggcggcatacgcgatatatatgtattaaccatagtaatcatcaaatgattaacatcgatctagccaacgtccacatacacttagtaagcatgctctatgttatgatcagtaaattaattaattaatgatcaatgcaagaggtgtacgtgctatatataagttcgagcgagagacactagatatattgatcatttgactcaaccaatctcagttgatttgggtacaaactgaattaagctagagaatgggcagagacatgccggccgccggcggcgatcctcaggtggcggcggcggagcagctgcggcggctgaagtcgtcgtggccggagttggtggggtggccggagttctacgcggcgctgaagatcatcgacgagaggccggacgtgacggtgtacatgttccgcgacggcgacgacctgccgccgccggagcacgaccccgcccgcgtcgccatcttcgtcgacggcgacatccgcgtctcccggactcccgtcgtcggctagctatatatgcccatcacccatgcttggctgcgcaatatatatattctctccgtttcaaaatgtttgacaccgttgactcgttagtacgtgtttgaccattcgtcttattcaaaaaatttaagtaattatttattattttcatatcatttgattcattgttaaatatactttcatgaacacatatagttttacatatttcacaaagtttttttgaataagacgaatggtcaaacatgtgctaaaaagtcaacggtgtcaaacattttgaaacggagggagtacattttaaaagctttttaccattcttaagtacgtgatggtatctcgattgatgccttgtgatactggccacgtgttaaatagatgtaagaggaggtactaatgtgcaagggtaaaaataatacctaccctactcctctgatggtaccctctctggtttacgatacttccttaaggcttgtaaaaatcttctaaactataagcttgttgtattttctggacacaaagcctcagcatacggagcttttttacggaccttgagaaggtaccagatatgaagaggtaccaactaaatcagaccattcatcttgcaagggtaggatcgagcttaaaaaataagcgggctttgtctacagcttttttgttctcactggatctttcaaagtgtcgcacttcgtcacagcagcgtacgtgaagagagctcgcaccggccatcacggtgataacggcaccgtcagatcacctcgcttgcagtggcgcggtagcagctttcctccatcgctggccatcgttcctccctggatatccgtgatgccgagtgtgtcggacgccgccatgctgatccaagtcgaaggaggttgacggagggaaaaagcatagcttaggcacctggaaggatgccaactgggaggagcggtgatgctaatctagcatgacgaagttcgacagcggggactagcgacagtgagatcaaattacaatggaaacgcgccgctcataatccccttccatcgcaacctcgtgccacagctgttcactgtcgtctccatgccgccgtcgcatccaaggcaccgttgtgccgccgtcggatccacctcaccacggccaccatctcatcgatcccgtcgtggccaccgtcgcatccaccccgctgccactgcttccgtcgtatccatggtgttctctctcgtcctgcctgtgatgccgcgtgcagggagaagaaagagatgcgtgcgatgaggaagagaacgcgaaaaagacaaaaataccctcccacctatataccgcatcgatcaatcttgcactaccacgtggtacgaggctgtatcagccgtttggtggggctagatggatggccaagattcggtatcgcgcaggctcaaggacactaaaaatctcccataattttattttttttaaaaaaaaacacatccaaaaggggttcggagattaaaactccgaacgccgttgagccgacctgccttcagctaggtgctcgtgctaaccagatgcgcgcggggggtcatcgatttgtccacaagcacgtcaagggggttcggaaactaaaactccgaacccactagctctgatttctcctgttttgtgtttaattaattctactcatcatgtacctatgccaaattgctaaactgtcaaaaaggattaaaaaaaattgcctggatactatctctctcgatcacatcgaacaagaaaaaacacaatggatacatatgcattgtctcctcatcgacgagttaattaatcccggtgttgtgatgccatgccatctgcatgtacgtatataaagcacacctacgaccttattacaagcttaattgagaatcaggctgtaacatatatacatcgcgatcgagaggatcgaggatggggagagcggcggcggcagtgggcggcggcgagatagtgagcataaagacggcgtggccggaggtggtggggtgggatggcatgtcggcggtgatgaagatccaccgcgaccgggcggacgtgcgggtggaggtgcacaccgtcggcgagagcgtcccgccggggttcgacggcgagcgcgtcctcgtcttcctcaacgacgacaacgccgccaccgtcgcccagacgccagtcgtcggctagctagccccccatcggactactggatcggatcagactcgctagctatatactccgtcccttacaggttacaagacgtcagtcagagtcaaactgttttaaatttatctaaatttataaaaaaatatagtatttttataatactaaattagtttaatcaaatcaataattgaatacatattcataataaatttatcttgggttgataatgttactattttttttctacaaacttggttaaacttaaaataatttgactttatttaaagttaaaacgtcttataacctgtaacggagggagtagcttattatcctcaataatacttactactgataaataaagaattaattagtggtcttatgacttgcgagcctgatcgatctatcgatcatgtctatgggttaaattcaagttaagtactgtactacatatatgccttcctgtgaagataaagatgtcttactattaattcatacgtgtgccgtgtaccgtgtacgtgctatatatgtccaatgcaaaatcagcgcaaatgctgctcagtttaattaatactgatctgatctgatcctacatccagctgagatgcagttccaatccaacacagcatccttaatcaatcacacaagtgcagcacttacttgtaactaatctccactgtagcacgcaccggcccgggccatagcgcatccccttcgtcggctagttactacacttaatccatgatccatcacgggtcgttgcaattaattctagccactattccaatatggaacaatttacttccatctcagcgaacttaattatttcatccgtttcatattatcagactttctaacttttgtcacattcatatatatgttaataaatctagacatatatatgtgtgtctagattcattaatatctatataaatataaagataaatagatccaaaaacaagttagtcacatactagcccacaaagctcgtagtgagcatctctccaagttttggcttggtaactcttgcagtttaatttttcagtatctctataaggatttgttggttgagtaatatattcttgctcttctctgcaaaaaaaaattatatgaatgtgggcaatgttaaaaaatttttaaaaatctatattcttgcagatgtagtatttgatttgatttcttattaatgtatagtttgattttaataagggagataaaatcgggtacatattttggtgggctgtagtgggccacgccacgttacacaagaactagacccaaaacgggcctgaaatccaatgggccaatacagccatattcgtattgccgcgcgcgatgcggcggcggcgcgcgccctagtgatcgccggcgacacgccggcacaccctggcctccttgtacacccttcccggccggcagaggtagcccttctccggcgagcagtgcgcgtcctccgagcacacgcacagcccctccagcgcgcacccgtccctcaccacgctcacgccgccggcgccggcgacgccgagcaccttgtcgctccactcgctggagaagagcccctcggggtcgtagctgcccttcaccttgaggaactcgccggacttcgggtacttggcgatggcgccgtcgaaggcggcgttccggttcttgccccagtgcgggacgccgccgtacttgcgcagcgccatctgctcgatctcctccaccgcgtcctcgtgcagccgcggcgccgccgggtcgcggctccggtagtaggtgaggtcgagctcgacgctgtcctcaggcttgccgaggtgcgccgtcgacgccctgacgtagcggaggaggacgccgtagtacacctcgaggccgcagagcgcgtccgggttgaggtcgcgcagccgctgcacgtcgcggatgaacgccgccgcgccggagagcggcacgctgatgccggactggaagaagaaggagttgtgcctgacgcgtgggtcccacgtgcaggcggtgaggaggccgtcgtcggcgccggagaggcaggaccccgacgactggatgcggttctggtagccgaccaccgccgcgccgggcggcggcgggagcacgccgcgcctcgtgacgccgtagttgccggcggcgaggcgggctatcgtcgccgacccggcgaggcacttgccggcggagttcgccgtcgcttcgagggcgtcctcgccaatcctattggcctggatggcgaccgtggggctcgactggaagacgacgagatcgtagacggcgccatcgccggaggtggtgttgggcacgcggtcgtcgatccggtacacggccttgccttggctgggaagccagaggatgtcggcgaactcgtgctcgccggcgaaggcggcgactcgttccgccaggtcgtcgtcgtcgcgccgccggaacgccaccgagcgcttgaacattggttgcagctttagagttacctgatcaaattcaaactttcgaaaattaacggagcagtatttacagacaaaacaggctaattaatgaaacaatcaggttaaatactaagttgctcagtacggggatatttgctttcaatgatgagaaacgagtagtaaaggtttgagaggacatgccatgtcccatgtgagttgttgagtaattccgttaattaataacttcacaaaaattggccaatgcatctaattaatagaagtgttcaaatttcaatgatgattttatattttcttgagttaattttaagagtgtattatattccatctgttttgtaagactttctaaaattgctcatattaatatagatgtgtctagattcatatctacataaatgtggataatgcactaatgttagaaagtcttgtgaaatagatgaagtatgtgcgtgtgcatctttgtgtaaaaatattactatatagagagagaagaaaaccagctgttgaaatgttgaactcgttgcacctgagaaatgaccccgagcacgccgagcgacaccttggcggcgtccagctccgggtcgccggcggcgagcacgcggaccttggcgtgcccctcgctcgccggcgccggcgtgacgatcctcatgccgacgacgtactcgtgcacggcgccgcccttcccccacaccgagctcccgtgcgcgcccgtcgacagcagcccgccgacggtgagccccagccagtacggcgagtgcggcagcgcgaggccgccgcccgccgcggcgtcgatcagctccgccagcgtcacgccgctctccaccgtgatctccatccttccggcgtccacggcgaccacgcggttcagcgcgtcggtgctgatgacgaggccgccgccgccgccgccgccgtcgccggggcaggccagcttgggcacgctgtggccgtaccgcgtcgccaccttcatcttggtcctggacgccgcggcgccggcgacgacgcggaggagctcccgctcggacgccgggtacgccgcggcggcggcgcggcacgtggagcggtccgggaacgcgccgtacgcgttggtcacggtgcagttggccgtgcccgacgcgcacctgaccggccccggcggcgggctggcgccggcgaagcgaacacttgcgcagagaagcacggccacggcggcgaggagtggagcgccatgggtgatgcgccggcgaccacccggtgcacctcgccggcggcgagcttgcagctgctgcatggttagcttaatttttttggcctgtagtgcgtgattgcttgtccggttggtgacctgctgatggggcatgtcatttcgtgcatggagtttgggtttttaaaggcacgcggtgcccttccatttctcctttttccttgaattggagagtttgtttttttggttcataaattgatttcacatcacgtggacagcattaatgcgaagcacgattttcgttgaaaaaaacaaacagcacccatgcattgagcaacataaaacgtcaaacactctcgattatggcccggatataaaacgtcaaatatataattacacaagtgcacatcacttctgtgcaacttaaattacttaggcattgttaatattgaagccaaaataaacctttttaaattttaacaacattttttatatatgtatttattaaagtttggtaagaaactaaatggatgcacataatttgacaactctaaaaataaataaatatggtttaaaatggcatcaatctgaataaacccttagcgatttgactctactcccatcgtttcaagaatgttttaagataatttatctatttgaaattactccatccagcttaaaatatatcaacataaatttagatgatggaacatactctaatcctatcttttcaagggtgttctaattaagatattttattgtagcgcccgttccgtcgtggcgcctagcgggaaaattatctcttaaaaaccctaattgcgaaatttgtttctttgcttgttgtctagtgtccgtgccatctcagatctcaaatccccgatctatcgtcgagttcaatcccgaatccaaacccttcccaaatcaattcctccgcaaaagtctattttgcctcccccggggtcgatgggccgaatttctctcggcccatcttcccctctcccccggccctctcctctcccccggcgcgctcccgctctctctctctctctctctctcgccccctccccttccccggcgcgctccctctccccctctccctccgctccgctccgccccgcccgcccgcgcgccgcgcgcgcgtgtgcgcgagcaccgcgccgagcgccccctccctttcccctcgctctccttctcctctccctggcgagctccccgctcgcgaagacggcccccgcgcaccgtcgttcgcgtgcgcgcccgcgtggttccccgcccgagccgcgtcgtctgcgccgtccgcgtcgcccggccccgctgctctgtcgcgcctgcagccgctcggccccgcgagccagcgcgcgtgcccagccgcgccgcccgttgtttcccgcgtgcgcgtgccgagtggctgaccgcctggtcgccgccgccgtcaccctctgccgcgccagcccgcgcctgtcgcccgtgacgtcgcgccgctccaaaccgccccgccgtcatcgccgtcgtcatcgcctcggccccgccactcccgcgctagcctccaagggacggaggcagagcctccctcctccctctgccgcgacgccctcgctccctcctccttttcccgaataggcaaggggacaagcccccttttctctccctcttttcccctttttccctcccgccggcgtcatcctcctccctcctccctgtcgccgctttggccgcgaccgccgagcgctagccctctcctttgaccgccctaagtcggttcccaaaccgacattgccatcctataaacccgagctcccccccttttcctttcctctcccattcacctccgcgccattgccgcccctctgtttcgccgtcgccgttcgtcgttgcgcgtgtcggaggagccggcacgagcaaggacgcggaaggggacttcagccgcgccctctccttcctcttccccggcccgaggccggagagattacttccgcgccgtcggcctctcgtcacagcgcccctcctcacctcggtgatgcctccctccgttcttcctcctcgctccatctcccccccttagttttcggtggtagcacgagtagcctccccgtagctagccagcgccgccccgaccgttgccgtcgcccgccgtgtgctcgccgccgtcgccgctcgagctccgtagcacccgctcgtcgccagcctcgctcggcgtagctccgcccaatccgacgctagcatcggattcccgtggccgcgtagatgctctcaccgccgggaattggcccctcgtgacctcgtcgccgtttccctcttccctccccgccggttgccgccgccgcgattcgccgccgtcaagcttcctccggcgaatccgagccgttggctcgtctcccctcgtctcgtgcaaccacccggtgtgctcgttttcgccggtatcgccgtggtccgctccgccgctcgccgctgttgtccgccgtccgttccggccggcgtcgtcgtctacctcccgccagcccacgtggcagccacgtaggcgccacgtcggcgccagctcagctgaggttgggacgggccgaccccggtcagcccttcccgtgcgcgcgttccaccgcgagccgtgaggctgcgcgtgggcccgccgcatccgttcctccgcagaccgtgcgcgtgcaccgcgtccctcccccgcccgcgcgcgtgcgccgcgtactccctccggacggtgagccgagccgctgacaagcgggtcccacctgggaccgcgcgcggtgagcccggtccaccggctctctctcctccctcccgcgcgcgcgaccgtcttgggccggccggcccatttagctcggccggaccgccccaattctcttgggccgcgccctagccgcccgagaaaagtctattttccctccctcttttcttttcttttcttttcttttccaaaaaggatttaattaaatcattttcctttagaccaaaaatccaataatcttagaaattcaataccttcccaaccgtaaatccatttgactccgttcagcttccaaaattcctcaaatctcgagatctatctaatggcacgcttagaggtcattattagggcttcattttcgccgtttgttgagttgtcctgtttcgcgtgtagttccggagcccgaagacccgcagtgcgaggatttcgaggatcaagctccagacctcgagcaaggcaagccacctttgaacatcttgagcctatacttgaaatttaattatgttgcttgcaaaatattatgcattgataggatcgcacttaatctgttgtcccgtctgcaaggcagattagcggacctacctagtttgttgcattgatccttcctttgttaattgttataccatgttcccttgtaaccacccagttgcgcctcggaaatcgtgcaatctgtgcgagtaccaaagggcgccttcaaatttaaaatctgagcaacttcttgggtaaaacttaagttttacaaaagacttggaaaacccgacacctgggtcggtgcttgtgaactaaatgaatttccaaaaccgcggaccggggaacgtaccgggtgtacggttttcccgttctcgcacttaaggaccgattccttggaatttcatccaaacataagacaagtacgaccacatgggtggaatgggacacccctggctgagtaactagcttatcaggggagccttgatgtcgagagacatgtggattcgccggggtggtgtcggggaggaccactgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggttcgctgtttgaaaaatctgcagctgatgggatcagctaggcccgggtggccgtttgaaagttgttggcccgggtggccgtttgaaaagctgttggccgggtgccaaccttgttttaaattttaaagactgatacattgcacatactccgaccggtcgagacgcaccgtctcaaccgtgttgtttgagaagcactcacttagttgtttttagaaaaagagttcaaataaaatcaactgcaaaaacaacagcctttccttgaagcctgcattaaacacctattttcccttggcttgctgagtactcccgtactcacccttgctctatataaataaacccccccagttgctgaagaagatgaagcggatcctgctgatgaggagttctttcaggagcaagccggctacgatgagttttagggtttcggcctagttcccaagtcgcgcctgtgttgtttggtccaagtcctgcttccgtttcccttttgtaatacagttgtgagctcgggatctgttcgtagcccaacatgactgtatccctactctataataaagagaccgctgttgctgtgatattctgtctccctgtgataccagcactgtttcctgggactggtatcgatcaacaggttaatttggagcgtcacgggctagttccggtcggtactagttcggggcgtgacatttatccgttctaatttataaatgactatctccgttctactcgtgcatggagtttggctttttaaaggccacgcggcgtccttccattttcctttttcattgaattggagaatcaatttccttttggtgcataaattgatttcgtatcacgtggacagcattaatacgaagcacgatcttcgttgaaaaaaacaaacagcacccacgcattgagcaacatagaacgtcaaacactctccatcgaatatggcccgaatatataaaacgtcaaatatatactcccttcattttaaaatttaaggcataagtaccattatctcaaatactaagaaacatcctaagaaacaactattatcatctcattatttaaatcatcctaataaatacaatcggtgcacccaataaatcatcctaataaattcaatcgatgcacccaatagaataactttggacattaatttaaaatgatgggagtagtgcatttctgagtgtatgagcgtgcgaatgaacgtagtgtgcgtgcatctatgtgcgtttcacataatcaaaaaatcatcaaagtgtccggatctgacatcaattatggatttgattttcggactttgctgccaaatagggccacaaagtcatatatatatgtattaatggcctcatcataagtacatatatcaaacattccatctaaaaaaatccacttattaattatactatcttaaaacactcctcacaatcacattgatgcgtgtgaaatagaagtggttggaagcgaacagcttaagctaatgatacagaatttaaggaaattcacttgtacttaatttactagaagcctcaattactctctacctaatctcacataaaaaatcccaaaaaagaattgcatgtgatacgcacgtctatttagtcaatacactctacaatcggtgcacgttaacatgtaatctgttgcattgcatgtgtacatacgtcaagttcagagataagtgccacgattgattgcatagctgtatcaatatcgagcacaagtttccccctccccccccaaaaaagagagagagagagagagagagagagagagagagagagaaaagattatcttactcgagcagagattactcgtacggctcccctctgactagctatcatctgacgtaccaacgaacttgaaatgagtaaatctggaattacctcttacaaaaagatctgaaaagataaaatgacctaataacatctatacttgagaaaatgagaacaggtttatatcgtagtaaacgacctaattacaacttcacaagattaattagttgaaaaaacattaacagaacaaggcagaatttgacataaaaacggcacgcaacggaagaaaatggtggcagcttgatagttcgatatcaaaagtatatatgcgtgcaaaacagctgaccaagctagagtcttgacaaaactacagtggcaactaaaaggacaagacgagtattgcattggcaaagaagtcagaactgataggaatttataaatgggaaaaaccagtgcttcaaaacttccaactgtgttgagctgaaaactgtatattagtgcactcctctcgctctaaagaaaaactattttagtacactattcttctgtaagctctatcagccttgttcaggcttaccatgcgtaaaccaccatcacctcttaccattgaaccagattgcgtgagagaagatgtaccatcgtccatcatggaagtagatgtgggcattcggtctgaccaaaaattttaatctcagtcttcggtctttcgaccattttggtctttgaaaagtgaagtccgaatttcaacgcaaaaagttaggactgacaaattcagtctaggtctcggtcctaaccaaaattcaacaacattttcatatatgcaaagaaataatcaaaattttcaacacaaaaataaaaaaattcgtaagcacgtatgagtaaagactcttattaggttgcatgcctagaagaaatagggatgtgaaaattagagtttaatcctactaaacctagtggattataggttgtatttagacatttttttaattcggtcttttcagtctattcggttatccgagtatactaacggaattgatgtgaaaattagagtttaatcctactaaacctagtggattataggttgtatttagacattttttttaattatgtcttttcggtctattcggttatccgaggatactaatgaaattgatcgaacaaatatcgatctttcacttacctattaggaccggctttcttggtctcggtatttttggttgggtctttttctacccaccgccctacgtgaaagcgtggaccaccaccatagcgacggcttggagtccacatgagtacatatgggttcgcgaagcctaatcaattactccggccttttgggcccacaagtaagcctattagttgctggattttgggccgggccatgtggagttcagttgaaggttaaaacattttccttttttttttccgccgtagatttgaaagtgaaacaagttttaaaaatcagtgaacaaatttttgcaaatattacagaaattaatttaacagtcctgaaagattttatgtatcacacgttgcatggccacaagtacactcgtcgtgtgcctagagatcgtcggcgacacgccggcacaccctggcctccttgtacacccttcccggccggcagaggtatcccttctccggcgagcagtgcgcgtcctccgagcacacgcacagcccctccagcgcgcacccgtccctcaccacgctcacgccgccggcgccggcgacgccgagcaccttgtcgctccactcgctggagaagagcccctcggggtcgtacgcccgcttcaccctcatgaacgccgcggcgcgcgcgccgccgtacttggcggcggcgccctcgaacgccgcgttctggttcttgccccagtgcgggacgccgccgtacttgcgcagcgccatctgctcgacctcctccaccacgtcctcgtgcagaagcggcgtcgccgggtcgcggctccggtagtaggtgaggtcgaagtcgacgctgtcctccggcttgccgaggtgcgccgccgacgccctgacgtagcgcatgaggacgccgtcgtagagctccacgccgcagagcgcgtccgggttgaggtcgcgcagccgctgcacgtcgcggatgaaggccgccgccctggacagcggcacgctgatgccggactggaagaagaacgtgccgtgctcgacgcggggatcccacgggcaggcggtgaggaggccgtcgtcggcgccggcgaggcaggatcccgacgactggatgcggttctggtagccgaccaccgccgtgccggggaacgcgccgagcagctggccgttcctcgtcaggccgtagttgcgggctgcgaggatggagttcgtcgtcgacgccgcgaggcacttgccggcggcattcccggtcgcttccaggccgtcctcttcatgcaacaacaaacatcaagtacatcatgtcatgtcagcaatggtattggaaaaaatggtgtacttgttcttgggaaagtgatttcatccctgaaagggatatcccctcgtttcgtacatgtcacctaaatagtcatcgaaaaatttgaaaaaaattggcaacatagattaatatgaaatatatcactccacaaacatacaagcttaaattcaatttttacaagttgtaacaaaaataacaaatatagctgtgaatgtatgataactattttcagtttaatttgttattttttttaacttgaagaagttgaattttgtcttgtatatttatggagtaatatatttcatattaatctatgttattatttttttaaaaaaaattaataaatgcaaagaatgagcacagtggatgcatgtatggtggatcacgtaccgacgagccttttggcctggatggcgagcgttggggtggcccggaagccgacgaaatcgtagacgccatcgcccggcgtgttgctgggaacgcggtcgtcgatccggtacacggccttgccatggccggggtaccagaggatgtcggcgaactcgtgctcgccggcgaaggcgacgactcgttccgccaggtcgccgtcgccgcagtgctggaacgccaccgacctcttgaacatcggctgcagttttagagtaacctgggaaatgaccccgagcaccccgagcgacaccttggcggcgtccagctccgggtcgccggcggcgagcacgcggaccttcgcgtacccctctctcgccggcgccggcgtgacgatcctcatgccgttcacgtactcgtgcacggcggagccattcccccacaccgagctcccgtgcgcgccggtggagaggaggccgccgacggtgacgcccagccagtacggcgagtgcggcagcgcgaggccggcgcccgccgcggcgtcgatcagctccgccagcgtcacgccgctctccaccgtgatcgccatccccgcggcgtccacggcgacgacgcggttcagcgcgctggtgctgatggcgaggccgcggccgtcgccggcgccggggcaggacagcttcggcacgctgtgcccgtaccgcgtcgccgccttcatcttggtcccggacgccgccgccgcggccaccacgcggaggagctcctcctccgacgccgggtacgccgcggcggccgcccggcacgtggaccggtccgggaacgcggcgtacgcgttggtcacggtgcagcgcgccgtccccgacgcgcaatggacgggatccgccggcggactggcgccggcggcgaggaggcgctgcaccaccacgacggcgacgaggatgccatggacagcgcgccttgctgtcactactgaaccttgcatggtttgttggtttgcttgcctcacgtcttcgcatgcagtcgaactaatgatgtattcgagataattaaattgaattggacggcaaagggggccaatgatgagcttgaattttgacttaatttgattagttttattatgtaagattgatttggtgtgtatcacgggtgtagtgcatgagtttgtcatgtcactcttctcagctagaggccggccaatctgtgagtgtttgtgcaggctatctgctggaaagcatattcgtctggaaataattcaaggttggtgatgattagacatcaagcctagcaagtttctcacttgagctatgttgattttatgctttatgtttcctttcatcaattaatcattggctacaaaatatatttattaattccatgtggtatgcaagtatgcaccaaatgaatggacgtgatatattcatcaaaaattatatcgcccatgtccgtttttcattgcaattaatggctaataaaacaaacccttcctagtatgttttgcttatcttaagattctcgaagcttacgttttaaacacaatactcgatctgccttaaaatatagtaaacatagtattgaattagacacatcttactacactacgaatctggataaactctacatttttttaagtattaggatgatttagtaatatgttgttatattttaggatagatggagtataagtatagaggaggggaaaaaatcatgatcaaaatatgtcatccttaacagagaatctcaaagttttgataaaatttatgattctttcgatcgagatgcaggacatttataagactgtctcaggatttcattcaaaattctttaaaattcctacatttcaaatggggccttaacgggcttaggccctgtttggctaatgggatagggaaatgattacccacccaacaaaaaatatctttaaatcctagccattcattctctctcttccatttaatacacttcattcatttctcaattctaatcccacccccgatttcccattatccaatcacatattagtgcttggcaagcgggcaatacagctgtaacagttatgagaagaaatggcgggcttccgcaacggtgtacagtttcggcccactatgaactaggcccaaagattataggcccgtgacgtccctgcccggttgcaatccaacctcttgtccaatacaacaaaacgacacaaggggaagcagttcacaattccggtctcctccatgtcgacgtcatcgccggcgatggcgccgccgtcccaacctccgccgccaccgccgtcgcaggagctcgacctagacgccttcctcccctcctcccccacctcctcctcagtctcggaacccgatggcgacggcgccgccgatcaccgccgcgccgtcgacgacctcctcctcctcctctcctcctccgactccgacaccgacgagccgcccgctcgacctagccccatcgcccagctcaaaaccctagccagcatccgagccccagctccgtcccctaaaccttcgccttccccatccccttcgcccaggagatccacatccgcctcgccgtcggcgacgctctcctccctcgtctcgagaaccttctcgaacaacgccgcttcgtcttcctcgtcgaagcctctcccttcgctcttccgcggcgtccggcccagccccaagcccggcgctgctctcgccgccgccgccgccgcgtcccgcgctgtcctcaccccccatgccgctgccatcaagtcccggcgttccgcctccgcgcccatcgagaagcttctagacgaaggctccggttccgaagtctctgaggagtttccttccgctggaaattcggaagcgggagtagcggagaagactaatgcggaagggaatgcggatgtgagcaaggaagctaccagtgggagtggtgatgaagaattggaagcggacaaacatggagaagaggtgcggttcgaagaaaaaactgagcccactgagtcggtggaagaagttgctgctgattctgctgttgccgagaatatcaacgagcataagcaacttggaggtgaaagtttggcagaaactgatcgacctgcggatcaaattggtctcgatgatgaggaacatgtagatgaccgaaccgccgatgaaaatttagtagaatttggtgatgttgaggatctggttggggctgcttgcgaggaagatgttgatgatgagcaggaatctgaaagatccgaaacctctgtggaagagcattcggaatctgagagcattattgataaggcaatcgaagagaggttggagattagcaggaaaactgagaagattgtggagaaaaggcctaagttgtcaatgaaaccactggagcaggcggaggagcttgagaagaggcaggcttctttcgggcagcactgggaggaaggagcagcagcacaacccatgcatctggaggggattggaaggggccaaccagctattggttacatgcaaattgaggttgacaaccctataactcgtgccatgtcctcccagtcatttggacaggaccatggctctccccaggtgatgacagttcataagagctatatagcattgggaatgtctaaaggatctgtcattgttataccaagcaaatattccatccaccaagctgacgatacagatgcaaaggttagtcgttggtactgttgcgaataactattgtttagttcatgctataaatcgaatgttgtttaagactattcagtattatgtggactcaaagatgaatatttagataacacttagtgctagacatattggaagtcttgtcttccttgagttgaaaataagtatagctatcctatagataggttctgaagtttcataaacaatgttaccataaatactgattttatgattccagatgcttttcttttggaaccaaggtgagaaaactcaatcatcggtgactgccatgtgcttcaaccaacaaggtgatcttcttctagtaggatacaatgatggccatatgacaatctgggatgtacagaaaggtacagctgcaaaagttatatatggtgagcacacagcacccgtagtgcatgcttgctttatccgccaatctaaagccatcactggtgattcaaaagggctagtgctgttgcacacattttccattattccagtaatcaatcgcttgaccatcaagggaacccaggtatggatcattatttccaacgtgtatacttacttgatcccctactgaatatatgtctggcctgataaaagttagctacaattttccagcgcctttttgacggaaacaccggaattgtgctctcagcctgtcctcttctagtggatgaatcatttggttctagcaactcttctacccagggaaacctgacaacctcgtctggtggtggtcttagcagcatgatgggaggtgttgttggaggtgtagttggagttgattctgggtggaagtttttcaatgaaggttcttctccaatagaggatggtgtagtagtcatgtttattatgcaccaacatgctcttgtggtacaaatcatttatataattctagaagcattttataacttttttgccatatgtatgtgagctcattaccatctgaactctttcttagttacaatgttctgtgtttcttctgttaggttaggctccgtaccaatattgatcatgttgaccatattgaaaccttctctagaccagatggagcacgggagggttccattgcatatgctgcatggaaatacacaacatcctcgagtgattcaccatcaattggtaagattaggtggccttatctgtgggcattgattgctgtctaaattattatgttgtattttcatggactaatatgacaacaccatagttgaagaacaagtatcatggcttgcacttgcatgggatcgtcaagttcaagtggcaaagtttgttaaatcaaagatgattaaacataaagaatggaagattgatagtgcagcgattggtgttgcctggttagatgatcaagtatgctaaaagctcactcttccataatccatttagtgtgtgctctttttttaggtgtaaaatcacatcactattttttttcccagatgttggttgtacttaatttgcgagggcagctctgtttgttctccaaagatagcaatgagcttcgcaggactgtatttgttcttgatggttatatcttcgatgaaagcatactataccatacacatttttctaacaggtttggcaacccggagaagcattttaacaattcggtagcagtaagaggtgctacggtgtatattcttgggccaaatttcctcacagtttcccgacttcttccatggaaggagcggattgaagcactaaagagagctggtgattggatgggtgcactggacatggctatgaaactttatgatggccagacacagggtgttgttgatctcccgagaacagttgattctatacgagaagccataatgccatatttagtagagttgctgctgtcatatatacattatgtatttgaatacatttcaattgctttgtcaagccatactggaaaagggggtgcatcagatggcctggtagatgctgataggtccctgctgacacagagagaggaacagtatgcacgtgtagggggggttgcagttgagttttgtgttcatattggacgaaatgacatccttttcgacacagtcttttctaagtttgttgcggcaaaaagtggaggtacgcttgttttaatttgctcacaaggactagtaacctttccttttggtttacctctgaagttgtactttgttcatgccttatttttgctaaatacctgtggaagttgatttgcagtccttccttgttcatcgagtgtatctagatcttcttttatacttactgcacttccttaattcattgcctatttgtttgcatatgtcttgtgctggttgattagatagtgcatgtacatgtttttgctgttaaattgctgctataacttgaaaaggctgacatggcatcgatggcaggtatgtttctggaggtgctagagccctatatattgaaggatatgcttggctctttgccacctgaggtgagcaacatcaagggtttactaatgttaacacagaagtcttcaaatgaatatacatttcctccaatctgatttgcagattatgcaagcactagtagagcattatagtagcaaaggatggttgcagcgagttgaacaatgcattcttcatatggatatttcttcattggattttaatcaggtatacataatttgcatttaaggtgtaagaaatacatcgcttatcacgcatgttctgttgcatatattgactgataaaatgtcatgcctcataaaaattttcaacttcttttgtttccatcaaagtttggaattcagaatattgtgttgaacaattataaggctgactcaatttgttatgcttctgttatattcaggtagtccgactgtgtcgtgaacatgggttgtatggtgcactaatttatttgttcaaccaaggtctgaaagatttccgcacacctctagaggagcttttatctgtcattcagaacgctagtagaaaagaaggtgcttctacttggtatgtcgttttgtggcaatacttgtctaaaagcccataaaattatgttcataaacaagataattatgtgtactgtgttcttcagtttttggtatgttagatgagcatatttttattattctgaagttcctgataaatatgtgttcaggaaaaaaaatgatttgatgaaccttagtaaaccccatgatcataagttattttcatttttctaaaagttacacacatgtgactttaacatgatagtttcattatcctgaagtttctgataaaaccgtgtttgagtaaattgcattaatcagtcaaataatagcattgattaccttgctattatttacacggatgatttagaatgcgacttagatggtcttgattgcctgaggaaaaaaaaacctttatgcatgagcatgcacaaaatggctgacagtatgtaacgacaaatatttgcttctttcaaatggaggcaaggatgaacaatactatgtggagttgtggacttgcttggttttgctacatactcaccattatacttttgtaagaccttactagtactgcacatatagctaatctcttaccctataattattctttgctgaaacagctacaggatgcttgtttacctgaagtattgctttcagggcttagcatttcctccaggttagcgtctatatcatttgtgaaaaacaatttactctcatgaattaatgctaggttagtagttggaccataaactatgttttttcctgtgctacactgctgtgtcttgtgttaggcctggaaacttgtgaattgtaaaatgctctaataaaactatatgctaaaatcttaactactttttttgtaaaattagagaattcaagtctaccatgagtaggccttttgggtctctctaccatgagatgtaggtactatgtcattctcataaggatgtctacttgtttcccatcaagattacttgtagaaccaggaatacacatgaagctgctgtatagaatgttcttatttttttaaaaaaaaatattgatgagatacttccacatgatttatttttcagggcacgggacaattccccaatcccgccttcattcagtacgagaagaactattgcaatttttgcttgaggagtctaagacttccagtactgatgtatacaagagcttcaaatcctccagtgaaaaatgcccaaacatatgctatctactatggatggatactgaagctgctttggaagttctcaaatgtgcctttgcacatgagagatttgaacctagagacaacccatctagtactcctgatgcacgtgtctcagaggatggagacaatattaatattggaagccctgacagtgaaaatattatgttacaaaatgtggtggacaccattgtggatattgttggtttggaaaatgaggctattcactcaattgttattggagcggctgagtcagaaatttggccttcagagaaggactttggttatctaatcgagtttgtgtctttttttgtttcccacaaaagggcaaaagcatctcaaagagttgttaggcacatcctcagatatcttacttcatccaatatcctgtcatctgatgataagaaaacaccaactcaaaaagaaaaggaagttcttcagctcttcgatgcagttcctcaaactgattggaattctgattatgtgttgcatatttgcttagacgctcattttcaccaggttcgtgaacattacactttgacagttgaattctatgctatgggctatggcacacgctcacaaatgccttttagtttatgactgaataatcttgttactgtacaggcttgtggattgatatatatgaccagaaagcaaaatttgcctgctttagaaagttacatgaaggatacactggaaccattccatgcttttatcttcattaacaaaaagctatccgaattggccgattatgaagcttcgtcatttcgttcctcagtaatatctcattttcctgagctagtcaagctaagcaggtgaaattgataattcatctaacaagtagatcacatattcgtcaactagattcatgcctgcttgtttgtctttctactgaatgcactcattttcttccctatgcctcttctcagggagtgcgcttttgtcttggtcattgatcatttccacgatgagatccagaaaatattatcagagcttcattctgatcaccacagcctctttcttttcttgaaaactgcgattgaagtgcacttgtcaggaaaactgaatttcagtgaactcaatgccagaaaaaatagcacagttgaacttcaatactcatcccgtgaacttgaattttatatacagagactttcaaatcttcccaagttgttggaccgcaatcctgttattatgactgatgagattgttgaactctatctggaggtaaatgtattgatttttttttttagaaaccaaatatgtcgatggacttttcaactgttcaggtcttaggtctgattgtttgttccaaatgaaaagagtctggtgaaatgtcatggctggaaaaattgtgttctttatggccacatctgctgtgtctctgtagagcatagccacaggcagtgtgccaataatagaacatgaagggtaccttgtccatcatattgcacatggtggtcaattctcttgaaggttgattgtcttatggttttgtagagctttggagtctgattacgcctgcaactgtccatgaaatcagtactttacagttctccattttgttgtgaatattatagttttgctttgtttttttgtcttatgatattgaaaattctgatatataaaagtaattgtgtgcagtatgtaattgaaattttgtggtgatcacaacaattttgtgtgttatcttcatcctaactattactaaaaaaaaaaatctttcttgcacagcttctatgtcagtacgagcgaaggtctgttttgaagtttctggagacttttgacagttacagattggagcggtgtttgcatctttgtttagattatggggttacagatgctgctgcattcttgcaagagagagttggtgatgttgggagtgcactggcacttattctagcaggtcttgatgagaaaatcaacctatttatttcttcagtggaaaatgctttctctgggattgcatcaaaaagtatatctgagatagagcagccagacattgttctaaaaatgagtgaggtctttcttttttttctcctgctcatttaaatgcttgcttggacaacctccgttgtatacatggtaagtaggtaacatattcaatatttttttattttgaaggctcatcctgtgcttgatgcattacgtgctgccatcggattgtgtcaaaggaattcacaaagattgaacccagaggagtcccagtccctttggttccaactgcttgactcgtaagttatgctaacatattaatactacgttacgttattcatatttataagtttcaaatataatttttgtcatctcagttgctggtttgttagtagcattttatgatgtaagatttttccttgttccttggaatatgaacctgtgacatcttgcaagctgttagacttctgttctaccccttctcatgaaaattgtaccgttcagttttctcactaggctgttagactgctgttctaccccttctcatgaaaattgtaccgttcagttttctcactaggcatgctcttaaacacttatagggagttgttaccatgtatacttcagatccaaatatagagggtaaattcaatgtccacatacataagtgtgcattgagagtgttgggcatgaactgatgatgctgaattgtatctattgaactttttctacagtggcctcaatttgtgagtcataacagatagtaagcatgatcagtgcctttgtccattgtgaattcagacaaaaaaaaaatcaaacaaggccttaattttttcttatgataaattttcattagattaattggcactctcaaaaggatataatcaacctataatattggaattgcataaggctttctttacagtcgtatgatttgtcatgtttgttgcttgctgtggtcatacaaagatatctgtcttgtgttctgatagatgtattgacatcaatgttgttatgttatcaattcagcttctcagagcccctgaaaaaattgtatggaagcaaggatgtaaatggaaaaggtgtcaggtctaatgggagtgaaacatcgaatagacagccaaaggacaaaggattctcacgaaaaacaaggatttcagcttatcagaggtgcttgaatgcactgcggagagtattttcgcagtttgttggagaaataatcgaggcaatggctggacatatacccttaccagcaatcatgggaaagctattatctgacaacaggagtcaagagtttggtgattttaagctcgttatacatagaatgctgtctatgtatctttatgaaaaaagaatactggtatgtccatattgatttttatcccatacgcaatttacttgctgctatagcagaccagcaatgctttaggcttttccatgctgctgtaatgtaaaatcattaggaaattcctgaagtacacatcgcttaaatgatcaacagactttagtgttgttttaaattgaacgcttgtttgctactgcaattgctggggtaaatgaacttttatattttgtttgatagaaaagagtttctagctcccttgatacccttttttagggaaacaataggggtggaccctattgaagatatatatttcttctctgatttcttatgcacctgcctgcaggaaacagccaagtcagtaattgaggatgattcattctacaccttgagcttactaaagagaggggtttgccatggacttgctccacagacttttgtatgttgcatatgcaactgctctctttcaaaagaaagtgctgtttcagcaatacgagtattcagttgtggacatgcaactcatctccaatgtgagtctgaacaaagtaagtcatccaatagggattccaaagatggatgcccaatttgtctttcaactagtaatacacaagcccaaaacaaatcacctatatcagagaatgggcttgggaaacattttggggctgaaagcgaggtatcacatggcacctatcatactcatgaaacagatcatgtcgacagatctcgtgggcttcagcagatgtcacgggtaataatatctttccacttatcatacatatgtcaactacatccaaaagtttttccaatgagtagaactgatttcagttatacttggaagccttgatcaagttataaccttgtactcttgttgaatatggcaatctactccacttttatagtattttaaatttattactgtttcatctaagctgatacgttccaagtgaacgtggcctacaggatagtactgtaattctgtaacaaatcgattctcctttttgcagtatgaaatactgaatcatcttcagaggccacagagtttgcatatagaaactgtacctccattgaggctttcaccaccagcgatatatcatgaaaagatacagaagagaacaaccacgatgggagaatccagcaagcattcagttagaactgaaaaaccccagagaatatggcaaatgaaggaaccaagatcaaaaagatcagggaaccgagttctgccaaagtcaagcatgttgagtgagtttgcgcttcacattgattaaataaataacaatggcactctatgtactccattttgaattttgtttgctctatttatgtttctttattcttctgtaggttctcagaataatcaagtgcgatagtgtaaatataatatggtatgaatttgacaattcttaaaatggtaagtggtaactctgttggtataggttttttgtctgttttttctcatgtatggagtcattattgcgattaatctttgaatccattcaaagctaattcgacattttgtggcctttggaaaaccatgtcaaatgtattgcttagcaaatcttcatggtcccacagtgtagcacagcagagcacaatgcaaggcttaaactgaacgtctgaaccttacatttttctgtaacttaataagaataatatatcatctatgttaaacctatcagaactatttagggccctcatcatcaccatgatcaatagaaaatgtgagcagaggacacctggaagttggaaatcaatttaggcatgcaaaaatgaaagcacgaataagctttgaaattgctagatctggagtaaacttgaaaatagatagtgccgtctagatttattcgcatgcagtgtttttgaactataggtggaatatcgatagggtttccaattcctattgtactggtttatacacgctgcaatcattatggatttgctctatttttctttgaagtaatagataatgagctgttttttgggttccttgctgaaaccagattcgaactgatacaaactgatttggatcgagccatcatgtttcaactttcaactgatcattgatttgccagtgtggttgtgctgctcttcctttgtactcaattctcatcttggtgatgcattaaggctgtttggagtagtgcaattcttctcccacggtacttctgttgaaggtcactatctttttttttctcttcatttggtcaatgtttttcttttctaatctcgttatctttcagctggggagatgaataccagatctcaaggcaaaggcgggagcggagaagggcaactagatcaggtgaccctgagaagctttaacttagaacacaaaaaaactaatgcgatagaaaattttttggggggcaattcatcatgaagtatttctgtacagagcgaacacgtgatgacgccatccttacacttagcattacatgactttcttgcgtttcgacttttctttttgtgtaaaatgtgaagtacacaggaactctgcgatgtatagcatatgagacattacatgattttgatcaactgagcaatgatatcaacactggtagtacatatgcacagtgctctgttctttatggatgtgattgatagattatggacaatcgtttatcggtatgaattaaatattatatattataaacctaaaaaatagcttagaacgagttagctaagcaatgatgatgatgtagatttttttttttgaagtggtagcttatgatgatgatgtagaattttttttttaagtggtagcttgccagctgaggtacgcataatctatactccctctgttctaaaataacttaactcaggatgggaacaaagattaattgtactaggatatatcttatcctatcttaagttgagttgttttttgggatggagagagtaaaacttgtcgttgctgcaaaatattgttcagcgttgcatcttgtgatgttttcccagcaatgtcatttttcatctcaaaacaacaagaaacttttgacgagatgatgaatgatcacacacacacacccaaaaaaatcgcaatcaaaacaagtcttgcgggagcagcactggcgtgaagattgaacaaataaacatgcatttatattcgattgatcagcatggacttcatcacattcttcctagcgtttataaacaggttgatttcctctgaaaaaggggacaaaaatcaatggaaaggctcaaagcacatccgtttataaacaggttgattttctctgaaaaaaaagggacaaaaatcaatgtaaaggctaaaagcacatcgtcttcgtcaatcgtcaccgtgcaccgctcggttttacactttgatccattagacatcaaacctttgaacttccaaaatctacatgtatttcgaattcatgttagaatttgaaaattgtatatgaatttgatcgaaatggtgtttcattcgttttcaccattacaacatctcgattctgcgtaaagagcaaaagtaaatgtttatatatgactttgcgagtcctctgatttactccacatagtagcagattacaagaaacaaaggctccacgtaatatatagctggaattccttttccaaatgtaaaagtacagattttttactccattgcctctctttctcattatccaacagccggcgttgtatatacatcgaagtccttcatctgccctcaatggcatcatggcatgtgccacaggccaatgtcagccattggatcatcatctcctcctcaattcctccatgccaagacagtgaatgtgccagtgttcatccaataagcagattggctcagaggattagtgacagagatcaggtaatgctacaatgtgttcctctgccctacaaatttccgtgcaacaccgaagatgagagccttggtcaacagcccttgatcaagagtgcaagccagagcaacagctccaccgagcacaaggaaccttgctactcggtttttcgcgggtttctcttctgcttccacaatatctgactgatcgtcgttggattccaatccacgaacaaaattgtcaccgaccttggtattgatatgcgccatcaaggcactctgagacaatggctccccagcagctctcgctttctgataggcccgaagtccaggttcgattctctttacacacccccacattccctgccgaatgccaatctttgcaatctcatagggaatacccatgtcctcatggtggaacaggagaacctcacaagccgtcaatccactgttccctcttcttgattccactgttcaaagatcagatgaaaaaaaaaaccagttaccaaactgcccacaaagaaaaaaaatagagaaatatgtctactcatccatttctcctcttctgcgttgttctttttttggttcagacccattactcaaaacagtatacatttcacctcataaggctcaaaggaaaacagagtagtcaaggaaattggcttacctggacggatgcaccagcttgaatagtatacatctactctacgaggtttgttacgacgtgggatggatgagcatggcacaccctgcacaatgcacaaaacacatacatgtaaattgctgagctggtcaactctgtgttcacatgcgcacactagtgattcaagcaatgcaagttgaacttgcctaggcaaaactatgaataatcaacaatttatttttactctgtaaaaaagtccatttaacctttgttcaatggtaatactctctttagttcagagatacatcttactgaatcactttatgcagggtaaatatcctaaacaacaatcttgaaccaaggttaagtcattaataagcatgaataggcctcgaaaagaaacctccagccaaaacaaaatgtgtgttatttcaggaaagcaggccaaaacttctgaaatgtgacctgagaaatgaatttaaagcaagaagtgatcatatgttctctaatgaggtacagaaggcatcgtccaataacttacaacagataaccagaactgatatgtgacatacttctaagtttgacaatgatgtaggaaattagcaactacttcctagtcccaccttgctttgtacttggtggttccctattaaatatatcttaatgctcatgggtgttcccactaaaaaatggagatttgagaatctctgctgtcaacaactcaacattaagatcaagacatcaatgatgttacaagtctatattcataagtgtgttccaaggatggagaaaatggcctgaggtcaacatcattagataaatatagtgtttcaaaaatatcggcacatctgagaaacaacagctggaatttctatatgtggcctctcagtatcagaaaaggtacagttgtgcagtacgcaaagtaatgaattcacctagctcagcctattcttaacagaacagagccaaggaggcacaactgtacagcataacttactttgagaggatcattttgttgcatacgcgttaaagcaggaagactctagaccgaaatccatccaaagaagttgcatatatgtttttgaattgttggcaactgtagtgtataagtttgatgcacataaattcactacaatcagatattcatatgctaatgatcaagtgcaagtcctcctataacccccacagacaacacccaaaatattttttcaatgtttgtttttacctttgtaacacaatagtatgcacctcccagtttccatatccgacgagcaatgatgtactccctgtcactacaaaagaaggggaactgcaacagcaagaaaaatgcagaggcatgagaacactcaaaaggcacaaacagaattcagtcgatttactatcatgtcaagataatcaaccttgcggacccaatgcactttcatcgtgcctgttgtctgacactcttccaaagtcttatgatagataagcatatcatcccacttgttggacatccggaattgatcgtcgccgaagaagtccctcacctcctccggatttgcattctcaaatatagtactactctggtattgtggaggtccagtctgattgcatcaaaagtatcattcgaggactagtgaggattagcattcaccacttcagatcaacaagaagcaaagaattcagtccactgaaagtggaattcacctgtggatccctcctccatgcctggtaggtcatggcgggcagcgccttctccatcatcttgatccatgccgggccgccatccctgccctccactagcctccagaggttcatcaggtcatccttccccaccgccagctgctcgttcgccatctccgacgacctgtcaaaccaagaagcaccgacagggtcaaagacccgctccaatttcgcgcaccaaatccaccactcaacgatacggctttgaccaccgcaccaacaccacgaacacggggacgcatttcgccgaacagttcgtgggcctacgtacccaagcagggaggagtcgtcctcctgctgcggcggcggcgccgggccggcggcgccgacgtactgcgcgagcggggcgcggatgcgggcggggagctgggtcctccagaactccagcgtggcgaacgtcagcggcgcggggtggctgtcggcggtggcgacgaggccggcggcccagcgcgggcgccacgcccagccgagcaggaggccgaggagcgcggcggcccagagcgggccggccagcacggccatctcgcaggccgcgccccacgccgtcggctgctccaggaccctcgccaccgccgacagcacgtaccccatcggcggcggacgcggacgcggcggcggcggcggcggtggcggagcggcgtatcgggcggggggaagaaaggaatgggctttgtggcctatcgagtcgtggaggggattaaagactcgatttttatttttattttttttctctctctctctcttttattatttatttatttattgggtttctttggagaagcaaaaggtgtggtgtgtgagtagtgacggggggtcattgaggtgtggacatggtgcatggactttgcatctccctatcacctttcattatttttttttcttcttttttaaggagattttctaaaggacatcttggaaggggggtcattgaggtgtggacatgatgcatggactttgcatctccctatcatctttcattattttttttcttcttttttaaggagattttctaaaggacttcttgggaggagtttagtactagtttaggtcttcaatgtagatgtgaatgatttttatttttgagaaagactaatgaatggccccatgggggtgagctgagatgatgttttaacaaagcaatggtgggtggtcaattgtttatatttcctagaagagtttagcttttcttaaggtgttggttgacccttattaataatggttttagtcttagttgatttctggttgggatgtcattttcacaagagtgttgtgctctcattgcttgttccttgaagccgcaaaagatagtctaaagatgtctaaacaattgaaaaaatgaagtacataagcatctccgttgagctaaaataaaaatgcatcatgtaccttttgctacaatgaaaggacaataagtactcactccgtcccaaatataagaaattttagttatatggaacacatcatattattatgaatgtagtcatatagtctatccatattcgtagtactaatcccatccaaccaaaacctcacatattttagaacggatggagtaaaccattacaattggatcgcatatgacttatatatgttttaaaatgtgacctttacaacttgagtgtaaactctttcaacagaagcgaaacaagaaaaatgacgatttcatgaatataatcgacttagtaacccccgtcataatataatcgactgatctacatcatagttaagtcaatccaatccaactaaacttgtgaaagaaatatccaaccacatactccagttcataaatatcctaagactcatcctccaaacccattttcctcttctcatagctcatcacgacatgtactagtactagtacctactggtacttattttttctattgaaatgatttttcagccattttttttcgtttgaattgatttttgagccattgaatccatgtgagagtggcatggacaaggtgtagagacgtggagggttgagccacaagtgataaggtggatttttccggatttggggggagaggttgggggcagcaccttccgattcctgagggggccaaatccccccaccaaccaaccacagcccgccacgtggactgcagctggcccaagatgagtggccattggccaaacacccagtcacccagaccagcttagctcagatcagtacaaaagctaggctactattggtccctgaacaactatgcaaattgatgattagccatcagctactactaattgaaagaagaatgaaaaggcagaggcttttgttactaattgatcgctatcatatcaccttcatcagttgccaaatggctctcctgtagctggtgtctactggacacctgcagagtgtagagctgttcttgcagctgcatgtgtcactctcctatcctgcctgagcctaacactgtttctcaatttttcttgtcaagctggcactgcgagtgatgtgtacttgttcagcccagaccatagttttggtatgaatagcactgttttatgtgatttgttttaataaaaaattcgtagggatagaggggctgatcagttcagctgggatgtagctgcacagccgcaacgctacagccctcctagcctaattctgcttgctgactcctatagctgcagcaccgctgcttccgtagctagctattctaaatgaacccagagtgaagccaaaatgtcagcaatttttgtagtgtatcactcattcactcagggtgtgtttaattcacgctaaaattggaagtttgattgaaattagaacgatgtgacggaaaagttagaagtttgtgtgtgtaggaaagttttgatgtgatagaaaagttggaagtttgaagaaaaaatttggaactaaactcggcctcacttaaggcattttttcatatagctgaatgattttgctaatactattaatggtataggcgaacacattaactattataatttttaaaaatgaatgttaatgctttttaataaattcgtatcaataaagctttaaagaaaatcacaccatatttaaaagccctatcgtattaatccattcttcaaatgccttataagtgagtgaatgagtgatacaaccctattcttccattcttcaacctacaagtttcatttttatgttaagaattcttcagtgcatatgattctttcagtttccatggtgtgtgtatgcatcatgcatgcatgctgagcagataaccctatctatctatatctagttcgtccttcattgtggtgccagcaatctggataagtgggggagtttggccccattctctaatctgctgatgatgctaaattgtagcacatgcatgcgtgtcaaagtgtcctgaaatttttacaatttggtcctttttaaaaacttattttacaaatagacccctggaaaaacttaaaccggaaatgatcctttttggggcgccagagtggctggcgccgtaccccaacatggcggcgccagccacactggcgtcgtgcccgtgccaccgtggcactagggctgtcgtggaggtgctgactgggcagaaagggggcgccagccacactagcgccgcccctcataccacggcgccagcatagctggcgcgcccctcctctgtgggccgacccttaaaccccgtgggccccaccacctttctcctccccactcccattttcgccattcccagcccgagcagcgagctgctgttcttctccctctctctccccctcacctctctacctcaaatccactcaatttgaagccgtttttcgcgggattttttgtggaaatcgaagagaaaggtagactccttcattcccccctctttttttcatttttattggttgaatttgtagatcggtgggtaaccctagaaccccttttttacccaaatttgtgatttttagcatttgttcttaggattggcttgttgtagtgctacatgtttgcaatgtactcattggtgtcatgatttttttaaccatatatgtggtaatgttaatttttggatggtttggttggatggatggatgaaaaattatggttgaggcatgacgaaggtttgggttgtatgatagagtatttgtaatatttcgatgtgtaatgcagtagtaaacttgttgatagttgtaggtggattaaatatttttttggagtagtagctttgggacaatttaagttatgcattggttataatatgtcggtttggactacgtttaggaatgaagatttaatttttgttgcaaagttacatttgattttttggtgtagatggatagacttgttcatgtttactacggtggtagagtggtggaaccttatgttggtggacatgttgagtttgaggatatgtcattgaaaaccattttgtttcccacccacccaactctagatgaactaaggtcacgagtgaaagaagttcttggatggaccgaggataatgtggagatttgtttttataggagatacgatgttggtcaagggcataagtatatattaaatgtgataggttagttggaatgggaagtttactttgatttggtaaaagagtctcagtttagatctctagaggtgtttgcatcaaagttagttcgtaccgtagaaaatttggatctaaacaaatctccttcttatcattacgttgagaagaattttgtgacatattattctcgtcgtggaggggtgcaagtaagagtgagttggtacgagaagacttggagggggaaggagagaagaagagacctttgcttggaaatgatttatgggaggcaggaccatcaaagagacattgcggtactgatgatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatgtgaatccagatgattactttgatgtcgaattgagtggtggtcacgattctgtctcagtaaaagtcaatagagatgatgttgacgaggaggcaagtgttgagcaatatgatgttgaatttgctgaagactctgatgatgaccgtccattccctccacttactaataatgacaagttagcattagaggaatgtcgtgcgtttgagaaggtgtttgggaggaagccggacattcctgagtttagggacctaacacatgcccatggtgcactactagatggcggcatcaacctagatcagttgccagaaccattccaggtggatggtctcagaaagggtttagagttcccatccatggtcgcattgaagctatggctccaggagtacgccatcgtgcaccatcgtccataccgtgttgtcaattctgccgcaaataggaggtacactgttaaatgtgaaaacccacggtgcaaatggaaggtccatgcaactaagaggtctagtggcacgtggaggatatcacgggtaggtaaggaacatagttgtgctactgccgaaggttcagggagccaccggcaactgacatcaaagttcatagcaaataggttatgcaatgccataaaactgcaacctacactctctgcttctgcgttagctttgtatatatttgaggttttccagtatagggtgaagtatggcaaggcttggagggcacgagaggaggctatgaagctcatttacggtgaatggggtgaagcgtatgtctgtttgcccactttgctgcaagccattaagcagaggaatcccagtatggtctaccacatcgatactcatcctgatagggttgtcaacgttgatggagtgactaagaaaatttttatgcgtgcattctggtgctttggtccttccattgaggcttttaagcattgtaggccagtactagctatagatgcaaccttcctaactgggaaatacggtggtgccttgatgactgcattatcagctgatgcggaggaccaacttgtacctttagcttttgccttggtggagaaagagaattcacgagactggtgctggtttatcgatcttgtccgacgggttgtggttgggccgcatagggaggtttgtattatctcagatcgacatgctggtataatgaatgccatgatgactcctgttccaggattgccatcggttcaccaccggtggtgcatgaggcacttcagtgctaatttccacaaggccggtgcggacaagcatcagacaaaagagctcctaaggatatgtcagattgacgagaagtggatatttgagagggatgttgaggcactaaggcagcgtattcccgaaggtcctcgtaaatggcttgaagatgagttgttggataaagataagtggtctcgtgcatacgatagaaatggccgccggtggggttacatgacaaccaacatggccgaacagttcaatagcgtgctagttggtgttcgtaagcttccagtgacggccatcgtatcatttacgttcatgaagtgcaatgactactttgtgaacagacatgatgaagctttgaagcgagtccagttagggcagcgttggtccaccaaggttgacagtaagatgaaggtgcaaaaaagtaaggcgaacaaacacactgcaaggtgtttcgataagcagaaaaagacatacgaggtcacagagaggggtggtataacgcgtggtggtgttagattcggcgcaagagccttcaaagttgaaggtgaggggaactcatgttcttgccaaaggccattgctctaccatatgccttgctcacatcttatacacgtttatctgattcatgcaattgatgaggaatctcccaaccgaatgccgtatcagttctcttcaagagccgttgtgaacacgtgtaccaaccggggagactaccaccaccactacctcaatccgcgcgtccaagtactgctcgacactccatcaggatagaagtgcgtgaaagagttggtggctcgtcgtcgtcacgcattaagcaagggaggggaaaggggaaggcgccggctccacctagcgacgacgatgacgacgaggacgaggaggatgaggactacgtcgcaccagacgccgaggagatagacatgtcacagcttcccgacgcgcctcaggggacgcaacccacgcaatacaacttgcgatccactcgggcagcgaaaaagaggtaaaatgagcttaccattctcaaatgttatttgatttcccttattttgtttttaaaatgttttaaacattggattttcaaatgtaggtacactccgggctcgcaagcaattcggcgccaacggaagaagtaatttgtatgaagttaatctattggttggtagtatgacatatgtggtgcactatgtgatataaaatgtgatggactatgtgaggactatgtgatggacttttgacattgtttcatgtgtggaatatagaatggactttttgcattgtttgatgtgtgggatatgtgatggatttttggcattgtttgatgtgtggaatatgtgatggactatgtgaggactatgtgatggacttttggcattgtgatttgtgcaattggaacctattttagtctgtacgaatctgtgaattgtgatttgaattgcgaactgtgaattggtacatttgtgcaatatggatcttcaatttgcagggaggcaaagggcggcgccaaccaccctggcgccgcggttgggaagggcggcgccagccagtgccgcgaggcagaagggtttcgggctgggggagggcggcgccagctaccctggcgccgtagtccatgagggcggcgccagccgaggcccggaggcagaagggcttcgatggggggaggagggggcgccagccaccctggcgccgcggtcgggggggggggggggcgccagccgttgcctggaggcagaacagacttggcgaaaatttttaggggggggggagaaagttggtggggcccgcagaggaggggcgcgccagccatgctggcgccgtggtatgaggggcggcgccactttggctggcgcccccttcggcctagtcagcacctccacgacagccctattgccacggtggcacgggcacgacgccagtgtggctggcgccgccatgttggggtacggcgccagccactctggcgtcccaaaaaggaccatttccggtttaagttttctcagaggtctatttataaaataagtttttaaaaaggaccaaaatgtaaaaatttcagtcaagtgtcacctgcagaaaaagagctaaaacctccattatttatctgttaattttcgcatgcaacaacccatatgcatgtctcatgtgaagggacagcttagctagctggctgggctacctaaagctgcgtgttaattatcctaattagttagcccttgagtgtgctaaacgtttgcaatatgaaagtgattaagctatgagcaccaaaagagcagctagctcaagctgcaacactaccacctacatccttctagattggataacaaatattgataagctagatctccaatgcagtttagcccagctgatcactagcattcatcatctctttatcgacgttgcccataattgagaccacttaatcatgtgattcacaaggtaataattaattagtactagcatacgcgacgatgcggcttaagggcaagtttaatagtacagcccactactaacttcaattcatctatagctaatttaatagccaattcatacaatagttacttactatactattcatatatggtcccacctgtcatacacaccttacgtcttggagtccgtactgcagctggctacagatctgtagcccgctgatcttctctctaatcttttatctcattaaaatatgcttatagctggctaatacttcctccgtttcaaaatgtttgacaccgttgactttttagtacgtgtttgaccattcgtcttctttaaaaaatttaagtaattatttattcttttcatatcatttgattcattgttaaatatactttcatgtacacatatagttttacatatttcacaaatttttttaataagacgaacggtcaaacacgtgctaaaaagttaacggtgtcaaacattttaaaacggagggagtaatatgctattgtgcctgctctaattgttgtctatatttgcacaccaaccacccaccaattgtttgctggccatgcatatcatatactttgagctagagttcagtgatacacgtatgtacttccttttggaaatcaagaaacctctcgcctataaaagaccgcctatttaagcatattaatttgttggttgggatagaatcacagcatgcagaaaatgcacagctatatacaactccagcacatgatctttgaactatgactgatgtccaatccaatgcccattcttgccagagcccaattagtgatcgatctggatcataccccagataagaagttaagaactgaagctgtatacgccgcaggtaggacaaatcaatcatacgtgaatcttcagaaaaataaattgcactttactaaatgtttttgtttttcaaacgatgcactttactgagtaagagtagagaatagatgcgcccggcgtacaaaccaacctaattctgaaatggagtcctggctcatcgtttcgcttataaatatcataaacgaaccatcttactaatgattacaaaataatctatgagtaaaactttcaaataaactgaaaagaaaacacaccccgaatcaactcttcatcacatttctgaatttctgaatctgttcttcagaaatcacatttctgaatctcgtctttttattgaacgaaaatgctggttacttttggaaaaaaattctataggaaagttgttttaaaaaattatattaatctatttttaagttagttttagctaatacttaattaattatatgataataagctgttccattttccgtgccggatggatagggggccccttagagcaggtacaatgcgggctattagccaaccataaatatattttaatgaaataaaagattagagtgaagagcagcgggctaaagatctgtagccagctgcagcacggactccaagacgcaatgtgtatatgacaggtgggaccatatgttaatagtatagtaaacactattgtatgaattagctattagatcgactatagataaattagagctagtgggctctagttaaacttgctcttatggggaaacacccccttagattgtcaaaaactctaggccaacgcttctccagcctaggccagatccgagggccttgcatcatgccactgaacgagaatgggatcgtccgcgtcgtcagggaagcaaagcaaccaacaggcgccgccatggccgaccacctcgcgagcttcagcgtttgcttccggtttctcaccatctgaaattctgtggatgctgccggcaactggccttctgacaggtggtccccactagtcatacacactagcccagctgacaggtggtccccactagtcatacacactaaccccaactaactgagacatcctcaactgactcagcctccgagataagccgcgccgtcgccgccgcagaaaccgcaaaagccatcgccgccgccgccgccgccgtggccatggcagcagcatgctcctccgccgccttcctcgcctacccgggcagcctaggagcagggccccgccccctccgcctcttccgcgcattcgcggcggcctcctcctccgggtcggggagcaagaagaaggcgaggaagtccaagggcgctgggaacaagggggaagccagcggcggtggaggcggcaaggggaaggagaaggcgctggagccgccgcccgcggtgatacgccgcgcgccggctgggagcgcgtcggtgttccagcagccggagccggggttcacccccggcggcggcggcggcgggaaggggccgacggaggaggagcggcggcagcggcaggccaacgagaacgccttcctcctcgcatggctggggctcggcttgatcatcctcgccgagggcctcgcgctcgccgcctccggtaacgaagcttagttttatttattttttttcaattaatatattatcctctgcttacaattttagtggttcaacttaactgaacaacactagtctgtaattaacactgaatgtctgaacagaaaagaaatcgcgtttcagtaagtaatcattcagtaaatgaccacacctttctagtggaaatgctgaatgtggtgatcagtgatggaggaatcgtcacattttctgaactagtgtatgcgttttccattcctatcatgatatgttggtgtaatcatctgaactgaagtgtgacatgataatgatggtacacgaaacaaagtgaatgtagctttacttgctctaaataagaattttaagtagcaccagatttattatgtgttattataacagagttggagtagttatcaacaagtgacctaacttttttttaaaaagataatgaagtgacctaactatttactgaggataatctgaaatttagtgctttagaactgtggagcttagtgatctttgagactttgagccttatatcataatgttatgcaggtttcctgccagaagaatgggacagctttttcgtgaagttcctttatccatcgtttactcctacggtaatattgtttttgggcggtacggtcggatatggcgtcttcaagtacttcgaaggcgagaaaagcaatagctagatggctgcacaaaggttggactcaaatatattcatcttctgaattttggccctatagttctcccaaaagtttttttatcataggctcactgcctccagcaatcatatatctgactgctagttctgtatatgcctctttcacatcaatgccatattgccatctctgttcttatgatctttggaatctaaaaccttttttttctgcaatatcgtattttcatttcttctccttttaccttaccatagattggccatattttcatttcaatgtagatttggaagggaacatattgtctaaccgtcacataccccaatttatttgcaggtgagtaaaagaatgaggcgggttgaaacacgattagagagtaaatggttcatatttgccatggttagagtattgactattaccatcgtagctgcacaagacaccagtcagaggctttgcgcaaattgcagtgcgactgtgcaaattacaaattgcgcaatcataagcaaatggaaaaaaaaaactcaaatctagagtttcccgacatgatttcgcagaccatgcatatcgtggtcaagacaagaggatcattgataaattcagtttcttgaagcaagcaggtgcagagaagttgtaccctattttatgaggcatcacacaaatcagcggctggggaagctacgagctctggaactccctgtctgtcatcagtgtctagttcgtctctagctagttctcttgtacttcttgacttgttattgttgttcaggtcatctaactcctggggtttgttcagcgtgcaagtcaataaatttgtattgtgctattttgttaatgaaatgaaacgcgatcgtttggtttttataataattttgtaattgaagtggttcagcttttgacatgagtcagcagggcaggtgggcaaggaggagatcgaaggatgcggaggacgaacgaggtggtgcagcgcggcggagctccggcgatcggccgccgcgcgatcgaggccgatgcgcacttgtgacggaggccactgcaggtgggtcctactcttgtgtgagcccacatggcagtgggttcgtctttttacccaaacgggccgcacctacgcctcgttcccgttccggcccaacaacgcgataccgttctggcccaacaagaactggccggaggtgatctccgtccggacgcgcaagaagtcggtttcttttttctgcttatcccatttctagtttttttttcctttcaaaaattatattaccatgtgaaaaataaactagcaagcaggtagatgtctggcctagcctacttctgccactctggctactgatcgatctaaaaaatgtgcctcgacacagttcatacgaagaccaaaatttgtgtagcatcaccctattgttcactgatagtagtacacaattctgtaaattgctataacgcgctctgtccacaagcaaaatcatgtccaccaaatatataatatcccagtacacaattaggaaatagaatgaaaggaaaataacttattggttgttattacccaaggggacaaacctacactacacctgaaattgaacaagaaaaaacagccgttgtacagtagtacaagacgccaatggctctgagcatccaactccttttgtgttttaactgtttacatcaggaagtccctggggtcagtgacgtatccggtgagggctgaagccgccgcggtgaacggcgaagccaggtagatctgcccttccttgtgccccatcctgccggggaaattcctgttcgtcgtcgacacacacacctgcacccaaatacgtttttgaaatcagttaatcaacaaaaccactcgcatcaacaggatataatttggagaacacttgcaattccctttgcattaaggacttcttttcatcacaaaatggtctactaagggagcattttactttactgattataggtctaccatagttattcccaaaaacaacggctttaatttggactagcacctatgattacccaagtagtaattaatatcgtagccagccaccaataatgtgaaagtaattcagatttttgttgtccctttaaatagagaacaaaattcgtccagggtgacagggttcatgataccttatctttcaaggaagacatctataaattctactatgttgataaagttcatacgaaacaacatttcctgttttactgaaatatttggaggcacttaccataggttcattcatgcgagcatatgtatcacgaggaccacccaaacaagcaccacaactagggctagctggtgtatcacaaccagcctcctcaaatatctgtgagcaagttttgccaccggctcctggtacagggatgctataaatgtccatccacacctacatagatttaacattcttattattaaatcgaaaccacaggatgatcatttcagtatgtgtttgctgtttgctgcatttatcaccttttgtgtcgccggaacgagaaaagtgggaactttaaccttcttcccctgcattaatgaaagcaattttagtaagtcaagcagccatggagtagtatgacttgagaattactgtaacatgagatttaagtttgtatatagagaaattgatttaaataaacaggatggatcaatatgcttcaacaaatagtgctggctataatttgcagttactgagtcaatcaagctggatgtctatcacagtaaggcggatgctagatcattataatcataactgattagcagaaattaacctaaccatctcctataaacacacaaacttcctcagaacaactcaacatattgaattccaatcaaaacccaacccgatttgatcatataataccgtagcacattaaccctttcagcattcaatgtttaaaatattctagatgtgcctatttaaaccaatattccctttctgcattgatttcagctgctcatgtacaagggaccaatgaggtcaactgaagcctggtccatatcaacactctttgagtcagaacctaacaaccctagatagtaacaaatggatacgagcacaaaccattggcattatcctcctcttaagttctaaaacataatgagtatctcatagtactaaataaacaaaatgacttgggtcatatgtcaccaagccacaagattcaagcctcttaccgaagctaagaacaccttcgcagcagcaaagaagtcctcagttttacctccagtacaagaaccgatatagacccggtcaatcttgacatctttgcactctcttgctagagcacggttgtcaggtgaatgtggctgcaggtccaccaaaataacagctttgactcttttgtataatgaaattgatgagattgcaaaagataacagtaactatatgaacaaaccttggcaataactggctccaatttggatacatcaaaccggtagtcactaacaaatctgaaaaaaatgtagtgaaatcaagtataagagagagagagagagagagagagagagagacatcaacagcttatgcttatgcggtttcaatttaactattcaaaacatgacacaaacggaccacagtttatctacataagcttatagatcaactaacaatacaggaaaaaatagagtataattcatctaaaaaaagtgtataattgcacaaggacaacctagtgtcacaagttatcacctagtaggctctacatcattgtgataagctaaagacgacaaagaaaacaaagaaccagttaccttcaaaattatttctctccctacatatagcaatatgacattcttcttttcagttcaagtactcaatatccaaatttagctataatatttctacatgattgaagcaacacgatctgatacttgagagccttgctaatctccagtgcaatcagttagatttcattaccatgatatgccttcagtgcaaaaccagcaaatagcagtattgataaataatatcatgaagatgtgtacggtaggaataggctagctgaatgatcggcatgcagcattttatttatgaagtttgaaagtgattaatatacagcaaaaaggtgctctgtattacaaaaaactctagaaaatgcgcatatcgaagtattgaatagtcaaaaggaaaagagaaggtataggcaataatcacctggcctgagcatcactatagacaggctcgtattcaactgatgtcttgccctgcagttaccaggatgaccgatatggagtcataattatcattatgtaaaagttagaaatttgttcttgtaaatatttcttcttattcgaagcttaaggatgttgggttgttttatttgcataaaaatatcgctcattttattaccaagcattttaaaggccattaaagtacctcaagatagttaaatgtagtttgatcggcaggcacaacaccattcttgccaccagcttcaataaccatgttgcacagtgtcattcgctcttccatctaccaagtttgcggaaatattaggttaaaagccatgaaagatgaaaataattgatcaatctagttatgagcacggagcatacatttagactttccacagttgatccaacaaactccatggatttgtatgttgcgccagatacagaaatctcaccaataatctgcaattagcaattattgaggatgagctattagaaaatgctggtagaaagataagtacagaaaaatatacaagtattttgtagtcttacttgtaaaatcagatcctttgcaagtaaataaggtggcatttctccatctaatacaaacctgatagttggaggcacctgaaaataattttgatagatcacattaagaatatttaaataaaatataaggaacaaaaagaatcctagaattcctattataaatgtaactatcctatggatagtgctattgacatgatacatcccatatgtctaccatgctacgtttggatgaaataatattcagatggcgcagtatgtgcaccagaataaaaaaaattctactgtcagcacccagaaatctatcttgagttctgatttatagtggtcaaaagcatgcagcttgctacaatgccattattacattaacatacatagaactgacacatcattcagatgaactcactaaccaatatctgaaccactttttactatcaaggctgatatttgaattcgatacggagtaatcagaactttctacataccttaagaagagccttcccagtgcccatcacaaaaccagcatcagtgtttccaattccagttgcaaattggccaaaggctccagcattgcatgtatgagaatcagtaccaaggagaacctagacaacaattggagcaggttaatcctgtcctatgaaaccaccagattcctgcattagcacattcactggaagtacctcgcctggtctgcaatgaccctcttgagcaagagcaacgtggcaaacacccttgtagtctggatttgcctgcaaacaacacaaattgcagtttatttaaaaaatttcttcaaaatgaacatgaaaacaggtttgatacaaaacaaacaagctatcaattggagaaaagataatgaaaatggatcggcatactttgaaattgctcaggtccttgatgtcatagaagtacttgatgttctgctccatacagaaatccctgaggatatcaacatttcggtttgctcgctcatcgctggtgaagatgtagtggtccgggatgatgaccaccttctctcggtcccaaaccttggcgtcctccccgaactcccgcttgaagatcccgatggtgccagggccgcagacgtcgtgcgtcatcagcacgtcgacgtccacccacacgttctccccgggctccaagctggcgcgctccgacgccctcgccaggatcttctctgtcatcgtcatggcgctcttcacctgaaaccgcaaagagtcccatcctcatccgcatccgcacgagaatcacatcgagaacagcagcctagcctgggtcgagaagccgtaccgagccagtggaggacggggcgcggggggcgcgggcgggcgtggcgacggcgcggaccctccccgaacgcgccctcctcccactcaccctccgctgcagctgctgctgcgacggcgccacggcggcggcggcgagctcgttctgcgacaaacaccagcaagcaagggcaagggggttagcatcgcgaaccgcttgggtggggaagacggataccagagaggtagaggggagtggggcgaaccttgtgggcgaaggcggcggccttcccagcgacgggggaggcggcggagatggaggccatggcggcggcggcggcgcgcggtggtgggggcggcgaaatggcgaacacctgtggggtgtgaggtcaagggaggcacggggattgtattgtggcgtcgtgtgtgtgtgtcgcgtcgcgcgtgggaaaggcgagccacccggccacagtgccgcgtgtgggaggtgacgtgtgcgatctcaaccgttggattgagatcggacggcggtgagtcggctttttttgtggccaattcgaccttttttttcttgcatcgatccatatgtcggtatgaacagaggaactgggcttcattcaaggccttctttatgggctatcgcgaggcgccaatggaatcttctaagaggccactttgtgtgatcaaatgacaagcccatgtcccctcaaaaaaaagggaatatataatgcaaggtcatcaaattatattaaaaaaaatcctgaattcgtagttttcaatttaaccctatgataattgacatatttttactgaaaagttgtttacaaatacttgacattgcacgaaatactttcggttttacccctatgataaattatattatatccactaaagttcgtttataacatgctcacccacttgctaccaaaactgctactacctccgtttttcactttggtcaaagtcaaactgtttcaaatttaactaagtttgtagaaaaaataataacattttcaactcatgacaaatttattatgaaaatatatttaattattgatttaatgaaactaattttgtattataaatattattatatttgtctataaatttagtcaaactagaagcagtttgactttgaccaaagtcaaaacatcttataacttaaaacggagggagtaaataatatcctagaactaaatagtagtctgtactacttcaaagaaaatagtggtggtggcagtgactctgccacccacctattcttatggtagttttaaaaattactccttgaactttttcatataaatgggtaaccaaatatgaagtaatatcaaggtgaatattccgaatagcaaaacactaagtaccacatttcataaaaaaagtattttagataatagtatactactaatatatgttttatttgtagcaaagtacggacgtttataatttctagtttttgtgtgtatggccaaaagtgtcagtaaaaataagaaggaagtagtacaatgttctcccttcgtacaagcttttaatgtttttcataataaacatctggtgatggaataacttgttacagaagctgacaccaaacaactctacatgtcaaacaggcagaggttggagataaaatggtgtataaaattttcttgttctttatttctaaaaaataccctatagaaatattattgtatttgcacaaatatattagttagattacttcatgcatattcttgagagagactttatgcatatcctacatctccatctctctccttaaagtactagctgttagtagtaggaaaataacaactaaactttaaaggagaggtaatttaaagtgatcaaataaaaaacattagatttagaggccgatttggacggatcacatctctaaacttatcatcatggcaacaataccacgcaatcaatataattaccatcgtaaaatattttaataccgttaatactacatcacaccaactaaagttgtattgtatattgttgcgctagatctcgcacatatccataattcttttaaaaacagcgggctgcactttgtcctatataccatatcatataagtcaaaatgtgccccaaaataaaaaactaattcagtcaaattatgtctccataactacgatatatcttattgtgtgctaaataatataatatagccacaataaaatggccccaaatgcatgtgaacactttggaaatcgtagttatattataagtaagtgcttctacactcttcccagataaattataaattaataaggcatatacgcattggagagtatatttaaatatacataatatggtagactaaattggtcacgtattttgtggttaaaatacaactcaattattacagttttttcatttgatttattccttgaaagagtgtgctgcgaacttaatttgctgaattcctttttatatttttttgtcaagacatcatgcacggcatgtttgtttcaaacctttgatagaaattagtagaaatttaaatgaaatgctatagttcttgcacaaatcctaggattttcctcagtgtacaggactaaaattccacctcaatacaagaataaattctcacggggagtcttgctctgagttgacttggggttgactcattactctccttttccttctgtatgaatgcattggtcagtgttctgcagacaaagcacctgatacaacggcattagtagttttcttcagcttaatccgcctcctttctgagaccactggagttgattagggtagaacagttgaaagttttgtgtgagaattgaatcatggtccctttatcttatatttaaaaagtggttgaaatacggttattcacttgtggtatcatgtaatggcttgccacttgtgctaaagctggtttgtcatgtactgacctttcttgtgcaaagctgaattatatagagtatttattacaaggtgttatcatcgatctaggctaatcaaaataataatatagatcatcatatccaactgccacaatggtatatttaatggtcaaaaccgagtagtacttgactttagccagttgataacatggtcgaaactgaatatgaaaacgaaataatgttaactatgtctgtaatgtttatcatctgagaatattatcgttttgtgagacatatttttttttgttatactatggacgggtaagtgcgtagttacctcataagatcatggttaattttctacagctatataacaaatcgtttcatattttttagttctgacaagaagtagtcaatagtgggcaagaggcccttttccactgattaaatttcaatagaaaatttgtacatttttagtttaaaactttaaagtcatacttttgctttccacgtctttcctttgggctcatttcttaatgcctccatcgtgaaggagattagaaaaattgccttcgaaaaagaaataacaatataaaatactcttttgtaaaaagacacctgaatactctgcaatttcaggaaggcctggcatgacgactgctgagaattaggattcaattttttgttctgatccatattatattgagttaggtttaatatataaaaggaattaaaagaagaaattaactacatgtacgtctgctattacatcagccatgtccaaatatacatttaaacaattttactagtaatgtttttgagaggtaatttagagtacattcctcttaggaaaatgatttacgaatatccttatttactaacatataaacaatttacatttttttctaaagcaagcaatgtgttaattgcttctaaatatggttattattgatgatcaaatatttcatctcaaacagacgcgtacgttatttttctcataccgtcttttccggatgttacaacttttttacgttacaggtttataatttgagtagacacatcccatgtagcattttgaccatgtacaacgaatatatcacaaagtacttatatgccatattgtggattttaattttaattgctttctgaaaatattttgaaatatcgatagccaaatatgcatagtaaaatctttgtaacaaaactatacaaaaaacatgcgtaatattatggggaaaaaaactgtgtttgacagagtctatatataccaacaagccttgcagacataggtacattaattgcaagaagaattcaaacattacaaaattaatttatatacttaatagggacttggccacaaaaccataaaaaaaaccataaacaagttccatgtcacaccgcatatttcgaaattagcaccacctagaataaaaaacctcccctacacaaaacaaaacaagaaaaggattaaacaataagccccaccattatttcgcctcttaaaaaatgccattaatttaaagcaatcaccaaaccaaacaaaccaaaaactcttaaaaattccacccatttgccaatttttccagttgtttaaattaaattaaacccaaatcgatcccttttatttcctatcttgcatttcccatctccatcctccctctcttcttctccttctccctcccctgttcttgaattcctcgccggagaacttctccggtggtctctgagttcgcactccaggttagaattctggtgcggtggctcgagctcgggttcgaattcggatttcctgggttggttgatcttgatcgcactcgcgggaagaagaagaattaggaagcagagtgatctctgatggtcacgggccgagaagggaagagataggagttgttgtcatggagcccgcgacggagaccacggcgacttcgccggctgcggctgccgctgcgcagccggaggcggaggcggaggcggaggcggagtcggcggcgacgccggtggcagtggcggcggcggcggcggcaacctatcagccgccagcgccggtggttccagtcgccgtggcaggtgcggcggcggggagagggaacgggaagaggaagagggggaggccgaggaagtacgggccggacgggagcctgctccggccgctgaaggcgaccccgatctcggcgtcggtgccggacgactccggcggggggcagtacacgccggcggcggcggtgggggccgtcatgaagcgcggcaggggccgccccgtcgggttcgtcagccgcgcgtcgccggtgtccgtggccgtgacggccgccacgtccaccgccgcggtggtcgtctcgtctccggccacccacacccagacgccgctcgggccgctaggtatggaaatttttgagaaattttgccgtaatttcgaaaaattcaggtgaaaggcctgcaacttttttttggttcgtcttaggataaagataataagcctgtttagttggagtttagttggggtggtgacttgtgagagagacaaggcttttagaggagagacagacagggactgtctactgatctagtctaggtaggtgaactgaaaactgaaagaggcctgcagctttcaggttaaggttgtttctgcttggacctgtagtaccaggtgctactagtaccttggttctgcctactgtgtgtcatggtctcatggactcatggttgggtttcagagttatgagtgtcttatctgaggtttcagacttcaggttatgagttatgcaaaacttgatgaattttgtagacaagttaccagtaggtatcactattcagaaagccttagtttgagatttcaggggaaacagtactacagtagttaaaacttcaactcatcatgctgtttactgcttagaacctctgttgggtggtgtggaactgaaaacctgcaacaggcgttttggtgtaaataccttcagttgtgaattgtgatgagatgtagtctgttcctatctatttggttagggtggcaagaataaccatggatgagatgatattagttgctggtgattttgaatctagttttgtctgggtgtattttactgcaaatactattttttatgcattagttgaataaagttgttacttaggtgataaggtgtgcatgtggaaaaatactactactattttgtatgcattagttgcatagagttcttactggtaattgtatgttcatgtgcgcatgacagtatgagcctacaataaattgaaatttgttcaaggatagcatttcgcctccatacttgataaaaacacaaaggctaaaaaatatgagaagtgcatgatgtcctgaaagctttatttctctcaatgctgagaacctgttgatgggcaggtgaattggtagcatgtgcttctggtgcaaacttcacacctcatatcattaacgttgctgctggcgaggtaagatgtcactgattttttctgtttcctcttcttgctctcacaatgttaatagccttgtctactaaatttgcttgaatggtgttaccaacttaattttgttatgccaggatgttaatatgaaggtcatatctttctcccaacaaggtccaagggcaatttgcattctgtctgctaatggggtgatttcaaatgttacattgcgtcagcaagatactttaggtggtacagtgacttatgaggtttgttctttccacctccaaattaatattcatgtttctttttgcaattttcttgctctgcttgtacaatatgcaaaacagatatatcacccgcatttaatttatgaactggaaaggacaatcgattgagtcttgttatactagccatattacactttttactcgattatattggcctctcaagttcattatcattggtcttgcatgttgttaatgaaaccttttacactaaaaccatctttttgataatcttatgatgacttttttttttacttaagtctaatgtaacttttggtcctggcaaatatgaattgcaaacaacatgtaaaactgtggaggaaatattttgaaaaagaaaatgttgattgtatgattgatatggagtcaaagttgagtggcccaaaagttttggtatagtcagtatgcaggttgaggattttatgtgtttcaataagctaagcagaagctgtaggcatgtggttttcagcatgctgtccctgttctagcgtgtgaaaactgatttttctttaatcctagttctccagttaatctgggcaagaactgtagctttaaaccagatcagttcacaaaaaggaaccaaaacaaccaaagagattcctatagagacattataactttctaaagggtgaattaataagtaaagacacagtttcctttttgcagtattgatattttttctgcaatttcgattaaaaaacattaatatcaaccttactggtagcaatgatgaatagtttaaggtataagtgagcgctttgttttagtctaatgagagtgtcgaacagtaaaagcagtaaacagccagggcttcatcagttccacaactagtggaattgcacaatggaaaatatggccactttctaggactttgtcccaggagaatacgatttacaattggaggaaatatccgccaccttgagagcagttgattttcttagagaaaaaaaaaagagtagttgaaattttttttgaacgaatgagtagttgaaaaatcaaatggtgtaaattatatgtcataatacaattcacatgatttgacttgagtatatgggtctagtaatagtcatgatcaggacttctccgtgacccaaaataatctttgtttcttcactttactacatgatgaaagttaaaaaaatgcaaggaaattaggtggaaactaacaggagaccacctgaagaacttgcatggaaattatgtgtgcatttcatagcatgtacatatggatccagtcggacgttgtcagcactcagcacttaacagtggaaaaagtgtgcctaatgtatatattgacaatggaataattccaacacctagcttttccacacaagcacatatgtactattcgaacaaacttttcaagtccagtctgcagtacaattcctctgtttatatactgtacgtgctaatgactgatcaactaatgttcatttcaatcatatatgtgtgcatatccactcttcatcatgcagacttgtttcgatcttctaatcatagatgtgcatatagccatgtctatttttgtatcaaagaacttgattaaaacttttctctctaaattcctaactgatcaatgtgctgttaatttaatcagggccggtttgagctgctctccttatccggatcattcacgccaactgatagcggtggaacgagaagccgctccggtggaatgagcgtctcgttggcggccacggatggccgtgtcatcggaggcggagttgccggcctccttgtggctgcaagccctgttcaggtgaacccttttttcagcttgtccagaattattatcatggactattgctcaatgtttctaaaaatacaatttttcaaaaaaaaaccttctattctattttgaagctatttgtaaggtttataaatatataatatttaatttattcctataatcaatcggcttgaatttgtggataatctatttagaatgctaccttaagctccatggattgtgtgttccaaagtgttgatgaatgatagacgaaactgagtttataacaattattcgagggcacaaacaaatggattaagtaatagaaaagttataagtttgatttatcaaagttatctaaaaactattgatattataacttataagaaaaccaagtgtaccgtctagaagcttgagaagagtgtccgcgataatccgtcatccattatatataaaaaaaagaacgtgctgtacttgatattcagattactcaacaatgacatatactcatccatctgctttgcttgctgttggcaacaacctgattgagtcgattgattgctgttctctatcaggttgtggtaggaagcttcctgccgagctaccagctggaccagaacgccaccaagaagcccgtcatcgagatcacgacggtgccgccgccgccgccggccatcggcttcaccatctccagcggcgaccctatggaggactcctacagcggcagccatggccagcaccgctccggcgccgccgcggcgacgacgacgacggcgaaggccaactcgacgtcggcgttcagggtggagaactggacgccaccggcgccgccggcggcggaggcggcgaggacgaagacgccgtcgtcggaggccaaagtcccagtccccggagcctgacgaagcttgcattgcatatagttgcattgtgttgccgtttgttaattaggccctgaaatggatgtgcagagatgaaaattttcgtactaccatcgatcgatcagtcgtcgtcagatcatcagcaacctccgtatgattaaatcagtgatgcagttaaatgttagtggaagaaattatcacaccatccctcgtggactggtttatccgattaatctgtacttaattatgataaggcagggacagtggagaaatataattaaattctcttgtggtactatctgttaggctcatgtgagctaatgatgtgcttgtcttgcatgcaggtgctgggcagcggctctactcctacctgtgatgcttaattgtttatttatgataagtgcaataattaggctccattcatttttgttaagatgcaaattttacttcagttttcgttagcgtgtttcaaaaactgctagacaataaaaatatacgaaaactttctgattaagtgcagttagatccataattgtgttgctactatctatcgattttgctatatatttgtcgacaaatttttccgcaaaaatttgacagatgtaattacagtacaatcgtagtgtaattacactgtaactatagtgtaacttgtatgtaactttcaaaaatctctccgtaacataatatttcggtaaaatgaaggtcgtgggaacaaattatttcatatatgtgtgtgctatgatttgttttcttcctcaccaaaacaaatcttgtaatagatctaacgatttaaaattatgtgaaacttacatataagttacactgtagttacatgcaagttacagtgtaattacatataagttacagtgtaattacactacaattgtactataattacatctgtcaaatttttggggaaaaatttgtcgacaaatgtataggtagtccccttcagttcttcttcgccgtggagaaattcttcaaaaaaatccggaaattattccgttccaaagaaaaaacgttagggctttttaaagtacaccaatagggtggtgtcagaaaaaaagtaaagcaatagggaaaagacaggattaaaatgtcatggaatcaggaatatgaaatgccttgttcaaaggaaaactaaataggaatttggtggattctgtagagagagtagaaagacaaagagacatgttgcattggactccttagagcaagtaactataagccagctataaacatatatcaagaagataaaagaagagagaagcagcaggctacagatttgtagccagctgcaacacggaatccaagacacaatgtgtgtatgacatgtaggaccaagtattaatagtgtggtatatgtttatatgtaactattgtatgaattgactattaagttgactatagatgatttagagctagtagttggctatactattaaacttgttcttatttggtgggggtttgagttcattggtcccaaaatcaactccaaagttaaggttgaaaatttaaattttgactgataatcatgagcataagtgaaaagatgaggctgattgtctgttttcctgtggaattggtgtatatgaactcaatacataggaatttggtgagttaaaatactttgttcgaaatggcatgttcagaaaagaatttctagaaattacaatcctccatttgtcctatgaaaattctacatctattaaggttaaggtagatccagagcacagttgttaccagcgctttgccgtttacagtcgatccatggcacttcaattagtcaaagttttgtcaaaagagaatggcatgcatcaccttgaattaatttggtcaatcaccagttgctggcttatagagttggaaaatattccctgctctatgtaaaacagaataatttattagcacatatataattaattaggtactagctatttttttaaaaaataataaatatgaattgtttaaacctcttttctatagattttttaaaaaaaccatttaaccgtttagaaaatgtacgcgtgaaaaacgagaaaaaaaaataggaaacgatgtcaggataacgaacgaaaatgctaagtactactcatcattcggtcaagtttttttctagcgtacgttgttgttcatagtgccatatatgcctctttctttcttccttgagcatatgcatctttctttcttcctacttatacatatatatttcgaaaacaactgcacaagttacttttgtcctgaatggacgatatgttatctgattttgatcttgtgataatatcatacatagggtataaacagatgaattaactgttaaaaagttgaaaaaagaacctagaaacctatacttagaaaattcttataattaaatcgcatcgtttagaagcttataaagcgtgtccgtgataatctataacctataataagatgaaaataactggacctatatatcatcggataaattaagatcgatccatcgaccatgggttgatagatgcatgttcggagaagttcctagctatctcagctggggcatgaataaattgatgacctagctagcatacaggaaatttttgattggtcagattgctaagatgcaacgatcgatcgattactgtctcgctcgatagatctagctagctatcgctaggactttctgcatccaagtgcatagttttttttttctttttttgaaagagtaataagcgcctaactttttctttctaggtgctggaataattagtaaccgagcaagcactcaatcttaattctgcaggtacgtagcagctcgatctcagctagctagacagctagtagaaaaagagaagaaagtccacaagaaagaagagatctacagctagcatctgtggactggacgactagcaatctagcatatatatgcagctgcccaaagttctttttttttattatttcttcaattcgttttgggcgaaattccgaactaacaacgaaaaatacgatggcttccttctcctagattaccaaggaatagtaatatttattttataggtgaaagtaggttgcatttaaatatatatatattatatgttgtgaagaaaggaagaaatgacacgaagagtctctatatatggatagtagaaaaagatcagaaattaagctaaagaggccaggcaggcaggcagcatcatggcaacagcctggatcgagttgaactcgattgctagccaattaaatataatcttgccacttaattagttaactaagctgtgaaaattagaatgcaagtctggcgaagttacatgatagctgctggctgctgcatggatcatccgttgagcaattcagtaggaaatttggaataatccttctagtcctgtgtgcgtggatgcaagctagtcatcgaaagctaatatgaagctactgccggcctgcggctgggtgtctgcgtctcagctgcaaaacaaaatgagactgatacttttcttgttacctagctagggatcaagtcaattttcacccctcatcgattggatcagcatccattacttcagtgttagctagagaaattaataagagcaagttttagaaagctccacatatattttattgttgaaattgaacaaaaaccctcaggtatatatatacttgtgacacatgtataaccccagctgatatcacaggactctctttgtttgatattataggtcattttaacttgttttaagtcaaatttcttcaagtttgatcatttttttaaaaaaatatagctacattaccaaaataaatatactataaaaatatattcatgaaactaatttgatgttttagttagataaaattggttaattttaaagtggtttaacttaagataaatctaaattgacttataatataaaacgtagagagtgctaattaatgttttacatatataaccccacccatcgagcatgcaatttaatttaaaatgttatttttataaatgcatgcatgaaattaatgatttagtttaccgtaataaaatatatggtgtcctataaaatatttaagagaaaatcccttatatacccctgaaatttttcctaatcccttctatacccctgaattttgcttacttccttatatacccccaaaatttgattttgatcccttgcatacccctcccgtcagttgaccgttagttgaccgtgtattttctataaaaatgaccattttacccttggatgaacaaagaaattcatgaattacattattaaaaatataaaagcttctcgcatgagactattatagttatgagtttgttgtgcgatgcattatttatcccaaaaaaatatttttagataatgaaataaaaaaaatacgtatttattttttaaaaaaaaggtcataaaaatgaggagcattcatataaagataggtataccaatgttcacaacatttttttttatgaatgctcctgataaaaaaatccattgtcctgataggtataccaatgttcacaacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacagtaaaatgatggaaaatgtaacggtaggggcatggaagggatcaaattgaaatttcaggggtacagaagggatcaggtaaattttaggggtatgaaagagattgagtgagttttcaggggtacacagggaatttactcaatatttaactaactatactgttgtttaatgaatgaataacgatatatatgtatgagaggaatatccacgaaagcatatgcatgtagtatatatattttctactaggaacacatttgatgtctatttatataaaattaaatcaagtgaataatgtagtactatatagcaatatcactatgctagtatatatataccgtattaaagtagtgcaggtccatttatatcacagtaggttatatacatgtagccattaaaagtaacatattatttaatttgaagatctatatctatccttatagcagacggctgctaaagctagaatgccggcagaagcaaagagatgcgattgcttagaaactctacatcgttcgtgctagttgtgcacacgaaatttcctgcatgcattccaagtacatcatgcgtacaatgatcaacatatttgcattattctttttgaacagaatagggtcagttcctccgtttccaaaagacagctagctcctttcattcttacatattgaagacacttctgttataaaatgctaatcactatgcttatacagggagacgcatatgcatattagcatatacaatacacactatgctcaaagaggcagactagtaacatatagtcaaatactctctagtctcactaagattaaggtggtgtttggattccctaactaaactttagtccatatcgtattagatgtttggaactaatttagagtatcaaacacaaactaattatacagatggaggataatttacgagacgaatctattaagcctagttagttcatgatttaacaatgtagtgctaaagtaaatatatgctaatcattaggcttaataaattcgtctcgtgaattagcctctatctgtgtaattagttttataagtagtatatgtttaatattcaaattagtattcaaatatccgatgtgacaagtactaaagtttagtcagggtatcccaaacactacctaaattatgttaaaagttcaccggggagtgtataatatttatggtactaaaatttaaatcctattggaggtggaaatctaccagatgcaccgattctctcatcacatttgaatttacatggcctatttttcttgcattttctttgaagaatggtagtgctcttttcttgaaagaatggtaacgctcgatcgcaaggaaaaagaacaactacaccatcggtgcttctctcatcccttttaaatttacttggcccattttccatgtattttctacggagaatggtagtgctcccaagaaaaaaaaaagatggtatagtcatcttgggaaaaaaaaatcagctacagtacacatatatatatagtactgactaaacacagaaaaatcaaaccaggccgtgtttatttcgtgtgccaaattttttttaaagtatacagacacacatttgaagtattaaacgtagactaataacaaaataaattacagattccatctgtaaatcgcgagacgaatttattaagctaaattaatccattattagtaaatgtttactgtaacaccacattgtcaaatcatgccgtaattagccttaaaaaattcatctcataatttacatgcaaactgtgaaatttatttttttatccacatttagtgcttcatatatatatatatatatatatatatatatatgtttaacatttaatgtgatggatttttttggaagtttcaagcgactcagttgaaaaattaacagcaaagccaagagagagaagataaactcatggactggttggctcactggaaggtggggccagatcttaaaacggtagcaaaagcgcgcgaggcactcggctagtctagtacggagtataccacgaacacgaagcttcctgtggagtctggacctctgctacgtggggagcactgccacgtggcacgactccactggctgcgttgagccggtctgcgtcatcgctgatcgcccgcggaccacggtccaaggccggcggaagcggaatagagatgcgcgttttgcgttgcgcgtgcgtgcggcatgcattttggaaagtgatgtctgaaaatatcctgaatgtacgtaattttgatacaaagatttaagagctagtttggtttgaggtctaaattaggcttaccaatatttgataatttcaatagtgtttagtagtgttcatttggtttgaagtcaaattttggcatgcctaaaaaaataggtcatttcaatagtaaacttaagctattttggcttaaattcaaacacaactttaccttataaaaattagtcatgccaaaacttaccaaaatttgacactaataaaatttggtaaggactatttaggccataaaccaaaccaactctaaattcacgacagagtccacaactgcacaaaaataattccaaacgtatataatacgtcccaatgtatatatatatatatatatatatatatatatatatatatatatatatatatatatattttaaactatgtaaattcatcacagcatttgcttaaaaaactacaactaattaatacaccatcggtccttaaaaaggaataacttgaacatacatttatccagtttccttaatagaagtagcgttttatggaacgagtacaatttttttttcggggaaagggaagaaacgagtacaagattatagttggaaaactacaaagaacaaaatcgtggattaattagaaacaagagctttttatgaaataatagcataaaggcaaagatagcataaatatattttttattcacattctaacaaaatcacaggtgctagcaaacacatgcaggaatagtggccgtacatgtttaccatgaaaaagagaaagaatgtaacagatcacatggcacagcgaaaatgccacgtgtactcgtactccagtctcgtgctacatgtttgtactttgtccctatttaaatccctgttaaaattttacacaatgtcacatcgaatgtatagatacatagagtattaactatagacgaaaaaacaattaattacacagattacgtgtaaaattacgagatgaatcttttaagcctaattgcaccatcatttaataatatagtgctataataaatatttaatatgacatatttaattagtcttaataaattcgtctcgcggtttatatgcggattctataatttattttattattagactatatttaatactttaaatatatatccgtatattcgatgttactaaaactttacaccctaaactaaacacaaaacacagcttttgtaccatcggggcaaagcagtggtctcatacaactacaagtacgagccatatctctcgcgtcaatgcttgcgaaactgtagaagcttccggaccggtcgcgccgcaccgcaccgcacccgcgttaaaacgcaccgagccttcgcgagaactacccgaacaatacccgcccgtttccttgctcgcgaatccactcgcgcgtgcgtgggccccaccagcccccacgcgcgggtatataaacccccccccccgcctcccctctcattcctttttatccgacgattcaaaaaattcgaagccatccaccaacgaagaaaaaaaaaagggagaaaaaaaaatccacgcacactttgcgtgcgaggcgaggcggttcgattcgagaggagagagagagagagagagagagagagagatggacgccttctactcgacctcgtcggcgtacggagcggcggcgagcggctggggctacgactcgctgaagaacttccgccagatctcccccgccgtccagtcccacctcaagctcgtacgtttcgtgcccccttctccctcctcccgcgagtgttttttttttgggattttttttgttggggtggatttggttcgcggcgtggcgggtgttgctactggtctaggttttgcgtggtgtgggatgcgacaatggatttaggtttcgcgtggtgtgggatgcgacaatggatttaggtttcgcgtggtgtgggatgcgagaatggatttaggttttgcgtggtgcgggatgcgataatggatttgggcgtcaagttctcgaatccatggttcgtgttttattttggggaaaaattggggtaatgcggtttttattggattgttgatactctcttccatgctggtttgggctacctgcgcctggttagagtttctgtgcctaatttgtgaatcgcaaatcgtgccgagggaatttctgcgcttgtgcatgaaatgtggcgtatgtgattagattttgaagactagtcgcgttgatttggggaaatagccatggagattagtcttcgttagtttcgaggattagatttagagactgaattggttggtttggtaattcctgacgtgacacgtaccaatccacgctatctgtttataaaacgccacacgcgctactcgattgggcataatttttgttcacagattttgtttgattcgtagctgtctatgaatgggttgtattactgttgattccacgcagcaggtagcactgcaagtctgaatgttatgccccatagcctggatgcttttcatgccttcttaggttgtaaatacaactagattttgtattttttgcttcttgatattcatgcgtccttatcagattgggtttaatggttgcaataatgacttgaatcctgacggtgcctgcaggtttacctgacactatgcgtcgccctggctgcgtcggcggtgggcgcatacctgcacgtcgccttgaacatcggcgggatgttgactatgctcgggtgcgtggggagcatcgcctggttgttctcggtgcctgtctttgaggaggttcgtctcggcttcttctgctgatcctgataactcgattgcttcctccctagaaattcgatggaagttttggtttactgacaatgtcaaatacatggtgtgctgactttttttttatgtcttaccctgtgagcagaggaagaggtttgggattctcttggccgctgccctgctggaaggggcttcagttgggcctctgatcaagcttgctgtagactttgactcaaggtaaatgagcttatcctagttgttttaaacaatggtctattgctatacagcgacgcaatgattcattgatcatgattggtcgatttagaagtaacttggaaaagtaaatgacatgttggacagacaagttggtgataatggttgataatatgtcaaggattgagtgtgacatgatgctcgtgggatttactgtggctcggttgcctttgaattaagtgtcgttgtctactagtgtctggttattcttggaaacattaaatgggttcagatgtgttatagtggtcaaattatgcttgtgaaattggacttttatatcatgctttatctttttctttaaatagattctacaagaacagaagtttgccaaccatgatagtagtggtattatagtctgggtaaatatatcctgcatagtggtattatggtttggtaaatgcatcatgcatagtggtgttgtcatgaagctgatgttcatgatgctctcatgatatgagaggttttagcgttcggtggtacgatattcattcagaattccagggtgtgctgtcgattctggttagtactagtattcagatatgccctttcacattttttcttctgtcacatgcctgcctaatactgttagctagtcttgtagatactttcctctggagttactaggaacgcacaacctactttccccctagaaatcagtagtgctagccttgtgggatattgtcttatggtttgggtatggactttgtttcatggttatcatgggcttcttttattttcgaatgatggccaagttgagtaccaccttaacagataaagtattccgttgtttctgtttgtcttgtggctgcaaaatttgtaatgtaactaactgtcctaggagcttttctcttgttgatctccttaactggcatgattttttttacctgttgactgatgttatatgtctattgttgtgtgttaccagcattctcgtaacagcatttgttggaactgccattgcatttgggtgcttcacttgcgctgccatcgttgccaagcgtagggagtacctctaccttggtggtttgctctcttctggcctctccatcctgctctggctgcagtttgccgcatccatctttggccactccaccggcagcttcatgtttgaggtgagatactggggctatattcttgtccaatcctaacatacaacatactacgcatcctttgcctgaacactgatacatgtgtggtttctcctgcaggtttactttggcctgttgatcttcctggggtacatggtgtatgacacgcaggagatcatcgagagggctcaccacggtgacatggactacatcaagcacgcactcaccctcttcactgacttcgtggccgtccttgtccggatcctcgtcatcatggtgagtacatgactcagcttactgctcaatttgctcatcatcctccgtatgcattgccgcgattcggtttgattcggcttttgaaatgctgacctgacgatgaacacccacaatgtctccgttgcagctcaagaacgcgtctgacaagtcggaggagaagaagaggaagaagaggtcttgagagcttctcttcccgctttgcacataagaaaaaaccaccgcggctattgcctctacgtattatgacagagccgcacttcaactgggttttatggtgaatacaagttcttttgcattttgttgatacggtgtgaatcttctcaggtttgtcgtcgtagtagctttgcaaatactagcatgctacatgacacggatctttctgtaatggtggtcgcgttgatcgaaacgtgaaaacacatcttcatttgcgactaatttgtttgccttttggtgattgatgatgatcctttccccaacttgtgtcattgttcccttttgatgggcgtttttgagcaaaccccggcgaattgtgtggccacgggtggttcgtgttacatttatgcgaacagcaagtttgcccgcgggcttgaatgctacgaatgacgctgcacggcgcgtgttctcatttaccccatctcgacgcagaattcacgccggtaacgtgcggcaagtttcgttaaaaaaaatatgctaactaaaactagcacgcttcgttttagcatcttattttaactggagtcggtcaaattgatccatcctttgaacttttgtatttcggggaatcacgataacaacatatcaaaaccttggagtagaatcttaagagatgaacctctcattctctaacaagaggtatgaagattaagggtctgttcggctgcccgcgctgccagcacgaacagtgctgcgcacactatgcgcagccgcagcagttggtatgctgaacaggccttaagattttcgtggcacgctttttaaactgataaacagtgtgtttatacgaaaactttatatatgaaagttgctctaaaatatcatattaaactattttttaagtttgtaataattaaaactcaattaatcatacgttaataccaatctttttgggtaaaaaacttaatcttcatcttcagaagaaaagaataccaccaaccttatactggattggatattttctattcatattcatagatttagaaaatgttcaatctgaatcaaaagagtattattttcttgacgcttttaaaaatatgttttctcaataaacattcttatattatatttacaacagttgctttaagatattcatcaattttacatatcaaattatttaattatttatatacttaattagataatctataataatttaattcaatcttggctctattattcacattgaacttgctagtactaaaattttcaattccaccaatccgaaggccaaagttttactaccactacacgaccagaggtacatagatataagagcaagcgggaagagcacacacactcgccgctcgcgccaccaaccttaacaccttccctccaccatacgcaacgccatggagaggacgacgacgaggcgcaccagcagcaagggcgccgccgccgcgcccgcgcccaaggtggtggccgtcctcgccggcctgctcgagcgcgccgcggcgcggggcgacgccgacgccgacgcccggggcggcagcgcggccgccgcggcggcgacagcgttccgcgggcggacgaggccggagatcagcgtgcggcggtacgcggagcggatataccggtacgccgggtgcagcccggcgtgcttcgtcgtcgcccgcgtctacctcgaccgcctcgccgggcggtcgccggaggaggagtcatcgccatcgccatcgccgccggcgacggcagcggcggcggtgtgcgtggactcgtacagcgtgcaccgtctgctcatcaccagcgtcatggtcgccgccaagttcatggacgacatgtgagcatccaacattccattctcctctcccactccatttttttcttgtcaactcagctcgcatctacctcaactcgtgccatttttactgccactttttgcgagcaataccaaattaaactagagcatagcttgcatcccactcttaaagaaaaccgagagcacggaaggattttaacaccaggcacatgccaaagttgaccggccggcatcaagaatcaataaaatcccagtcctagcaagaacacaccaatgcagctaacatttttgcagtacacaaaccatgtgccatgcgtgccatcaggcgtgaaatgggcgatcgattgaacaagatatcgatctatctgtgacctgtcggtgcagtgcagaatgcagagtagtagagcagatcaaaggagaggataaaaaaagaaccaacaataacaacgacaactgccttgtgtgtcggcgaaggcaagtcaagccggtgctagaatggattagcagctgttattatgccgcatttagtccattattagcttaattactcatgtggctattttatccagtgctcactgctcattatccagtactactacattgcagtagttggttgctgatcgagctggatattgcagccaagaaacgcatgttctaactaaatgcatcttccattctctgaagacgcttaatctgttcagtattgtagtaattttttgggtgctcgagattgattagctaagcacgagacgacatggccggcaggtaggtgcggttgggatgtccagctcatcgctaggttgttcctctcatagacagcacgacagctgatcagtgctgaacccgattgctcaccaacctacctcacacctgctaactacttaaccaaataatcttttcttttgcgcacttcttaatcaatttaaactactaatcttagctgcattatgtatcaattagtggctaaccagtttagtttataattaattggttggtaaatccgttgctaatactagtagcatttttttttctttttgttgatgtgatcatgtgcagacactacaacaacgcatacttcgcgcgcgtgggaggcgtggaggtggcggagatgaacggcctggagctggagctcctcttcgcgctgcgcttccgcctcaacgtcacgccggcgaccttcgccacctactgcgccgcgctcgagggcgagatggcggcggatgatggccccctgccgtcgccgtcgccgtcgccggaggaggaggggaatgaccgtcgtcagccgccgccgcgacgaaaggacggcatcaccaacaaggtcgccgccgccgtggacagatcggcgctgctcacggctgctcatcacagagttgtagtagtagagatcacccaatgacggcatacacggcagaagaagcgccataataatcaatggccattgattgccttgcccgtgattaattctttcatctctttcttcgttttcttctctcccaaatctgtttcgtggtgatcagtgatcacgattcacgactcacgagctgttgttggttgttgcctgccattttcgttgatcattttgtgtataatcgcaagatgttgcatgcgcaccgcctaacccgtagatgatcatcttgaattcttaattgacacaataaaaaagaaagaaaagttttttttttttaaaaagaaaccgagccagacttagctagtgctatattaagcagggtgaaagaaaaaaacagataaacaatgaaaaaggttataagccgtaagtgataagaaatactttatgggtaaaacttttatatatgtgttcttgaaatcttaaaagtcaatagtaaaaaaataaactatgatgaaaaacattaaaaaaaactactttaaattaagttttaaatttaaattttggtccgtgattttttttatgagaaacacattacaaacaaaagcactcacaacacacgtacacccatccttataaaagcacacacgcacattactgtgaacaccttcggtagacttaagctgtgttcggaggaggggttgctcccggcaagcaaaacgaaaattgtttgattgtatgattaattaagtattaactaattcttttttgaaaagtggattaatatgattttttttaaataacttttataaaaaaagtttttgcataaattacaccgtttagcagtttaaaaagcgtgcgcacgaaaaacgagagacgtgggttaggaaaatggaggaaagaacacagatggtgtggtcattaatgggggttgggaacacatatcctccgcccggaaagcggagcaatccattagcgcataattaattaagtattagctatttttttaaaaaaaatggattaatttgattttttaaataattttcgtatagaaactttttttaaaaaatacacagtttagcagtttaaaaagcgtacgcgcggaaaacgagagagagggtttgggaacccagggcaacaagccagtcacttgactccaattgagtcctggtatccaatctatttgatattttgaagcccaaaccccagcccatttatcctggcctgttccataaatgggccggaaattaaaaatccagcccatcttgtgactgactcattcgaatatccgactctagtactaccgactagtcagaaacccacgcgaccagtgccagtggcgtcgtcagttcactcgcttcgcttggaaatcgcttcggcttcgcttctccgcctcgaaagcgacaaaaccccaacagcgatggctgtgcccgacgaggtcgccgccgacgccgacgccgaggttgaggaggaggagccggaggaggtggagtggttgtcgtcgtcgtcggactcggagccggagcacccggcgctcaaacagtggaccccttcatcacccgactcggaggaggcggaggcggagcagcagccgtcggcgccacagccggcgagctcggtgtcggcggggaaggaagatgagggggaggtggggttggaggaaggtgaggtggggaagccgttcagatggcccgggtggcccggcgcgagcgtgttccggctggtggtggcgacggacaaggtgggtggcctcatcgggcggcggggcgacaccatcaagcgcctctgcgaggacacccgcgcacgcgtccgcgtcctcgaagccgccgccgccgccgccgccaaccggatcgtaagacgactcctccctcgcacatttttgggtgattcgagttagggctttcgtcgtacggtggttagaacttggaaatagcatgttgatgattactccgttcttcgtttgagatcgggggtacttgctacggcctgagctctcaccttgtcggcttgttgctgtaagcaatacatggcaaatgttcgttcagtgtattagccacctgattctccttgttaattctgaattggaccgtgctattgtcatggttccgtgtaagcaatgtcctgcagcttcagcatcgacctagtttcacggtgacatgcataactgatttcatcactgttctctatgaacttgggcgttttgacatttgccatgttgattacactatgcaatgttctgctaaggacaatataggcttgcgatatttttcccatggtcaaatgtacttaattactctattagggtgcacccatgctcttgaagttttgacagaggttgcagcatcctgatcactagtgaaaattcctgggaagaagtggaaggcttcagagactaggatgacttatgatattataaagtttgagaacactttcttcattatgaaacagccttattagaagccttctatatgtaacagtttaattaccgcacatgatctaattcctgtgccatgttgggttctatgtagctgtgtcactgttctagaagctgataaacgatatgtggaaccacattgcatggtcttctttcttttagctttctttttgttctaatagttcaatagctaggcgaggcttgcccatcctatatttatttggttcctgcttcgtttctgtcatttattctttgtcaacatcagacacaataacctactagtgtcatgtttcaggtagattctgatagtaatgatttcatagctaaggttacttttgaaatggtagaaaactagtgcaagatgtgcagatggtacttcttatcaaagccataaacttgttcatatcgagtattcataaacttgttgctcctgttccatatttatgtgcagaaaagactagtctctggtattatttttttatcttgcaatatgtttattttcttgccgttgtatttcaggtgttaatatctgcaacagaagaatctcaagcagagttacctccggctatggatgctgcaattaagatcttcatgcatataaatgatatagagaagatcaattgtgatgatacattatctggttctgcaccagaaaaatgttctgctaaattattagtcccttcagcacaagccacacacttaattggcaagcaaggagtcaggatcaagtcaattcaagaaactaccggtgctactgtaaagattatagataaaggtatgtggtccaatgttctatggaatttgctcagttaaaagaaaattggacatgtggtgttactctccgtgtttctaaaatcaacgttcagaggttggatatttccaattcgaatcacttgttatttgttcctcaatttatttagtatcctgtagcttgtaatatcacaaggattcttttaactacaatgtccaaaaactaactggaaagtggcaattatttcaacagcacttcaacagtgagatattttctaaaaagcaaatgatttcaatacattgacagcttctaccaatttatccacttctttttcctggtttcagtccagtttgttgtgcgaacttagtgcagttctttggatgtaacacttgctattgtgtgtagttgagcttctgagttatgatgtagtggatgagagaattgtggacatacatggtgctcccctcaaagttctccatgccctaaaatctgtactcggagttctcaggaagttcctagttgatcacggtgtgcttcacctatttgaaagaaaggtaatgctacctgttcttcagcatgctttcttatgcatgaacatgaattctgctcatgcaattgatatttatgttgttcatctgcagaaccaagcagtaggtgaggcacatgataattctaaagaaaatcaagtaaatcaggttgccagtgattatcgtcttccagtgaacaaggacatattgttacctgaccatcgaactcctcttaacccaaaagtcagcagatatttgttgtatggccgagacccatctgtttgtgatccatatttatctgatcccagtcaccaagccaatgccataatacaacaggtctaaattcagtaacactatatcttataatcctctagttagtagttacaaactatacattttttctcattttgcttgtaacaattacctcgagtttgaactgtttacattctgatttgttttatatgtttattccattaattttttttttaaaaaatatgaactgatgtactcatctttccaattatagtgctgctgcagacttttttcatataaaatggtttttgctttcagataacacaaacaatgcagatcccgttgccatttgctgaagagataattggtgcaaggggacaaaatatttcttatatacgttctgtcagtggggcagttgttgatcttgaggaaagtagagattatccgaatgaggttttagttatgatcaaaggcagttcttcacaggttcaaactgcacatcaacttgtacaggttgataacctatgtcctgatgtacactgctgctcttgtatcctagttactgttaagatgccataaaaattgggcctctagctatgcttatttctaagtagactaagtcttgttggaaccagggccctgaaactcaccctacaaaactagttgccacctgttggttaaattgagttgatttaatagttgtaccagaggtagggcgtagggtgtttgtactgcttctagccaacccatttaaactgcacgtgcattttatttgttgccactatgggttgaccaaacccatataacctgggtttgaacaggcctaaccatagggttgtcttgcagcaggtttagtttagttaagggaatgcagtttcaggtatatgcactagccatagcatatgatggttgccttcatcctgctagtcttgagctggacagacttgagaaagccacttcatcagtttcaagataggacttagatagagccacttgttccctattgtgattttgattggttcctaagccctaactagtttctccctgttccagccaactagagtgtttttcagtggtacccagcacctgctagcttactaatgagaaactgaacagcacgaccctaactagtttctagaattgcaaattgcattcattgtttgtatggagagttagggaccaaccggaaaacggttattacaaacataagatccattatcctgtacaaatgatatttcatccatataatatttttccatattattgaaactgtatgcagttgctgaatgtattcttttcattttcgcaggaggtcttatcaggcaataaagagcgaccttctggaagcagctacatcaatcttgattctggcccaaagtttctgatctctggacatatcaatccagtaaaccgggatcacttggcatcataccgcgtccatcaaccgtacattgttcgatatggatcttcaagcttaccgcggttgagaggatacaggctgtagcaagcaaaactaactgcacctatagcctcattgctgtgtcctgtgtcaaacaatgaccaccaggcgcctgtgggagaggatgaagcggctgtgcttccagtagatgcttagataattaaatatggtaaagtttgtgtattcagttgtcagtcagcagaagcaaatcctaaattgtgttaaattctagtactccgtagtagtaatctagtctagtttttaacttcactgaagctccccatttctgtatggagaagttctaccatgtcggaagaagggctctgtaagttgtatatatacaccattagtagaactgcagttgttaccaggagctacctggcatcttatcgtaaattttctactacttcccaggagtaaaaacctgatgcactaaatgatatttggatgcttcatagcagaagacagtgaaactgacaggatgcaaatcacacagtagttagtatccttaagcttcgtatctattctagtcagagttattttaattattgcaaaagaattaggactcacaactcttgcaaaacattttttgatgggtaatttgactcttgcaaaacatatttttgatgggtaattttattttactcctgaaaagaaaaaaaaagaaggaaaaatcgcaacaggaggtgggtgggcctagcagagtagcagtagcaggtgaacccgcaccagcctcctcctcactatataaacacaccaccgccttagctctctcgagcgcctcccttcctcccccttcccgcaactttctagaagcatctggaagcttcggttgggtgccccaggtgagggatctcgtctccgatctccctcctccctaacctgcaccgccttgatcgaacccaaacctctatccaattcccatagttttgaaagattttttcagtttgctttcaattgtcgtagtcgtcagtttgcccggcgccgccgcctccggcgatccccatccatcccgcgagcgaggagggccacggcgccgtcgttcgttctgctgcttccgctggcatcaatcctggtgtggtgagcacatcctccgccacctccgcctgcgcggctgcgccgatccccatccatcgcgcgagcgagcgagcgagcagggtcgccgtcgttgtcgttcgtcctgctgattccgccgcatccgttacgcgtcgcgcatcctctttcccatctctctctactcgcgcactttttctcgaatttgaatttgcgttaatcctagctgcttctgttctagaaatttgccttaaccttttaatactaataacagtttgtttgttcccgaaaagtttgggggttcaactgaacccccatgttagatccgccgctggttcccgttagcattttccactctagaccttcccgtcatggaatgcgatgaacggtttttggattttggtggaaatggttggcttgataatttagaagaattctgagtgatcattttgggatctatttataattttgatctagaaagttggattgttctgacatctcagttggccatattaaaggtttttgcaaagggttatccggttcaaatgtaccttctgtttcttctctgttctgtagaacaaagtgtagtttgttgtatattttggttcgttatacactgcagatagaacttctgatatgctagttcatctgttcatgtaaaccattgtaacagcttggagtattaatgatattttattttgccactgtgcgatgttcgatcaatcccctgtaatacttttccacttctgatcttctttcaagaataatctgtatttgcactgaaatcaccaattattgtggacaagagtgagcaggtgcaagtagtactggtctgaatgctatacataaggaaaatagttttttacacacaaaagttgtgttacacaagatttacgcataacccatgcttttatgtttttttatggaataacccatgcttttattcatgaatttaagcaatcttaactgtcacacctactcacaagtcggaaagttttccaaaattatcacaccagcaagtaatatgcgaattttcagttcatttcctttttctgagttcactactaactcttgtgatcatcaaccaaacaaaagtcatggggattacacttgtagagtgtagtcattttggagcccgtatctattttaataatagtaatagtaccatgtgatgattttattagagaactagtcaagtaaattgtgctttgtttctattgcattgggccaatgatcctgcaactgaatttttacgctttcagcttcaaacaagctgcatatcattctgcaaatgtttcgacctgtatgttttatggacataattgtgccttcttgtcaagttactttatataggacatactggtagtttacttatgtactggacaaagaaactagcacatgtggattgatcaaatcaactcataaaaaaataatatcactagcacccgttgcatgttagatttatttcgttttggttgcatcataaatgcatgttgtgaacttgtgatgcatcacttttcccatttcaagtagcgagagctagtggcagagtaaagcttgcctattctattagactgtcatgcatttccttttaggtttaggtttatatttgaaatggattagataattaatcctagctttctgttgaattctcttaaactgttggttgcctattctaaccatcagagattttgctatctgagaataggtgagctagaaacatggtactttatgctgatcctcctcccccaataaaaccccctgaaattaaaatcaaagaactagcaaataagtctacatatgagtcctcaatgatggagcaaaagacaagactgcacgccattgagcgccacaggtcgtgtgaagtgagtcaagcaatcttatctgaggtagaaaatcgtcatcaacatcaaacccttgagcccatcaaaagcccaatatctgggtgttctccttcagtagaatcaactacagacaccaacacagtacacaggcatacggttgcagatgctgcttgggaggccctaaagaaatcaatagttcacttcagaggccagccaattggaactgttgctgcaatagacaagtctcagggagcactcaactatgaccaggttagcatttccttcacaattgaaccatggatataaccatttagccataaaggttccttaatattgttactattatctctatataaccttaccaaatacactcagcacatgccactcttagaatattcagataggtaaaataatgatgggtgtgattatttctcttcctgtaaaaaaacctagaaactcataattctccttatacatggacatccaatgcaattgacaatgataaagttcttgtcactctggagcaggttttcatgagggattttgttcctagtgcattggctttcttgatgaaaggagaaccaacaatagtgaagaatttcctgttagaaactgctcgccttcagttaagagagaagatggttgacctctttaagcttggtcagggtgtgatgccagctagtttcaaggtgcaccactgcaactctaagcacaaaactgaaagcctgcttgctgattttggtgaaactgccatcggaagagttgctcctgtggactctggcttatggtggattattcttcttcatgcttataccatatggacaagggacaattctctggctgaaagtcctgaatgccaaagggcaatgcgtcttattctcaaattgtgtctctctgaagggtttgatacatctccagctttgctttgtgctgatggctgttccatgattgaccgaagaatggtaagccacttaaacccaacattgctttgttttgttattgatggtatgtctcttaactgtttgcttactttcctactagagtgttaacagtcctgatgcattgtcagaagtattatcttgatcaaagttgaaattgcattaggtttgttgtagtaacatatactgacgcttttgaatttattcaatctggggtttaaaaggaactgccttctgtcaggtcctgcctattcggtttattattgactgcagaaacattaagaatgggatagggtagagcattacttttagttgccatgagcaatatgtacatgttaaaacagttatttacaattctgggtatgactgttttcttttcagttaatccaggcattgatatcaggattttttaaaaaatatttgggctgttaacggaagagacgtaatgctgaatggttatagtggtaccttctgatacatgtttatgttgttaaagatcggcttgttacatattaatcaattggatgctcttaaatttgggatagcaaattatctacttgtcagcatgaacatatttctgcatggttatctttcccttacttacagattgcaatctgtgcatgtgcagggtatatatggctatccgattgatatccaggctctgtttttcatggctctgagatgtgccgttactttgttgaaagaagatcacaacgacgactttgtgtaccaaatatcaaggagaatcaaagctttgagctaccatctgcacagttactactggcttgacttccagaggctgaatgagatataccgctacaagacagaggagtactcagagacagccttgaacaagttcaacgtgataccagaatcaatccctgactggatattcgacttcatgcccagccgcggcgggtacttcatcggcaacgtcagccctgcgaggatggacttccgctggttctgcctgggcaacttcatcgcgatcctctcctcgctgacaaccggagaacaggctgaagcaatcctggaccttgtggaggagcgctgggaggagctcatcggagagatgcccatgaaggtgtgttaccccgcgatggagaaccaggagtggcagatcgtcaccgggtgcgaccccaagaacaccagatggagctaccacaatggaggatcatggccaggtacgtacgtactatagcagtataatctccaaatgttgtgcatcgatctgcagctgtttcttgtggatgacaatcataattgattggaatgatgatgatggatcagtgttgctgtggctgctggtggcggtgagcgtgaagctggggcggccacacatcgcgaggcgggcggtggaggtgatggagaagcggctggtgaaggacgagttcccggagtactacgacgggaaggccgggaggtacgtggggaagcaagcgcgcaagttccagacgtggtccgtggccggctacctggtcgccaagatgctcctcgacgacccctccaacctccgcgccgtctccctcgccgacgactgccacatccgctccgcccccgtcctcaagcgcagcaactccttcccgtgatgatcaacacaatgctcaaactaagctcacaccgcacttcacatatactcaccaccaccacgtaattaacgctgcctcgctgttaatgttcttatacgtacttagtagtagaagtactggtagtaggaatttgggtgcactcgtttcaccggatgcctcagctggtggagattttggtagcttggaagtgcacgcgcaaaccttggggtggaaatggatttttttgatcaggatgttgggacgctcatgattagacctggatggctttgatgatagtggattgattgtccatccacattgatgtcgaatctcttctgcttatactgagcttgttgttcttgttgtttgtcggtttagaaaccaggtcatttgtatcttgacgatcaactgggtgctgcttgttgaaacgttgagtagttgtcgctgccattcgatactgcacacttgcatttaatagtgagtttctattacactgtgttggtgtacgaaaggaaagcgtggtggtgctaagctagtgttatctcggccacaagccaatcaaaggcacacgtaggacgagaccccatccaaccaccccagccacgtcagcaagagggcccaccctgacctgccacgtgggcaagaaaaaggaagagcgcactcccactcccacccaaagtgaagtcccaagcgctcacgctagcctctcatttccgcctctctctctcccccccatctctacagaggcagcagcagcggcggcggcgacaagggaagccgatggccatggcgacctccaccttctcccccccggcctcgcagctctccctcacccgccgccgcctccacccgggccccgacctcctcaccctctcctccccgcgcctccgcgccggcctccgcctcgcccgcgccgccgccggggaggcccccgtggagactgtcgaggcgccgccgagcaagccggaggccgagccgtcccccgctgcgtccaacggggccgccgtcaaggccgagaagccgccggcggcggcggcggcgcccccgctgcccaagttccgggactcgaggtgggtcaacgggacgtgggacctcaggcagttcgagaagggcggcgccgtcgactgggacgccgtcatagacgccggtgaggctcagttcgtctgcctccctattcctctctatgcttcagtttgctgttgctgccttgctgctgctgctgattaattagctagcactacactaatggcggtggaattcataaaatctactactagagtactagtagctaagcattgcataactgcatagtactacttcagtattaggactcctttatcagccattagttatttggtatttacttgatgaatctcagaatgtttgcatgaattgtcgtggatacgattgatgggagtgccgtctcggcactgcgacttcaattccagtgtggttttttagctgggttgctactgtgctttgatgaacccattgctatgccctctggcccctggatctgtttgtgcttatattggagtttggagcttacttcccattagtctcagtgatagtgacagtgaccttccatctgctgaagcgaggaaccagcttgctgacaacaacacctacagtgctatccattcaggttcctgttctctatggctgtacaacttcaataatcagtgcgccgcaaaattataaaaataaaacttcaataatcggtggagcatgattagatggatagcctcatctagatgaagtttcttaaaaaaaggatgaagtttctagcgtgtcaccattaatttgcttgataacgtatgtagaagatgatgtaaactgctagacacagtacacttgcttttacagttcaagctgctgggagtgcccttgcaaaaaagaaaaaaaaaacgaaagctaggtggacatgggaagcgctggagtgctaggttggatagggaagagagatctgtcgtgtgtgcacaactagagtttgaactgaactgaaatccaattgatttatgttctgaaactgatcttttttttttctcagctgatttgcatttctgtacgtagcttgtgtttttttaatttatgaatcggtacaaacaagatgtctgccaatgatgtgtaaacttatggcacttgtcattgtgctgcagtgaatggaacaaaatgggattccttactatctaatgaggccgactgacataactccttggaaatgttgcaatcatctgatgccatatttgtttgtttgcagaggccaggagaaggaaatggcttgaagattgtccagaggcaactagccctgacgaggccgttgtcttcgatacttcaatcataccgtggtgggcatggatgaagcgtttccatctccctgaagccgagaagctaaatggtcattcttgaatccttctccttttcaaaagctgaattcaaaagtttttacttgcatcaagccacatgtgcaaacaaaccacgtgcatgggaaagaagaattcatcacttctaacatcacactcttatgtctctgcaggccgtgctgccatgattggcttcttcatggcatactttgttgatagcttgaccggcgtggggcttgtcgaccagatgggcaacttcttctgcaaaaccctactgtttgttgctgtggctggtgtgctgctggtcaggaaaaacgaggacatagagacagtgaagaagctcatcgatgagacgacgttctacgacaagcaatggcaggcaacctggcaagatgagtccccttctcagcccaagaaatagctctgaagtggaatctgaatctgaatcctccctatgttgtattgtatcacttctttttgcagcccttttctcaacccatttattagtgaggctcagtacattttgatgatcttaatacctatgacgtcttgtaaaaagtacgaactcgtttctgtgctagaggttaacgttgctgcgggttacttggttgaatgttttctttgtgagaattgcttgtactagttactccctccgcttcatattataaaatgctttgactcttttctaaatcaaaattcttttggtttgactacgtttgaaaaaaaaacgtagcaacatttttaacatcgcatcgcgccagaacaaatctgcacagttccatcggcagtgcacacagccgttataggaaactaaaaatcaaaattgttcttggagctcgaagtaatatatcaagacattagcgcaacctgtgtcaccatgacaagaaaaatgatttgccatctactagcttgacctgttgtcctgttttcggtaagcaaaaaagagcatttgcaaatggtgcatcacaagttcatgtgccaactttacaaattgcaggcaaactaattccaaaagtcgggcgtgagttccctcatcagttgacaaaattgctacgcccagttgcctagtttttgctaaactgacgctgcttcaagtatgcacacaatgcccattctgtatcagttgaacctgtcaaaatcagggacaggctgatccagcatcatgtatcgtatctaagaaataaatgtgcatgtcattgaggctaaaatgctaggatagatgttcctggaaaatgaaccacatttcagaatggaacaaagcacgggcatgaacctacgcacataagaacacaaggtaggtaaaatttgaaactagactagatatggcgtgcactgtatgtgcatgtcatcatcattaacgcataatgcatgtctgggggtcagctaatgcagatgaagtagtctatattttacaaatgagatcttttaactatagaagatagtggcaccgaagtttcttaagagacacatcagacgaacctgtggagaacataaagagaagtctgcagtctgatatttcgccatctgtagtgtagactactgcctttgatcaggtacagaatttaagtcgggcatgacacggttgaattctgacctgtgaacggagcacatcaaattaaacaagcaaacaatctgattcttactgaaacaaattaaagctctcaggaaaaagacaaaagaatagaaacacaaagcaactataacatacccacaggtcgaacacttcttatgatacttgcagaatatcgataaacaaactgaacaaacatatcccatgtcaatagtcttcttatggcagaaacatctgaaaagaaatatagcaaattagatgcagttgaaaggccaccagtatcagacaaactgaatggaaacttaaaaacaaaaataaactgagctgctaatcctgacctaaggcctttggtaagatagaacttcacaaaaaaaattagctgtatgtttctcacatttttctgaaattgtcattggtattatgctatgttttcagatctataacaagcatctcatagctatgtcacaaggcattcaagaagatgaagaaacagagatatgcctaatgcctagagaacttaatagaggaaactgagtgacacatacgaagcacggaaatccactcccagagtcttggggaggcgcagaaaggttcttgagtgtaaatcagttgcaaatacagcctgcatatttgcagaaatgagtcattgagctcaagcaaattaatcaagttatctgaaatagaaatattcctactcagatagaataaagacaaacacaaaacagagcaactttggaactaatatatatattccaaaaacaggtcaacgtaagctgatattgaagcaatagatttgggtcagaagtaaacagcacagtctatcacgccataatctgatgattccattgttgttcattagtgtattgtacatatatatgtgaatctgattctagattaacaggtagatatactaccagtaccaggaagatggagtatctatgtgccccactctagtgacagaaaatattgagttttgacataggagatgaactcatgaacatagacactgagagggcattcaactttgtagtctactagtagcatccaaaatcatttggcactaaagtttagagatgtagttgtgttgatcttcccagattgacagtttgagacatacaggaaatattatgcttgagtgcacactttaaacaagccacactcactagagatgcatgagttcccaaacattactagtacattctacattcaagcaaaggcaggaaaacagaagagcctagacaaccttagatgaaagttgatattattttttttcacaaaatgaaaatgggctgatctggcatttttcttttaaagagttacatcagattcatgtgctggaggttagttgccttcttaatttttcattattacacagaaaagatggccacaggctttatataaatgcatcatgcagttataaagatgtaaccatggttgcatgagaaaatatgtgtgttgctacagaagtgccagaatgacttacagcaaggtattgaaatagaccatttagttcttggggtttcaaataaactccacctgttatatatgaagcctgcaaatgaaaggccagtatatgatcagcattcagcaaggaatagacagctctatgggggcatacatgtaaaagaagttataaatggaaagaaagaccaagaaggcactgaagaacattacctgttgcaagaaagcagagtcttgggttcctactatgcatgaatcgattgggacctaaatttttttgatagaaaaaaaaaataaggaccaaagttgttagtgaatgttttaagcaatgaaactggtgatgtatatagtcatatagacatgtctagaggtagtgctacttgcagttgggactcactaaaaccactacagttgtgaaatggtgaggtgacatcaagagtatcaataaaatgaattgaacaatgaacccaaatgtacggaatagtgacagttcatgcaataccatggaacgttgagcagaaaatattgagttcatgaccgctacatatctgcgcagcatctcattgagttaaaacatgttccagaaaatatatactacacaatcaaatcgatgaatgtgcgtactgttcaggtccatctggagaaccctgcaggcataaaatctgtatttcgtgttagcataatacatgatgccactagaataagttgtgaggatattgagtagaaaaattcaagaaaacaaagaaaattaaataattatatcattagtgatgggtcagatgcctatcaggtttttttagtccatacagcatgcgcattgtaaacatttatgctaactgatatgctcccttctatgttgttctcataggtcaacatatcaacaggaatcagaacaaaaggtaacttagaacacacacagagtgtatactcacccgaggttgtggatgtcgagtaccagaccgaaaaaccctctgtatatctaagcatcctccatgttaagaaatacaagcacaaatggaaaatgcactaacaataagaaatcagtaccagtcataggatacagcacagagcaagggacagtgcgcctgagagaagagaggctgcattgccatcagcaacggaaccattgctgctagtggcacgggcgtcttctgcaatgaactcatccatcttgcggctcgcctttgcgaaggtggccgcgacgtctgcagcaccagaggcactagcatcgctcgagtcgaagatgtaggtgcaagagctaagccccgcggcgatgacgaccacatggttgaggtggttcagaagcaagagcgagttcacgtagtggatcagctacatacaccccggaattgcatcagtattaagtgtaaatcctctcctctctggagaattcagagtcaaaatcaaactaactagatcagcgagcaactagagattgatcctctctggaggagtcagaataaaatcaaactagctagatcagcgtgaatgcaactagatactgatcgtgtttccgtggttaatccccatgatatagatgtgaatcaaaaactagaaatcgagaggggaagcgggggacgagaagggaaatagggtttgggaggtcgcggcgtacatgggcgaagaagtcggcgaaggggagggcggcggtggcccagaacaaggggttggtgtcgacgacgacgacggcgaggctgacgtcatctgcgcaggcgcggtggagacgaggcaagagaaaaggggggaagattagcgagacgcaaagggatcagaaaacggagacggtcgggcgccgcttaccggagtagagcttggaggaggccatggcagtctcaccgccgtcgcggcagggccggacacgcgcgaacggaggcgctggttgggccgaggcggcggcggcgcgagcggttgccttgccgccgtcgggaggcggaggcggaggcggcgaactcggcggagttgcggctgcgcttgggggcggcaagagacgacgaattttttttatttataatttttttattaaaagttttacaaaaataattttccattttgaaaattgacggaagtagtcgcctaccgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccgccctccgctagggcgattttgtactgtggggggggggcgcctgcaaatgggcggcgagggggcatggaattttgcaggcggcccccttgccgccctgggggagggcgatttttgcctccccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacatagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcatggtaaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtatgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgagggtatgttgcgggctattgactacttgcagaacggttgggatgagaagggacttccagctaagtggcctgatgttcagagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcaaggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaactattcggtgttgtattataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtatgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgaccggatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctagggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcattataagtttatcagtcgtcttctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcattgcccacagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaattttttatttccatcttgcataggctgatgccgcacgggatatcagtgccgatatcaccgcagtccaagtgaggttgaacagaggtttgcagttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccagaggtttcttaagttttgtttctgtttttctacgaaaacatcaccccgtcgtaacttgatgttccatcctcgcaggacctcgtttgccttcgagcgcccctagcttcggagcagtgcgacctacagcaccggtttcgcacggtacagttcagcccagatattagttcatttttgtttcagcttttgcacgaatatgtcaccatgttttaactgcacgtttcctcatcacaggacctcgtctgctttcgagcgcgttcgcaggcacgaccggcgcttccgcgagctccgcaggggcgttcgccacctcttcgggcgcgttcgccagctcttcctctcacggagcgtcgatccctcgcccacacggtactttactttttgttactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcaggcagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactacagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaaatgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaattccatgccccccctcgccgcccatttgcaggcggccccccgcacagtataaaatcgccctagcggagggcggcaagggggccgcctgcaaatttcgttgacggccgtcgcccgagagcgaacggccggctgccacgtcattttcgccgccctctgggagggcgatttttaaaaatcgccctcccagagggcggtaggcgactacttccgtcaattttcaaaatggaaaattatttttgtaaaacttttaataaaaaaaattataaataaaaaaaattcgagagacgacggggcggaggtggcgtcggcccacggcagaaaagtcggcccttccgtgctgggttccccctctgttgttccctgccgaaaaaagtccacttaaggtccctctcaactataggtttgctttattcgcttccttaatcgagggtccctcaactattaaaactagtgcaaatctgagtttcttggtgatttagagagcggtttacagtgctgcccctgccgacctccgtaacgcctagcctctcatccacggtcatcgcatctttgtcttgtctcgtctcatcagatactattgtcgtcacaatattatagatgcaaccggagcggtagctagattttcctggcccgatgtcggtagctccccataggcaacaattggtggtggcactccatcgcactagtcctccccacttgtgttgtcctagagtcatactagcggttgggggcagtaaactctcatgccgtatgtgttgatgtccctatggtggttcttatgaagggtccctcattctcatcatacttcatgccgtgttctcgtcggtgacaatgactttgtcataaaaaagggagtgtgaagagaagagaaagtataaggctcatttcatagggttggagcagcgaaaaaaaaaccatattgaaagttgtgtttgaaatctagcacatgtcaagcctgagtataagagcaagtttaatattatagctaacaactaagtccaatctatctatagctaatctaatagctcattcatacaatagttacatactacattattaatacctgttcccacctatcatatatacaatgcgtcttggagtccgtgctacaactggcgacaaatctatagcccgctgctttactctctccttatttatcttcttataatatgtttacagctggcttatagcctgctattgtatctgctctaagagacgttagtatcgagccttttctgtcactgaaaaagagatgagtgttcacgtaattaattaagtattaactattttaaattttaaataattttaaaaaatattgtttttcaaaaaactttttttataaaagcccttttaaaacacaaacggcttgtttcaagaaaaacaatataacctctctttaaacttagagttagacttatgtgggcaaatatttttttcatcctaaaatataacaattttagtgtttaatttttttttcaaatatagcaacttctttatcaaaactttcttttcaactaatcatcataactttccaccattcaattttcttagctatctccacttctcaaccaatcacaactttacctgtttaattttacttacttttaaaaataattttataaaaccacacctattattatcataaaattttcttttattttaatattcgtgtgcaaccctaaaaatcatattagttctcttgccacacaaagccacgccaccgccgagagaaggaaaccggaggcgacgagagggatggcttccacgctgcggcgcgcggccgtcctccgccgtgccgtctccttcgcagcgccgtctcccgccgtccgccgcgccgcccggctcccgatcgcgccgcgccgccccttctcgcagccgtctgcagcgtcaggtgatcagcctcccaagtctgcactcgacaaggtaaaaacttaattccccctgcttcccttgttctcctcgatgttttcttcgatcgtctcaggctttcccactggcgtagcctccgcgtcagcgtggttcagatcagatggaccacacgccggagcaatcaacgcaagggatgaaacattaatttttttttagagagagagagagtgtgtgaaatatttgttagggctgggagtggattctttttgatccaaattcggtacaactagttgtgatatctatcggtccactgaaatcaagttcaaatatacatcgagaaaaaaaaaacaaatttagatgtgaatggtatatgctactgcttatacaccgattttttttatatcccggacgtgtgagttgaatttagatctaaaattttgtaaagttgtgtacatacatcacctcgagcaatctaaatagtttctcatacttgatggaccaaatatctgaattgtgtgggtagatctggcactatttccatttattaaaaatacagcggtagaatttagctgtttaggaaattttaacgaggcaatggagccatcaagtagaaattggttttcattattcacaaaaaaaagttgttccatgcaaaccagaatgtaatgagtagcatcagtcaagacataagccaaaagcttttcagctgtctcctgcattattttttgcacattgcttcagcagccattccatcccatctcgttgcaacttgaaagcctgcttaacccttgtttgtttggacctaagtttcaacttaaaagtaaaagagccaaatccaaaacagattgaggcctccatcgactgactcctccgctaggccaccgccatatctttaccattttttgccgggtcggcaaaaaacgctgaccgtaatatattaagaaattggagaatgtacatcaaattcgcaaacctatctttaccattttccaccggtatgattctaacatcaaggttgccgacactgctctgaatttagtgctcaattgtagctcttgggtcagatctgattttgctgctgatattgataaaagtatgattaagagcctaaatgaactagcagttcgtagtaatataaattagtatgaatgcagcctagcagggtagttgtagaatgcagcagtgaaattgtgttttcatgtggtgtttcagtaatgtggaggaacggtatggtgaatgaataacaataataatattgttgcatgcacattttactttcatctcaattgatttccaagtgctgttgcgttctatgtctgtacattttcgatgatgtgatagtttacagagacaaaagtttcaaaacaccgagtgcaatccattttctattgttaaagaaaattcttatcattagtcatcatcgttaagtatgaacttctaaatgagactatggaagaaaatgagctcataaacaagtccttgcatgcaagggtattttagcatttttcaataatatcacagccatccagaaagggcaggttgccaagcagtacgattattgaaattgttgaaccagtaaaaccctctttccgtcgatagcctagaatagtcagtcgtctctctcaacaaaaggcaatactgtatcattattactatttttctctgttatcctgatatctggtactccctccgtcccacaatataagggattttaagtttttgtttgtaacgtttgaccgctcttcttattcaatttttttttgcaaatataaaaaacgaaaagttatgcttaaagtactgtggataataaagtaagtcacaaataaaataaataataattttaaaattttttgaataagacgagtagtcaaacgttacaagtaaaaactcaaaatcccttatattatgggacggagggagtattttagaccatacaatagttctaaaatcatataatgtatgtacgtctgccagacttgtcctgtatccaacaatgacataaatggatgtgagaacaggcaggtgttaaattagcttagctaaatctgttttcttttttatttattaaacaagtttggatggctgcatcatatggtgccttttgcatgcatgatggaattagtgcatattgtgttgttaggtgctactgccatactttctgttttcttcttgtttcatgcacattataatcttttgcactgtatcaactatgtataataaatggatacttcaaaagaaaggcctgtaggccacttaagaacccacttgacacagtacttaaaaaccttttgtttcaagaatatagccaatgacatctactactgattgattggaagtagtgagctttcatcgatcatgcttcatgtgtggctattgatcaaattgctttttttgttctatagttgaatccattatttgaggaggtcatgagaaaaggagtttgttcgatggatcaatatatgacactttgttcgatggatcaatatatgacactggaaatcgtcaaaaggtgtaacatactacctccatattttaatgtatgacgccgttgacttttcgtctaacgtttgaccattcgtcttatttaaaaaatttatataattattatttattttattgtgacttgattcatcatcaaatattctttaagaatgacataaatattttcatattttcacagaaaatttaaataaaacgaatggtcgaacattggttaaaaagtcaacggcgtcatacattaaaatgcggagggagtagttctttgtcatttgtcctcttccctttttgcaaacatatatatactaatattttctctttttagcatccaacatgctcgtatagagttcaatcgaaaggaaaatgactgaccaggatgggaaggctggaagcctggaacgcaagagattatgacagtgtagtagtctacatctgtgaattaaattactgagacactagcttttgaatcatgctgtagtatgttactagttaagttcatttctcattatcaaccgtgtccagtataaacttaactgccaatgctgctcgatggaggtctttataacatatgatatgtcacttctgctggacgaactatgtatgaaatagatggtagagctaacaagtgtgactgggtgtattttggacctttcacactatttccatgtcatattcaaccaaaaatgaatttcttaataggtgtggtgtgtagcaccaaatatccataatttgagagtgtctcttaaaaattgaccttttttttctgtattgaattgactagtgctacctatgagcttgtatatcttcttgtatatcttctgttctgaaaaaatcaacttatgcgtacaaacctggatatatgccttttcagattcgtccaaaaaaaaattttagactatggaagttgttttcttttgggacaagggagtacatagcaaggggatgatatgtgtactctttttttttcatcattcttgacaactttaatcattaaattaaatagttttaaatgactacttcctccgtattactctccccgttttatattataagactttctaacattgcccacatttatatttatgttaatgaatctaaacataacatatatatgaatgtgggcaatgctagaaagtcttataatatgaaacaggggaagtatactataagtcattttgacctctttttttcaaatttatttaggtttgactaactttatagaaaaattaattagcaacatctacaaaatcaaattagtttcaacatatacattgtatatttatataatatgtttgtttcataatgaaaatattgctatatttttttatataaacttggtgaagtgtgattagaaaaagtcaaaagtaacttatgaaatggagggagtagtttataaatgatttagtttaagtgtacacgtgatgttttaaagacttgctgtgttcggaactccaagttaccaactcctctccctcgttttccgcgcgcacgcttttcaaactgctaaacggtatattttttttaaaaaagtttctatacgagagttgcttaaaaaattctaattaatccatttttgattaaaataatagctaatacttaattaataacgcgctaatggaccacttcattttttttgtgtgtggggagatgggttcccaaccccagtaaccgatcacatcctaatattgctcaaagttactactactactactaaaaagtagaggaaatatttgtaaaaaaaaaaaggttttactatactacttgtgatagtttttaggcctaaaaatttttaaattatggaccgttagatcacatcaagattcgtgaagattagatgataaaaatttacgcaaagagcgtgggagcaaggagtcaaacctacgaccttccgtttacgaccgaacagagctaaccgactggtttagttagaatgagcgtaactcataactacactataattcaagatataaaaatttatatatgttttttaataattatatatgtgttatattatagtgatagtgaaattatattataatatatattatagttggataggttgtatttagatgcaggtgtgaaaagttttgacgtgccacatcggatatacggtcacacatttaaagtattaaacgtagactaacaacgaaacaaattaccgcctgtaaaactgcgagacaaatttattaggtacaattttgtttttgcacccactttcatctccaatatgatcttacccctactttttggggttttcatttttgcccccactttttttaactggaagaggcgtttacccctactttggatggaagttagtgggactaggtatatggcagtaaaaaatagagaaataaatgaaataattttttttgaatttgtgttttacttttttacccctagcactagtctagcactagtctaacagagaatcgattctttcccacaatctcgctgcttctctcgattctacaggcggcaacagcagctagggcgcagctcctcccgtcggcggcggcgagtggcggccaggtggtggcggctagggcgcagctcctcccgtcggcggcggcgatgggggcacgggagaaacgaagctcccctggtagacatggtgcgtcgcgaggagacgtcgtcaccgtcgtcgtcgccgctgagctccctaccggcggccaccacctcgcccctcttgaggttgtaaatcccgtaccaatgggagagggtataaatgtcctatttaacaccgttaactccattatccaaaacatgggcaaaagcctcttccggttaaaaaaaaagtgggggtaaaaatgaaaaccctaaaaagtaagagcaaaatcaatattggagttgatagtgggtgcaaaaacaaaattgtcccaatttattaagcctaaataatctatcactagcaaatatttactatagcaccacattatcaaatcatagaacaattatacttaaaagatttgtctcgcaatttacatgcagtctgtgtaattagtttttttatcaatatttaatactctatgatatgatagagtaaaaatgttttttttccttgggagctaaacatggccttagatttgaaagtttcttttcttaaaagaaaaaagcctcttggcctcttgggcgacagtggaggaggcgaagctccggcggccgaggtgctccggcgacggcgagttccagttccaggtgatggtctctccccaatccccatgttctcggttgatttccggctcttcgtcctcatcctccctcactcacatggctaccttgtgctattagggtttcgtagcaagcaaaatcaggagggccatgtcgtcgtcgtctctgctgcgctcgtcgggcgccgtcgtccgtcgcgctctctccgctgcctcctcctcctcgggacatcaacacgggcgcccttccttccgccgtgccatctcagcggcagccaccgcgtccgcccgccgcggccttgcgccgcccccaaccctgccgtgccgcaacctcacagcgtattcttcctgtgcgacacatagcagtaataaaaaggtgatgccttccatccaccacagtttctatttatttttttcccccggggtaaggttctagttcaagttgtcactgaatttctgcgtgaaggttgacaggattttgatcagatcgacagggaggggattattatatatactctagaaatttaagggttttttttttgtgtgtgtatttatgtttgctctagaacttatagcatcgacatatatcaggaatcagactgactcgatcgctcgccaaaataaattgagtttttagtttggtgtgatgtcgggtcccaaccaaacatgaaccgcggtctgttgttctacacgtatcgatgcatgtaggcctaacttaggagaagaattgattaaataataagtgtaaaaagtgaacatttgtcaatgactaattaagtattacattacatattataaagtttgaaaaatgaatttaccaaattatttcaacaaatgcggatgaagaaagttttttggttgcaaaaaaacattgtttaataacttgggaagcgtgctcgtgcaaatcgagggagttagtggcggagctagaacttttccaaatctagggctaaattagttgaatttatataattttaccggggctgtctacagttcgggcgcccgacgatttggagaaaaaacgggcgctgacgtcaacgcccgatttacgtgcaaaaactatttaaactgatttttctcttaaattacttatccaaatcatgatccgattgcaccattaaattcgttgcaattaaatcttcaaaacaagaccacacatggatatatttcgatgacaatttttttagcttattattgaattatttttaaatgttgcacgatgttcccccaggtatatcggaattgtttcactaagtagatcaaaaatgtttcactcatttaaattgggtgttgtttcacctcatataaaaacaatgtttcagccaatagcgaaagattgtttcagttcactgcaacatttgatccatacatagtgaaacattataagtgcactaggtgaaacattttttggtggaacaaaaaaataaaacgaattcccttaatagagggtttccaaaatatgtgggttttttgtcgcaatggaatatttcggttcactgcaacattagatctatatatagtgaaacattgtgagtatactaggtgaaacatttttggtgaaacaaaaaataaaccaaattcccttaatagagggtttttaaaatatgtggttgatttgttacaggtgggggcaggtattgtggtggggtcagtgacatcaccgtgcgcgcgggggcggggggagcgaccgatttttcctctcccagcccggtcacccgacggccatcatttcccaattttaccttttgtcttctaggttttgaagttttaaaataaaattttaatgaatatttaggagcaggagtagctgcagccctagctgccctactcccgtctgccaaccatccaagtcaaatggggctttgctcgtcctcatgttatgggataagatgacaatttcagtagttgctacttgctcatgtctagatacaggacatttggttaattggttaccttgctagtcctttttcttttgtttgctttaagggatatatagtttgcatctaggactagtcgttcataaacattgtcagcagagagatatttctcacagtaacaggaggtcaggtcgtggagaagttacaatagagatgatgtgttccaagttgtgaaccttgccattctggcatgacgtcacaacagagatcatgtgcccattttatttcagaaacatgtttacttcttctatttaacatgcagggtatgcctaattgtctagtttgatagtaatgctgttgctttcatgaatcctccaccagagtataacggttcaattcccagagccatatttataaataattaaatttcgtttatagaaggcagattgcagttgatgactgtgaattctcaaccattgttgtttgttgtgaaggacgacaagactgatctgaagctaaaaaaacaccttcaagaactggagcaaatgcttgaccaaattgtcagtgaacatgtgaagctgcacagattagtgcacagctctgaccgtggctattttgagaggtattttattcgctcatcaagaatgcatatatacctacactgcttattcattcataacaagtatgtgcatatctgtgcaggcttttgagcgaacatgggtggcccaaatgcaaacctcgtgatgtttttgtttggagatgtaggcttacaactatttttgttgcatctgtcatgatcggttacatgttgcctgaaataggatatccgtcgtaaaatgctgtgaaggaacaccctacatagttgtttgcagtcgtgcagatgtacaggcgatggacacttctcgctatctacagtagtacctaagacatgtaaatgtgatgcacttttcaaatctttctactccctccgtcttattttaaatgcaacaataagtttctacatttaactttgatcgttcgtcttatttgaatttattttataattagtaagttgtgctataaacacctccgaaaaataagcaagttgtgctactcacattatggaagaacttggttgctatatacttctcatctcaaactataaacatttttttatttgtatacaagagataaattttgagatgaaaatactatagtacccctcaaaaaataaataagggatatgtattcgaacaagattcgaacgagatgtttgatgggacaagtagtattgtaaatactgctataaatcatcctattttgaagcaaagattaaactattaaagttcttatattttatttaaaacagaggaagaggaagtatttttaccctatctaaccaaacaaacaagtagcccaacctaacatgtaacagcccacgacgatgcaatccattaggtagggtaaccctacaatatatgctatcttgacttttggacgagattcatcttattcacatattctttaaacgaaaaatatataagccaggcttaaaaaacatttagtgatcagtcaattcacaataaatatataataaatatataatgttttaaataaaatgaatagttaaacatgttaaataaaaaaaacaaccaacgatgttaaaacggaaggggtaccttgctgcctcccgggtgcgatagtccagccgcatcggcatctacaaacgcggcggtcgaggcgaagaagctcctggcgacgaccttgctccggtgagttcccggtgacatatgtattcgatcgatttcccgttcttcttcccccatgcatcctcctccttcacatgacggccacatcctgctgctgttaggacgaaggatcggagatgccgtctctgctgcgcctgcgcccgtcggctgttcttcgcactctttccgcgcccccgtattcttcctctgcgacacatagcagtaaaaaggtgaagcctttccatgcatccactcgctcctaatttccagttaaaattgtcgccacctaatttatgcgtgaaggaaaggctggctggattttgatcagatggagaggaaagcctctagcataaacttattttttgatgcatcttttttttttgacgcgattattgatgcatctttacattgttaatttgttattagtaatgtatactccctccatactcataaaggaagttgtttagaataatgtttaagtcaaaccttggaaatataaatcatgaataactctcaagttgttaagtttgaaaatataaaaattatatgaatagatttgttttgaaaaatactttcataaaagtatacatatatcacttttcaataaatatttatagaaaaaagaagttaaagttgtgttttggagaccgtatcgctgtcctaaacaactttctttacatatttgtttcagccgggaaggtacttgctttattttgatgttttgtcttggtaactgagattcagttcttcttacaagtgttaattaaggctattttggtaatctggaatcaagattgaagtgattgaatagagttcagttttcctggatgaaattattacagtgtaggcctatgtaacacgtcaacaaaacttagtgcagcaggatattgaggcatagctgggatatttttttgactcaaataactgggatatctcgacactggagaatttattgggtacatgaattcttacttacgagttaggaacgaccagtcctgacgtaccttttgtcatcgaaaaggaaaaaaaatatttgctcaaataattctgctctagtctaaccatctctcccctagccctccgatggcagtcactccattgagtattatggtccataactggaacatagtagtggttacctgacatcctgataaggaacatggccagccagtttgggtagatcaaatattcaaatgcaagcgtacaattttggctgtgtttagttcacgccaaaattggaagtttgggctgtgtttagttcacactgaagtttggaagtttggttgaaattgatacgatgtgatagaaaagttgtgtgtgtatgaaaggtttgatgtgatggaaaattggaagtttggaaaaaaaactttagaactaaacagggccttgattgaaattggaatgatgtgacggaaaagttggaagtttgtacgtgtaggaaagttttgatgtgatagaaaagttgaaagttcaaagaaaaagttaggaactaaaccaggcctttgtgaaccttttctaagtacaaggaattccatgtttaaattaagggaaaatgcatgttttacaaggaattctctttggctattttggcggtccttttgttcagtgacacagttatttctcttgcttgtagttcattaccccatgatttccactttttctatattaggtaaatggtgatgaaagattctatgagaagaagcaacaaatggatccatattgaaattatactacacttgctctattgtttttgctaccattacttaacatgtcttgttaagcctgaatcccctactggtctgatctgaaggctcctgttgagcggagcgtctctgacatgttcgcagcatccaccttctctatccttggagatggtcagtccacgctcttctggactgatcggtggatcgatggtcgctcgatagcttctatagctcctgacctcctccacgccgtgcctccacgcttccagggatcgcgcacagttgctgctgggttagtgaacaactgctgggttggtgacatacgtggcgccctcactgtcccggtcatctctcagttcttgttagtctggaacgcggtgcttcctacccagctctcgctgggtgttgaggatcacctcgtctggcgttggacgggtgaccagtgctactcagcgcgatcggcgtatcaggcgttcttccttggccagcactcttttgcctgtgccgacttactctggcacgcgaagggccctgctaaatgcaagttcttcctttggtttgcatttcagaagcgttgctggactgccgatcttctccaaaagcgtggtatcgatagccactctgcttgccccttttgtgctcaggagcttgagaccgcgaaccacatcctcatcgattgcgtgttcgctcggcaggtctggctccgtgtgttgtcccctcctggctgggctgccctctctccccctcgtggcagctggctccaggattggtggtcatcctccagggtatgtttacctgagcacctccgcagcggcttcgactccttggtactcctagtctcctggcagctgtggaaggatcgaaactccagggttttcgactctgcgctcgcttcggtcgcagtggttctgaagtccatccgctcggagggccagctgtggtctttagccggtgttactttttttggggatttcttgggagtgtagcgtggctctgccccctcccgctgtttggagttgcgtttttaactgttgtagtagttcctagcttcaagtccccccctttaggcataagccagactagctaattgctttgtgtaacaaaaactcttttcctgctaatatattgacgtgcaatcattttgcgcgttcgaaaaaaaaagaatcccctagttggtgttgaacatttcagctgaatatcatgaatgaaaattatttaactagtaactattgtggtgttatgcaggtgaatgagccacttgatatgaagaatatagaccttgcgttggacaaagtatttattatatgtgggggcattagaatgtaagaattcatccctaatccatttatatgcactcttaacaacatcatcaacaaatccttatacattcttctaatactattgaatgtatagtcttgctgcagagagcaagccacggagtctgtctgcccagtgggcattgggtgttagtcatattcttgttgttggggcgattgcaaaggctttgaacattggagatcgagactcagccatttgataatataataggtattgttattattcctctctttcacattatactacactttgggttttcaatagattcatgtatatgtccaaattcatataaatattagtgaatgtagataagggatggataggctaaaatgtcttataatgtggaacggagggagtacttgattgtcttttaaatataatcttttaggactagcttatatactaaaatttttccgcatcatataagaaatattatggcacacataataacattgatcgatggccttaatttgtttacccatgcagacaatagctgacctgtcagagggtggaaatgcttcggtgagcagacgtggcgcactactaatatgatggatttacagcaatgactgaaacttttttgctttgcttgtgtttggagaataaaatcttacctttggactttggtcatgtggtgtcctcttagaaagtataaggggtgagctgggacaaagggagaaggggttaggaggtcttgggttaccaaggagaaacttcaacacatttacttaagttcttatgaaatccagaagagaaaggaagagtattctgagtagtggtaaacttaagatccttcaagccaggagtacgatattacacctctgggtagcccgaacctttacaattctttgtgttcatctattattgcgctccaatggggctcaaactcctcactcatatgcgactagctccccaactgaactgaccgaaagggtcccattggatccccaccatcgaggtccataccctaacaatatttgtctcaaagtttatgacataataactcgcactatagtatgtagacaatgtacatgacctaatggcaccacatgcgatcggacgaagcagtgacgatgttcgcatgcctagctgcgtccattcctcttattcttccttggtttagggcttcaggccgagcaggcagaggaagagcgagcacatgacatcggcgtccagtggcataacgacaatgatggtggcgcctcgacgcattcccgaacacgatacgatggaggaaggtggcagccagcatgaggattgagggaagagttgggaacgccgacggcaagaactcagttcgataggaaagagaaaactccggagtggcttgatttgaggtaggagagaagggggaaatggggcaaaatgaactcgccggagtggggagatgctggtggcgagatacgctctaggggaggaggatatggtttcggcagtgccgcgatgacggcggcggcgacgtgcacatgacgcgccctccagaagtaaggaggcggttggctcggctaggcctcggcttagttgggccacggcctgactaggccatgtgagggagagaaggccggaacggcccacacagcaaggggatggaatcaacgcaggagggaaatgaccggttggaaagatttcggttcaaaagaaatagaagattttttaggggattattttaatagaatctaaaagagatgtagttaaaacaaagggagatgtaattcaaaagaatttgtttgttgactatttgggaattggagataaattttaacaagtagttcatggactctatgcatgtgggggtttttggtttatttttgaaaatggatgtttaaagggatttttattttggggtattggtttaaaggaggagtatttgaataaagtaacgtgtagtcaatggactctatgcatgtgcggtttttggtttatttttggaatggaagtttaaagggacttttattttggggtattggttcaaaggaggagtatttgaataaagggatagatatttgaatttgcaggagagagagtgtttggtaggaaaactttagaatatcattggaggtgaaaattatggaatttagatgaaaaagggtgatggctaaaagaataggttttagctaataaaaataataaatagggatgtttataaaattggggagagacttgaacacaagtatacagagatgtctggctttagaatatttatgagaatgggacttggtgagtttggaagaaagaatggttaaggaatgaatggtatatcgagaaaatttttatatgtggcatatggaattggagcttcttcagaagtaaaccaaaaaggatttgaattgatggatttacgaagactcggtcaataatttgttggtggagttttacgcggaaatctataggattccgaggaatttgggtaatgggaatttaaaaggaaatatatgcgctaataaaatagggtttcggtaaaaaaataaattgaaaggtttataaaactaaaaagaaattaaacggggtaaattaccaaatcctcgactattaaattatttatttagtttagacgaggcatcttttctagtatcgcaaatatatatacagattctttttggtgaggaataggtatatcaaatttacagggtaagatatatatagattatttcacatgtgatgtaaagccacaaaaatatagatataacaacaatgaaaaagggatttatgggccaggccgaatcacggcaaacattttggcccaatagtatagctggaagccatatggctgcgaggtgaggtagcgaagctcgattgcgactttgcgaggtctaccatggcggcgatgcgtcgtttggctgttgcttccctgacgccgccgcggatccctcgtcttctccgtctccgacgccccgatcgaacgccctctgctttctcgacgtggactcctcatcgtcgtcctcgtccccacgccgccgatcccacgcccatctatctgccggtgcatcgatccgtcccctcgtgaatgcctgccatgacgacgatgccatgacgacgatgcgaaccctttatattattattattttttagagaaggatatttttttttatccggcctttacatccaattggatatatacgtatgttaaaatagggaacttagtctcgtaaacaacccaatctaaaattcgttcatatagagatttgaactcagaatcttagaatactactcagtcgtcgacgaacccttaattattggttgaggattttaattttatcgcaggcaattgaaaagattgagaagatgaagacggtttcttctctgaccaaggatgccttgaaggttcttcaagacgctggggacaaggccaagacgcatctcaggatcatgcacaaccagtacattgaggagtacgtactaactgtttctactttatccattacatcttgaaaaaaaacaatctgttttactccagcaatcagtactgaccgtccgcatcaatatatcaataactttgagttatcgtgaaagtactctccgtttttaatagatgacgttatttttttatcacacgtttaatcattcgtttattaaaatatacttcctccatttacttttaatagtcatatttcatcttagcacacagactaaggataagtaaatcaacttatcatccatattaaacatgatactagtcatttctcgtaaacaatcgatttattaatatttacatttatcgatgcccatgtagccaatcttatgtggaagaatggagagtcacacattaaatccgagaaagtcattaagatgataagattgttggattgaaatatgcctatcaaaaataaatttttcagatttagaaatatgactatgaaaaatagatggagggagtatatataattataatttattttattgtgagctgttttatcacttaaaatacttttaagcatgatttgtttcttatatatttgcataatttttaaataagattaatggtcaaatatatgtttaaaagtcaatagtgtcatctataaaaaaacggagggagtaagtttattattaaaattacagagttaaaaaagcacaatactgcaaatgtcatggaacatttgacagtacccaaaaaaaacaataattctgtgagacataagggaggagtgtaaacatggtaactgttaccgaaagctactctgtgaaaactagcgaagataacataatgtcacctttttatgtcttatagtacgaatttagttgctagaacaacagtaggaaatttgtttcagagttcttgtgtagggttaaaactctcagtgggcaatggtatgttacgtaattgttggaaatactgaatgcttatatactgcttacttttaagcatctgcatgagcagattgaaacaattatgatttgtagcatttgcaggttttgaccattttttttcttgccataatttacataaatacgtttttagctatttaaacaatttgggatgtaattctcattctctagccgataaaataatttgagatgttgccttgcagggttccaataatggaaggacttatgcaaaatggctggctacattttgtgtgttacattgttcctgtttctctgccttcttttgttctggttgtcggtactagagttgtcaacataatcaacgaacgttctcattctcatttggaggaaggcataaagattccatttcaggacttggaaaacaagtaactatatatatcttggtgtgttttgtacttctgtatactgataagaatgatctgttagtattaaaaagaactttttgaatgcattctcatatgtgttgttggcgtgtatgcaacctatattagttatgcatggcagacccatatgtttatttacgttttcttaattaggtgtggcatttagttttattgataattgttcgacaaattaaacttaaaaactggtatcgtagttttttttttgaacttttgcaatcatatatactcattttgggtgtgaagaagtaacaagtcgttaccacttttgcacccttcctttagcagcttcctgttaatgtcagaagcttcctgttattgtcagaaaagcagtgatcctatcttgcagccaaaaactccaactagcatagcagctttctcctcctcgaaatatataagtgataattctcctcctcataatttgtaagtgataattctccttctcatgtgttgtagcattttgatatctgcaataataaagccttgagggtaaaaagttcccttccaattgccttcacatcatctgcaaatgcccatgatataagcttcattaatgatagcttgcaatagcgcagcacccaggaaaaagagcaaaggtgccaaatgatcaccttgcccaactcctcttttacaatgaaaattcttgcctaggatgctatattcatcaagactgaggagtaggtgacgagaaaaccattttaatccaaacatcattaaaccccacggcttgcgttagttggagaatggtttcatgttcaattgtattagagatataaatagttgtacaaatatctactcccgtgacctataagttgcaacgggtgatttataaatagttatacaaatatctactcccgtgacctgtaagttgcaacgggtgatttataaatagttatacaaatatctactcccgtgacctgtaagttgcaacgggtgatttaggatataaaagcaaaactaaactttctagcatggctagttgattaaagcatataattacatctgcaatactttgtgttagaattaatatccacagaatattctcatttcattataggatttttatcaagataattatcagcgacccaagaaacaggatctcctaggcagtcggtgcgcaccatgaaggtgccacatgtcactttatctagctcatgatccccattcaggatcacaattggagtggcatatgacccatgtcggagcaagagggacgcaccccgagggatgaatccttgggtccataaccttgccccatttatatttgagaggacgattatctaccgaggggaagcatggaagacagtgtggcaactacaacacctcttcatggattgcataattttgtggcaaatctaggaaggtttgctcacctggctgaattgtgatcaagcatggatgtcataaaatcctgacaaatcacttgattggtgggaagcaacacggggagaaaagcaaaggacaaatgcaatatgatcatgccttatgcttattgcgtgggaggtttggtgctggaggaatagaagagtcttcagaaattaggagttgcttgtgcgcctctcatgaaagagactttgcaatcgataacaacaaattatcataggaaaaaatttcaccctaaaacaaaacatatttatataaaaaactttaacaacaagtgctcactcggaacatagcatttttacatttcacaagatataacttttgcattaaagtctctataataaagaaggcttaaaaacaactataaaaaaatctacaaaaaaactttaatactaatactttctattgtaaataatattctatcaattggctataacaaatcatcttcctcaactgcgcgtgacaataacatttgtccctcgtcactccttcgtgctgacataggtgacttgaggaagctcggcgtgcttggcctcgacgacaccgatgccgacgccttcttgccgcccgtactagtgccacccatagacaacgtcctcgttacattcttgatgttcttgggcggaggcctcaccaccggcgactcccctgtgccctgacccagcatccttctctgatcctgcaacaacaatgtaagtataccctttgcccccaaaatataatttgaaccgataagatagctatattttggacagagggagtaacaatctttgcactctactaaaatatgcatatgcaactagtagtaccctttgtctctttctctcctgctctttctccttccttgtattgttgtactcctccagcatgtccaggagaccatcctacatttggaccatctcctttgtcagtctggtcaaattcccatcaggtaaagaacgtccatgggagcaacattcacttacaccatcgtactcaaatttggcacccctctccttctcccaagcaattacctttgtgatcaaggcctctgccattgctgcaccctcatcaagttcaatgatcaatattctcaatttccattataagagacatgaaaaaaaaagaatagctaaagaacatgatcaatcacctggcattttgctgaccaaggcacgcgctttctcggcacgcttcagcacaagatgagtccctttgcccacattgtatctgttctcattctgaatatgcaaaccacatttgtaagttttagaggtgtagatgctgatatggcatcctttaagagcagagaaaaattcagaagtcacactctgttgtactcctcaagccaagattcctcttctagtgcagcctgccatttctccatcttctcaagaacatccttcctgctgaactcctcatctttggcctcagagatctgcacttccagccgctccaggattagagaccgtttggcatctgcaaaacagtgtcatacatactctgaagtctgaacaatacaataaataggttctacagaggcagtacagtcttgcatcgcatactactgataatgcttcaaatctttttgttttttcatgtgcttatgacttcagatgcatcactagaaacactgtgcatttgttaccactgcagctgcacagaaactagggctcccagccaattattaccactgtcgatggcgtcgaacatcatcatcgcatcgtcttcgttctcgacgggtacatgcgctcgccgtcgtatctcattgagctcatcatacttcttcagtacaaggtctttcatcctgcactccttgagcctctccagccttaccacctctgcttccacctgcatgatcacactctcagtatcaacagctcaaccaaattctcaccaccaatcatgacaatgacatgatctgatcagcaccaacattgttgatgaattccatggagagagcatcccgttcggtgatctcgtcctcggacgcggcgatgttgcacgccacgctctggaacctcttctgctcctccgatggcgtgtccatcaggttccacagatccagcatggtggccaagaggtcttgcagctggttaattacagcaagatgatgaattgatcattaattctccatgactaatcagttattggggatgtataattcaagccagcctcaccttctgcatcctgttccgtttgatctctctcaatctcccgatctcggaaactaatcttgcaattgcatcgtcgctgatgtctccttcatcatcatgatgaaggttggtctctctgaaatccatgccaagaaccaaggaggaggaatgcagagaacccatcagctctgtcatcttcctgacgcgactatcctgccaaaaacaagaatcatgccggtaaacttgactgaattttttttgtgttcatgctagaaactcaagacaagctgtgttctatgcaaccaaaaaaaatattgtctgaaccaaccttctccagctgcagatcttgcaggtatgctctgagctcctcaagccgtctgatggtgaggtcggagttgtccatggtgagatgaagctgcttgctcggcttcatctcctgctcgatcctgttgatgagctccgtcacctccgagaatttccgccgcctctcctccctcctcctcctcatctcctccagctccggcgtgatcgagccgagctcctccttgaggttccctgtgctctgatcaatttgcccccaaatcgatcagatcaagaagaagaagaagagatcgatggcgatgcacgggtacctgcagcgaggagcacgcaatgtgcacggtggtggatggctcgccgatggtggcgcagatggcggcgacctcggcgacggagtcggctatctcccgttgcagctgtgccctgtactgcttcacctgcgccaccttcaccctgtacacgttgaggcaatcctcctccagcgcgtgcagcatctctcgccgatcctcctccgcttccccgatctggtcccacatctcctgcaatgcaccaaacaaattaatcgacgattctcaagaaccgatcgcattcgccattgctgacgtcacggcgttggctttgcgtaccccaagctcctgcaggagcatctcgcggcgaggctccatctggaacgggaagaggatggctcgcagcttcagtgaaaccatcggtgtagagctccgccgtgccgcgtctgcctcatgcttaatctcctcctcctcctcccgcgacggcggcggcggcggcggcggcgattgagatcaagaacgcatcaagatcaacggaaagctcgagaaaccgacgaaatgcagctgtgctgcatgcacggatcatggccagaggagcgatgatggtgcgattgcagcatcgatcagggattgttcggggggagtttgcaaatgcggagaaaagcgcgggagaaagagaggtgagcaggaagaggagggcgcatgcatcggtttgagtggcctacaattagggagagccaacaatggcataaaaaaaagcaaaatgaaattaaagcttgtgcttgtgtttaggccccaaatttgaatgtggaatttggagaaatataaagtgcgagtctggtagaaaagtatatgaatataaacccggttcttgaagaaaacatacatgataaaattggagccttatcgtctacttgatagcttattgagccgcaaccaaaaagttaaatttcaaaatttatttttagagtttttctcattgtagcccattacccaacattgctttttaaaaatgtagataacaatcaaagttggatactgatgatcaaaatttagatagggaattatcctcgaaaccgttaagtgaaattgcatgcaacttttagagttgatccaatcaaaattaattctcatgaaactgaccgtcgactgccgtaacttttatacatacctttaactatccgtcttactaaaaaaaattgtgtaaaacataaaaaaagtcataattaatgtattattaataataagctaagccacaataaaataaatgataattatatgcatgctctttaataaaatgatgatcgaacgtatctttaaaatgacatcatatattaaagatcatagggagtactttgcagtgccatgcatccaccaacatctcatatcggtgtagttttcatgccattatatctcgttgaaagcgtcaagggtcttggcggcgatatgtatgacctgcactccatatatgaacacacatatatatccaaatatatgtctcctacaaattaagcttaattattattgctaatttttctccacgcggagttggactggagtcaccatctatcctgtagctaggcaagaacgtcgaggagagagagagagcgatggatcgatggagacggaagagatggccgagctgtgtgttagttcacgctaaaattagaagtttgattttcccgtaaaaaaattagaaatttgattgaaattggaatgatgtgataaaaaatgtgaaagtttatgcgtaggaaagttttgatatgatgaaaaagttagaagtttaaatgaaaaaattagtaactaaaccaggctttacacaccagcagcgacgtcaggatggattcagaagagatcgaatgcagttgcaggcttgcagcgattggaagcttcgcagctttgatccgtccagactgatttgaccgactcactgatgacttgaccccctcccctcaccgagtgagatctttgtgtgtttctgtacaactatacaaaactcatggtcaaataaacacacacgcgcattcaactatatacgtacgtactcaacacacgtacgggcgcataatttgttcatgatcatttcgttgtactgtttgacttatttgactcatttcacatagagctcacctttcttttactagacgatcttgtacacgcgcgtgcatctgaatcaagagaaaatctaagaaatatcattgacaagcgtttaattttaaaaaatatcaccgataagtgcgagttccataaatatcatcatacaagcgattttgtctcataaatgcaatcgtcattagggttccgttcgtcccgcgctgttaaatgcactgtgcatcctatagcacttaacgaagggttgctaacggaaccctaacggcgatagcatttttggaacaaagacgcttgtacaatggcatttcatgaaacctacacttgtcgatagcatttcatgaaattggacgcttatcgacggcgtttattggattttctcataaatgaatggcatgtgagctctacgagtactagctaaatgttcgtgcgctcatagaaaaaaactttgattttttttctcgagggtaggacttaactgctgaaggatacaaatttttcaagagaagctccagctataattttgtgttttttaatatactccctcagtttttttttcaatatgtaacactgttgatttttaatggacggttgaccattcgtcttatttatttttttatagaaataaaaatatatgtcatgtttaaagaacctttagtaataaatcaagtcataacaaaataaataataatttgataaattatttagataggataaatggtcaaatgtataaaaaaagcaacgatgtcatatattaaaaaaaccggtggttgtatttttttttaccacttgtggggtagttgcccccagtgtgcacctacatgaaatgttttgtcatcgtatagcagaggtcagaggatatgaggagttgttattttgttaataatgttgcgttgttatgttagacgtgtgggggtttgtttgtaaaggcctaaaggggaagggttttttttccccttgacctgaccttatatatgcaacttgtgaaaagaaattatgggaaaataattactatatagtagtagcttaaagcaaagagacgtacctcaactctttcaagtgcctctagcaaggaaagagctagtggataaaacaaagattatgcaatttagccacgaggatgaataggatagtgtgatgatgctttctttccagagaggactgcagtggaagcatggaaacaaaattaaaaacatgagaaagaaaggtgcacttaaacccttttgattttgtattgactcggtcaggtcagcattttaaagatcctgatgcatgactgatgaaagagttctatgcacttgatatcccacctagcccccactggtcacagcactggagaatttttcaacttaattactctctttttgcctggtatacatcaatcaatatatctgaatccggagtttcataggaattttcaacttatggcccattcatgaacctgagtttatgacaattatccaatattagaaagttgattagtgaattttaaaaggtttttaagaaatgatgatgtaaaccttttttttaaaaaaaatcataaccatttaggagtttggtaagcatgtctgtgataatctgatgatacctacatggttgtatgatgtatattggacaaccacaaaataaatctaagtacactacgatgtaaaaaaaatgtagatctttggtaccaaaagccaaaaatattcttcaaggtctgcctgatcattgatcggtgcattagcttaggtgtatttgagaggagtagaaaggagaagagtacaaaaatacgtaaaacgagatgaatcatcagcatatgattaattaaatattaattatttcaaactctaaaagtggattaatatgatctttaaaataatgtttatgtattttttttataaaatacacgttgtttagcagtttgaaaagcgtgcatatgaaaaacaaaacttttctactctatccactcatatcaaacgcagttaatatcttgaactacaagagactagttatccctgatgttcacacattttatactagtgattgtagtgtcggacgctatagaaaatgatgtctattttgaccaagactgcttccaattaggaatctaaattgtagtagcgtggaagcctgcaagtcaaaacaggccataaccacaaacgaaaagatgcttaatacgccgaagagagtatcttgacacgattgatagtgagttggaagaaatcaaactaattgttttaatatactcagcactcatgtttcttctataggcagcagtggagaattgaccaagattgatagttttgtcaaagctaataatatataaattctgtactagtgtttgtgtaatctatctccgaggaaatttggaactaagtggttgctggtagagaaccacgccggctatggatggtcctagctagtctaggaagacattggtgatataaatcattataagaattgttagtgtatatgcatcactaagcatatggtgaaatttttatctatcaaaattgatgatgttatatgtcaaatactttacaccattcgttctaaaataaataagggcttgttcgaaatgtgagatatataggaaaaatattgaaatacgaaaaacatagaataggattgcatgcgtaaaatataggaatttcttgttcttcgtacacgtgattcttactacaaagaggctagagtggattcttttttttttcatgtgaaaacatgggcagggaatagtgttcctctggaattcaaggtagtaaaccctttgaaacggatgcatctacagtacccaattcaaaggaataatcaatcctccatttttccttcacattttctccattctgacgaatgagccctaaactcattgctacgaaactgaatataatcttgtctagatctgttgctaagatttaattctttttggaacggatagaataattcattgtactagacaatgttcttttcgacttccaatagcttattggaaggagtcacttccttgtttaccgtgaacatacttcatagattattgaacggagtatttttaaaacttttcatatgtgatatttttttaaaaaaaatcaaataaatttatttttaaagtttgcgatggctaatattaaattaatacgatggttatttctcttgttttgcatgtggcttataaggttaaacgaacccctatatcaaatggggcctagtatagaattgtacattgaagagttcatcaagtgatctgtactatgtaataccttttacaatattattgctttcagtttttatatcattctaattgattctgatagtgcagcgcaaacatcaaaaataacactaaccatagaagctaaacttagctaagtagctaactaatacaataacaacccccttgatatagacacaagaccaaatcctaaaaaaaatattggtgccttagaaaccaaatactattactcaattatctcgatataattgaccacaccaagtaatttatattatatcaacataaatgacataacgtagtaatgtaaaacaccgtatgaaaacaacttcacgttgtaataatttattagtactagtatattgcatctatcctatataaaaaaaatcaaaaacaagacacacctcataccaaaaaaagttaaacctataaataataaaaagaaaaattgctacacgtactaattttttcttactaacactgatgatttttatcaagataattatcatctcaagataatacgtacggaattttataacttctgtttatctaaatcaaacggttaagataattattagtaaaaatatagtaagaaaaatttagcatgggtagcagtgctaaaaaagcacaagaggtataaaaataaagaaaaaaaaccaacagcaagagaagagaggagaggaggtgtgtgtgtgacagtgtgtgagtgtgttgacaatagacagtgttgaccgggggccccatgttgaccgccacctcacctcctccccttcccttccccttccctctcccctctccctcaccttcctctccaccttcctcttcctcccgaccaaacaacctccctcctcctcctccacctcgtcgtcgtctccgccgcgctgtctcctcctctatataccctcacccacactcgcacgcgcaaacccaacccccgcatatgcttaactccccaacccaaaccctcctcctcccccatgggcgcgtgcttctcatcccacactgcgaccgccgccgccgatggcgggagcgggaagcggcagcagcggaagggggatcacaaggggaagctccccgatggcggcggcggcgagaaggagaaggaggcggcgcgggtggagttcgggtacgagagggacttcgaggggaggtaccaggtcgggaggctgctcggccacggccagttcggctacaccttcgccgccaccgaccgggcctccggtgaccgcgtcgccgtcaagcgcatcgacaaggccaaggtactactaatactattactactggactttgacgcttggtctgtgtgattcgctgcggtttcgcgggaattcgggagttccatttcggattgagctagtgcgaattggttttgtttagattgttttctcgaattttgggcgtttagctcaagtaaaattctgattcatcaacgatatttttggttgttttgggtagtttagctgtcggtgaggccctacactacactcctcctaatcatatcatttatcgtttagttggggatttcacctcgttcaattaccccctgaaatggcaaaaggtggctctctttgaaacggttacgatgttttcaattttggctatttgcgcactactcgccaaatctggtgcattgtcatactaatttcagctgattgttgcttcttccttggcgcttgcttttttttagtaaacctgccaacttcgatccattttatgtacttaacatgtaaatagttcacatagagcactagtatttgtggctcttgttggtgtctccagattcatctgatttttttttcatggagatatttctcatcttgacagatacctcctctaggtgttcatagtgtaactagattttctcttgataagaccagtcaggaaagccaactggtaatggaaaacgtgtcattgtattcttctacggtatatttgtattggtggatggcattttcttcattccacacaacttgaccttgtaatacatataccaatcaacacggcgttgattttgtcaaaaatactttggacctttggttgaaatttaagcatttccttattaatgcttttattaaaatgtaaatttatggaagaaaaggccacttactaatcccagataatttttgtagtaaattagtatcatagttaaaactagaatcagatctaaatgctcaattttgcctgtggcaggttaagtgactgtgttaacctgtgtgatttttttttgggtgggaatatgcaaaaaggtttgtgcatctttgcattaagaaagagagtttgatacaatccgccatgctaggtagcaggccacaacattaaacagattccttgccacatcagctacgacctaggagagacagcagcatgctgctcaaactcagcctcggcatcctgacccctgcagttacccacagctgcacttccttgacgatagcttggatgagctgcgcccaatccctatgtgtatgattgaaaactcggttgttgcactctttccatatcacccaagccaccaggatgacaattgaatcgaagcctcctttttgggttttgttgagtcctcgatacgtgttaaaccaccatgaagcaaagtctgtttgccggactggtaggtgttgcggtatctgcaaagcagtcaggatcacccaccagacctgacaggacttggggcattgcaccagaatgtggtcaatggtctccacttcttgatcgcagaagaggcaattccacctgtgagaaaatcaaacatctttgttaaggagtgtaactggagcaccggctattatgtttcaaactataccaatgataatagaacaggctagttggactgtgtttaaattctagtttcacataataacctttgtagacaatttggtataactaattcactcgttttcttgattgtgcacagccttgggcacaggcagctctaggctgtatgatgtgcagcttgagttgatctactacttctgttgcacacatgatcacaattttataacatttgtgtccttaccaccggcttgcttcttgatgtttgtgggatgtggataaaataatcataatgcatgaatgagcttgcataattaagtgaagataatctgttatatttaaattagagtagcacatgcaatcacctgtctgtacagtagatattgcgatgttcatccatggttggagccttggatgcatgctctgtatagatgcttttatgtttgtctactctacattatctttaggatatgtgattgaaggcgatttgaattttgatattttatggcagatggttcgccctgttgctgtggaggatgtaaagagagaagtgaagattcttaaagaacttaaaggccatgagaatattgttcacttctacaatgcgtttgaagatgactcatatgtatatattgtgatggagtaagtagttatatactagcttctcttacatttcgtgcacaatgttatttgctatatacactccttgcacttacattttatttctacctaaatcctaatacgtctttactgccagttgcattctctatcatttgtttacagtatatgaatatatacacagttcttccaaaatcacatctcgaattcatgtcttcatggcaataaccatttatatggtcagaactcttagtatgctttaccatttccccttgctatgccccaatagtttccaagattatctaaagagagtatgcacgaccacatatgatttccatcagtcatacggtaccaacccttgcttcctttctatttttgcagactatgtgagggtggtgaactattggaccggattttggcaaagtaagattagatatatcctccatttcttcttctgtagttgatacattttcttctatctttttgtgtcatcattctttagtttccattcccgtacagcttctagggccataaggccattacttactggcaccttccattttgtcagaaagaacagccgttatagtgagaaagatgctgcagtggtggtgcggcagatgctcaaagtggcagctgagtgccatctgcatgggctagttcaccgagatatgaagcccgaggtagaaattgaacgctttcaatgtcttggcaattagtgtacattttggtgatatttcattacttctcaggtcatgtaagaatgtacctattttccttcccagaacttccttttcaaatcaaccaaggaggactcacctttaaaggcaacagattttggtctgtcagacttcataaaaccaggtatttatttcaagagcttttgcttatgtgcatctttgctatgtgcttccaattgttgcttctgatttgagtaggacatacaagtctgcagttcattcattgttttctttcattactgtagggaaaaagtttcacgatatagttggcagtgcctattatgtagcaccagaagttttaaaacgacggtctggccctgagtcagatgtttggagcataggagtcataacttatattttgctctgtgggagacgccctttttggaataagacagaggatggcatattcagagaggtaagtgatgaactgttcccaagcttttgcttcaagcaaaatgtgtttggtgagagtgccaaccttttactctgttgtcggtgtgcttatgtgatggaggaccagtgttatctacatttcttcaagttatgcggcattgttaccctgttaacgatgtgtcagtttttataagcatagcttgtattatttttcacacggtagggcacttggctacttggtcaggctgtccttgagtgatgtctgaactagctgtctaaaatacagcctcatcatattttgtgaatgctactccctccgtcccaaaatataagcatttttagctatgaatctggacaactgtgtgtccagattcatagccaaaagttgttatattttaggacggaggtagtaatgttatgactattagagtgagtagcaaaattgaacttcacttctagtttcaattagtatgaatgggcaacctgtggttccaacagccttagcaaccaatgttccagtgcttagttctagacagctggcaccatttgagtatagaatcctcttaggaccattattcccatcagactatgctagatttttttttttgaattacgtgtatttacagaaggagaacattttcagtcttatccgtcatcttgccgtatgtcttctgccagcatatgccacgtcagagaacatttccactttatttgttgaattagaaaataacgatacagagaaaataggcattcaactcaacctgtgaatgcagttacgtacttaggtagtatggtttccctcttcaatgaaccagcattttgttgtaatgctgattatctttgtgcatttaaatcaacatagacatcttgtggtgtacataatcttctgcatccccttgccttctaataatcaggtactaagaaacaagcctgattttcgtaagaagccttggccaggcatcagttcaggtgctaaagatttcgttaaaaagttacttgtaaagaacccaagggcaagattaaccgctgctcaagctctctgtaagttcctacatctaatctaagatagtcttaatacaatagtagtgaatcttcgtcagctgtcaatccttactgtcctgtttatgctttgatatgtttagcgcatccatgggtaagagaaggaggagaagcatctgagatccctgttgatatatctgtattgtccaacatgcgtcagtttgtcaagtacagccgttttaagcaatttgctctgagggtaaattttgtgtgcaactaatcttacatatcttttctcactatatgttcctaatgatgttggtttctttcatgctcaggctttagcaagtacactaaaagaggaagaactagcagatctgaaggaccagttcgatgcaattgatgttgataaaagtggatcaattagtattgaggaaatgcggcatgtaagttcttactggatattcttaatgaaaatgcactttggcacataattgaagtctctgattgtcttttttatgtttcaataggcccttgcaaaggatcttccttggagattgaagggcccccgtgttctcgagattatccaagcagtaagtgtcaggccttctttattattttcccccttattttcggagcaactagcttaccatctatcagagtcgtacttcaactgtgatattattctgtggcagatcgacagcaacactgatggtcttgtggactttgaagagtttgtagcagcaaccctccatatacatcaaatggctgagcttgactctgaaaggtggggcctacgctgccaggctgctttcagcaaatttgatctggatggtgacggatacatcactccagatgaactcagaatggtaagtttcaattcctgttctgtgttcatgttggtttatgtagctacctcatatttagtgaatgaagtgattttgtccacagaagatattatttcttacaccaagaaagaaaatcccagattttcacatatgttagtcgatgctccacatagtaggggcctgtctcatacgtataggaggcctgtttgataaattgaaaagcatttttctttgtgcaacatcgaagaccagtttgttgcagtgtgctatttcagcaattagatgcgagattaattttgactaattaatcctgtataaatgtttggactgtgacagaaacaaaactagtagtatttctcattgaggtttactttcaaggtgcagcacactggcttgaagggttccatcgagccattgctggaggaggccgacatcgacaaagacgggagaataagcttgtcggagttccgcaagctcctgcggacagcgagcatgagcaaccttcccagtccaagaggacctccaaatccacaacccctgtgaacgtcggtaagaaccgagatgagacgtcgtaaattagtcttgtaaaggttgtcttgttcctgtccgcgtgccatgtgatgttgagggtgtcttgagtttttagcatccaggttccgtgtgcagcatgcagataaagtttcggtgtagtacggagtacatacatatttttttcaaaaaaaaatgttacaagcagaaatgctgttctagtctcccattctcctccttgtacataattctatatatgtatgatttgattgcacgtattcatcgcaataaagttgcctgggattgcatgatcatgtgaacttgtgtactagatgtagatggtgatattgcaaggccatctagctagctagcagctgtaatactagttcagagctaagcaactttcaaatctatttgagtatttgtctatgcagtgttgatttgtttgaggttttgagaaactcggtttcccatttgctggaaatgctttttttttttttgctcactaatattcagttcaacctctgttgagtgcactgcaaaatttagccaaaaaagacttccaatttcttcagagaaactgacttcaagtgtgccttagcgtaagttctaaactgcaaacttagccgcacgcaaaacgggataactcactattccataattaattatgcaattattataaattttaaaaatatatcttttattttttaaagaaaactttatatagatttttttcacaaaatataccatttgataattaagaaattgtgctaatgaaaaacgacaaacttctaatttggagctagtataatttaggagccctatcagtatcacagtcaacatttacaaacagaaccctgactagatcaatatttacaatcagcgccctcaatattcactcgtcactccactgcaatatacaatggcgcatgcttgaatgccgccgccgccgccgcgacctcgtttggcgccaaatccggccgccatcatccacgccgcgctgctcaaatcctccccggccagcctcccgccgcgcctctccttcaactccctcctcgccgccgccgctgcctccccgcacccgcgcctccgctccctcgtcctccccgcgctcgcgctcgcgcaccgctgccccgccgccgctgggccgctcgactcctacgccctgtgctccgcgctccgccacgcctccgcgccggaggcggagccactccacgcccacgccgccaggtccggctggctcggcagcgtcttcgtgtcctgcgcgatcgccgcggcctacggtgggtccggcaggttcttggacgcacgcaggctgttcgacgaaagtcctgtcaggaatgccgtctttgggaacgctgttcttgctgggtacgtgaacgcggggaagtgggcaccgttgctggagtttgcaaggaggttttcggagcttcgattgcaggttgatgggtacacgatgacggctgtggtgagagcttgcggagagttggcggatgctgatttgggtggacaggcgcatgggcatgcgatcagaagggtgggagctgtggagtctgacgtgttcttgaccagtgcgcttgtggacatgtatgccaagtgtgggcttgttagccacgcgaagcgcgtgtttgacctcgcccagcaagtgaatgctgttggaatcgatgttgtgctgtggacggcgctgctgaacgcatatggaaggcacggaatgtgcaaagaggttatccagatatatgatcggatggtggcttcaggggtccggcctgatgaactgactattctggctgtgctctcagcatgccaacatgctggggaggtggtcaaagggctccactattttgagtctatacatgaagattacgggttgacaccgacaccagatcatttcagctgcgtggtcaacatgctatgtcgggcagggatggtgatcaaggcctgggagattgtgacctccaaaggctgtggaggtgagtttggcatctccacatgggtggctttgctcagtgcttgctgtgattgtggcaatgttgagctcgggaggatggctgctcagagggcaatcgagctggagcctaacaatggcaccatttatgttgagttgtcaaatttgtatgcgaggtttggcttgtggggggagattgaccagctgcgggaattgatgaaggacaatgggttggaaaaagatgctggattgacatgggttgagcttagttcctgatatgacttaaaatcccttcatgaaaccagtacaggtggaggaaggggaggcaatttcgcttttgttatgaaagccaactgagtatttttgggaacagatttgagtatagtcctattttttggtcacatatttaagactgctggaggaattgaaagtgaaaccactcgtggctttgccttggtcacctcatatttatcttcgttcaacaatgcatatacacctttacatcaggactggatccgactttagcatggttgctgcctcatgatgcctccaatgaattgaaagcatctgtgtaccagcgggttacaaaccgccagaataatccaaagatattaacattcagtcatgtactcttctgatgcgaacatgatgccctagtgtgacaagtgataactgtgctgagatgaaccaaacgaattgaaagtattcgatgtgccagaagttctcttatgaatcaaaatatttgtaaagaaaaaaggctcctccttctgactctttcaccaagacaaacttgtgctatggatttgatttgcaggtttctcctagacaaaattacaccgggtgctcgaaatctggaacttattagacttctcatggtacgaatgctttctttttattcttcaatggagttcttcctatatgttgtgactgttatttttgaaatgacactgaaatttcacaggtcaggcctttgttattgtgatcatgatctgctaaatcactgctagttgtcgttccaacaaagaagaattaaatatgcagtacaatcgcgcttgatgtcctagacaagaccagttaaaatacatcagattaggcagtgctgaaagggctattattttctatatattgatacagtcaatttgagtagtatgagaaactaactcaatgtatccagtttatagtgcaggtcttagtaatgggttattttatttggaacattaactaataatatccaaaagacataaaaaaagaactagcagtaggaatctctctcttagtagctaaagcatgattattcaattcgtcttatgcaagcaaaagtgtatgcatatgcaaaagcatgcctatcgccaccttttgccttgatttctccttattgctaaaagtgatcacagagccactacaaaattgaagtaccataacttgtagctctgaattcctaataccactcgttgcgacttaacaggtttttggaaaatgttatggccagattttgactaacctggaaaagaggttgtgcataaaattcaatagaagataaaatgaaagcttgatcctcattacaaaaacccaaccagagaccgagttggtaactttcccctcaaatgattcctgcctctccaatgccaggccaactctagcttcaaatccaggggaggaatcaaagaggaagggcagaaaaggcattagtaacataaaagtaaaggaaggaatgcattccaagcttgcattccttttcttctcctgaactatataaacacactggttcccacaaatcttgtaagcaaacagtctgttttgccctctttgctggaacaatcatgggtcttgcatttagtgccttcggtaagtttggtaaatactttcagttcgttctttgtttttatctcttgagatagacaagtgccacatgtatgttgaaccgatctgtgcacagctgttttatctccttcaggaaggcctcattgattggaatgtgtgatattgctaacattatgcaattctggagcttttatttccctttcatgttctgaattgttagtttgctgttgttcttttcaggcctgccagggtggagcagtataccaaccggacaagtttatgatcagtatttcaaggacaagaaaaccgacagctttgaagcttttcatgttgcctatgttgagttctgcaagtaagcaccctcattcttaaatttctattgtctgcgcaatcttgttcgttgtcggttgttatctatctcatcttcccaaattactgcagagatttcaacaccgtgctacctggtcaagattttgataccccatcactcgaaaaaattcaggtaaccctatctttcaaatcttcttcctccttgaggatgtagttttgcgcaaacattcccaataagcgacacctcactgtgaattaattggcctagattacagaaatgcagtccaaaaaaagacaaattaaactggggatatagttttgcacaaacatttcccgataagcgacacctcgctctgaataaattggcctagattaacagaaatttagtcaaaaaaaaattgaactacgtaacggtgcatgacttatgacttgcagaaattctatgatgatacttggaaactgatcaacgaagaccaagaaaagaagaaagcgttcatggattacatccgcgacaacgtcaaggaggcggcggtcgacgacagcctcttcatcatggccgggctggcggcgccggcgggagccatcgtcctcaagaggacagggcagagcatcccgcagctgaagaggctggacctcctccccaacgtcctcttcgtcccgctcttcactctcgctgccatcatgggagcaactgcagtccagatgaagcagaggagcagacacacctgatctcctcatcataatcatctacattgcgtcggcagttataatttacaaataataacatggatgaatgtcgatcaaatctgcactgcaatgtcagcgtcaaatatatacacacgttttcttttgtaatcttctttattgttactgtccatactgataataatatcacacaccgggatacgcctttgccaagctgccatcatctgagtgttgtatacatggtgaattattattattttatttctgttcatcatatttccgaaatgaaccttatgctaacttggtaagcctggagtcgcagtataagtccggcatggaatcaaaggttgtcgctcgagcaaacttccacatcaataaatttaaaaaagaaagaacccatcaaagcgtatcctgcaagatcaatcaatgtctgtctggtttgcgaacttgctcaaactttccactgatttggaacgtttctttagaagcatcccacaaattcacacatgtgcatgacaatgaggaataaatcatcagtcccccaaaagaggaatatttggccaacatgtgcatgacaatgaaagggtaaagtcacagaacagcggcagaacattgataccttgctcaactatagagcaaaaccagacctgatatagtaaccaaactcatgtcctggttaaacacttgctttcacagaactcatcatctctcgctgatactgtatattacaatcgatttagatgaacaaacaaaaaaagactactacaggctcaaattctaacttcatagaaggttgggatagataggttatcagtaattcttgcaatggagggcacggcgagctgttatcactttcccctgaaaagcaaacaggaaggacagatagataagtgtaagctgaggagctaaaactaagagaatttttttatggaacttgttttgcttttcacttacgtgttcatcattaatgtaatgttgtctccttttaagagaatccggcctgagacaaatcaaagtaagttacgaagatttcatatatgttgtgaacaaagaacaatagtagcagagtgcagaatttccttacccagagattttctagtgtccttctttatgttgatctcctcagcttcatccaagaccaaattcatgtattcgtcaaagccctacaaaacttgctgcagtaattatattgttcaacagtattcagtgaggataaaccagcaacatacgaaaaactaccttagcatgcacgtgcaaggtcacagacacaacaattatagttgtaaagaatagcaactcacgggtgagaagaattaaatcctcaaaagttttgtcatctgtcctatcccatgagatattgtgaataaatacaacatacagtacagagttgacatacatctagacagaaaagttatattatgtatataatatctagtataacagtatcaagcattaaaatggtcaactggcagtattttcttgtcaaatcgagttgtcagatcagcaaagtttcgcactgaaagcattagggttacatgtgaacacataaaaaaatagcagttctatgtgcccatcgcataaacaaacactcaataataaagctacttctgttttcgctgatacattatactatattggagtcaggcaatctcgtgaaataggaatttatgcaaatacagtacagattcttgaaagtgtctagcagctgtcactagtctgtcgctattactacaaaactaaagaaataaatgcctaacttcgctatctccaatgcaaaacgacaataacttacagatctataaacctgctcttcttccaaaaaagaaatacacacactcgtaaaaccacacagatcctacccaagacatgtccaagactacaaacaataaatcaaaaaaagagacgctattgctaggtctggatttcatgtttaaaagctacttcagacgcatatgggaatacaatacaacaaaagtgtatgacagtatgagcatttgagcaacaacctcaatcctgacggcagtattatctaacatctcaaatttcacctctagcaaacctcaatcctgacggcaatattatcttaacatctcaaatttcacctctagcaaaccactcttacaaaggcccctcatcttcttagggcaaaattctttctagcatacaagattaaactttctccccaataatatttccatagctaagggggattagggaacttacgatgattctgccctcaatccggaggtccttctgctcgaagagccagatctggatgcgcgctttctgctcagaggaaagaagacgaaacgagaaatcaagaaaagcacacaagcagcacggacacaggaagaggagaaagaactgcgagggggggtaaggcgcgtacactctggaggaagcggaagatgaggttgatgggctgggtcataatcctctgcaccttggtggacgccatggcggcggagttcgcttctcctcgacctcgcgcgctctccttcctgccctcggcgagctgacgcctaaaaaccctagtttgtttgcgagaggggcttttgcagcagctgggtgtggttcgctatggagaagccaagcttttatcaagagtacacatgagtttcatgtaaccatgtaattttccatttcaaattatattttttaagacttacacccttcatctaaaaaaacttaatctaaataaaataggacatatatcctacaacaataaataactcttatctaaatttgttaattagatcatattttaggttgggttttttctatgaagtaagtagaaaatattttacttcccgcgtcctaactaagatacaagaatttggttagttaaactactttaaatttaataaaagttttatggagaaaagtattaatatctaccatctaaaaagtaaactataaaaatatattttataatgcatctagtgatacttatttgataccgtaaaaaaattattctccattactatggatttagttgaacttagaatagtttaatatgagataaactaaaaatcccttatatttacatgagaaaaaagtttttaaatttagaggagtactatatcgcaaagagtatctttaccaatgatgaggttttttttaatgcttttaaattataaatcgtattgttagataaatgtagcaaaatcataagttgattttatcgttgaccccaaactcctaaagtgtcatagtcaaacaaccgatcttaatatgtattacgtatgtgtttggaattcaaacagacagtcatgaaacaaccagaagggtataagtgggaggtgagcgtgtttatatcttccgtgcaaattcagaaataaaatcattaattgttttttaaaaaaaagtataaacattctcttataggagaacgtgtaactagattttgctatatctagcatatactgttttgaaataaataccgaaatgtgcaggtgttgcaaaagaaaaattcagtttggcaaaacatcagtagtcaaatgatattccctaataagtcgtttaagtttattagaaaataaaaattaatttataagtaaaacttttatatatttattattcatagcgacttaaaaactaatattaaaaagttacattaaaaatatattaaaatcaactttaaaattaagatcaaaaatttaaattttagcttttgctttgcagaaatatccccaaatgccccatgttccatctgagccgtccaaccccacgatcggacggtccttacgcctccgcagaatctcacctccgtatcagttagtatgcccaattctcctcttctccccactctcctctcgcatctcttcttcttcttttcttctccagatcgcgaggcgggcggaatcgcggaagcagggggatcccgcagccgaatcgggccggatctcgccggcgatgatgccgtcggcgtcggacgccgcggcggcggcggcggcgctggagctgcaggagtccgggtgggaggagctgcggcgggaggcacggaagctggagggtgacctcgacgtcaagctctcctcctacgcgcgcctcgccgcgcgctcctcctccgccgccgacgccgcctccgcctcctccccgagcgagcgctcctcctggaagtccatggagttcgagatccagtcgctgctcgacaagctgcaggacgtcaacgacgccatgagccgctgcgccgcctccaccgcccccaccacctccgtctcgcagaagctcgcccgccaccgcgacatcctccacgagttcgcgcaggtaaaccctagcccctgcccgcccccccgccccccccccccaactccctcacctctcctccccctcacactgcttgtaactgatcgccacaggagttcaggaggacgagggggaatctgagctccatcagggagcacgccgatctcctcagctctgtgcgggacgacattactgagtccaaggttcttgcctcaaacccctctacaaaatggtttaactgattaactccacaaaatggttgtaatgtaatgtgctatcgtgttgtgctggcctgattgatcgttgtggttgtctaggctactggcggcatgtcgccgagggtgcatttgctcagggagagggcctcgattcatggcagcattaaccaggtatggcttgagctaaaataaggttgttgttgcacacttgcactgatcaaatggtttcctggttggcatagtcgcatagatgttcattggctagaagaatttatgtctataggcatgccatgttcatcattagttggactggacttatgttatctcatgatcatgacaatctgcctgtcaatggcgtttgatgtagtgtaaagtttggaggagggtctatctaatctctctcattgctagttcatctttcaaccatttgattagttatgaaaaaacaactagaataattgaggtagtctgagtggaaaaaggaaggaaatcgtggtatttctgtcttcagcattacgagtatgcatttctgaggatttttggtttatctagcacaacaatgtaaaaaaggtagctcatcctgtacaatatattaagtaacagctatgacttgtttccagattgatgaggtaattggccaagctcagagcacaagggtagccctttccaatcagagggcattgtttggggatgttcaaggaaaagtcaagcagttgggtgaaaagttccctgttattagaggactacttggtaatgtatcaatccccaatttacatttttattgatcctttcttacatattgttctgaactggcattgtgctaaatgtgctaatctattattcaccgaaatttctgcatcccaactttccatgatcatgtttgttttagtttgtgttagtagttagtacaccactacctttcttacacattcttgctacaggtgccatcaagaggaagaaatcaaaggacactatcatcctttcagcagtgatcgcggcctgcaccatctttttgattatttactggctttcgaaatgatggttgtctccagaaaatctcaccgtgaaggcttcccctctgcgcagaatcgctgataccagatgacacgataagacttggtagtatgtttcatttgttaggctaagaggaggaatgagagatcggattcttcagcttttatcaatttgcctttgatatatactcctaccttgtatttggagattaacctgtcctacatgtacagtacagagcaattttgctttccaaagtaacttgtctggctggctgagtaaatatgatacaatcaagctgatgctctttttgtgataaaaaaaatggccattaaaacacttgatccgttgagcacttaggtttagctggaaaatagtctctcgtctcttctcaacgaccgagtggctggctgctattaatctcagttatatgttcagctttacacatttacagctgatcagaagtgaagattattgacgcatctaccttcactttgatgctaacaaccttagatagtacgatggcaaccagtatgctacgtgtgctggtaagctttggagttcaacaagttttcacttcaaaataaaactaggaatctagaaccatagcgtgcagtagtgcattctcaaatatcacattcatcatcttgcagcgctcaatggattttttttttacctctatggacaatcttccatccaattgcatgcatgaacattagataaaagaggtatcagatagtgacacttgacaatgcatgcaatcgtgcattctcaaatatcacattcaccatcttgcagcactcaatggaattttcgatctttatggacaatgttaagtaacaatctcattgcgctccatccaattgcatgcatgatccatggacattcgataaaaaggggtatcagatagttgacactttacaatgcaaggcatgaagcatgaaaaaatggtgaccaagtacagtttcatcccaaaaggccttctttccccagaagccgcccaaatacaattaaacaatttttgtaatgaatcagttgtgtttcctttttactctgtaagaacaaactatttacaccagaagtgacatatttgtaacaggttgcctatggcaaggaaaaaacagctcaatcctgacaaagttaacagccgcattctatggttctatctcacttcaaagtcagatatcatactctcttcgcaagagccacgtttttgcagtgatgacaactggtattcgacatctcagcaggacttgccgacttggctcaatcatacatttggcgaacatactgctgaaggcagaagtacatgaacagggcactcctagctgcatcagactccaaagagaggtaaagctactttgatgaatgagtaacaaagtgcccctgtgaaaacatagctgtctactcggtcaagcatcccacctgcattgcagccttgtgttatgttcatgcagaagctatagatgattctttaaatacaaaccatgaaatctggaaatataatttatttctccttcagggatgaaagcaaagttaacagattaacatacacagtaaaactttcaatatgagtttgacattatctataaagcaggcaaagtgcgttaaaaatagaagttcctgttgtcagatctcagtaagttgaggcaatatctatctcttagttgacaaagaagggttgtacaaaaagtaaaaaactataagaaattataattacatggattaatgcagttgacaacttgagatgacactatgaaattatgcatccaataaggcctttaacatttatcctaaatctcaagacaatcaattgcacatgtagatgcattactacaattgaataaggcagtgagttaaaaaaggttaccatggccaggaatgagtgatccagagtccttcacaccagcatcacgcttgatcagagactcgacaagatccccgaacaacgaacccagaaagatcaagattccgtaagcagtagcactgatatcagtgaaatagttagttatcaaaaccaagtgttaaggaaatatttgctacttgtgaacatgcaagtgaacaacctatcaaagttttgaacacaatcagactaacactcgatgctcacatgtagttcatttccataaagaactcctagcagcagctgtttgttgttcatatgttaagcaaaatataatgcgcattatggtactgctgatacaccctaaaaggtgaaagcctacattgaccagtaaatggcattcggaaaaaccagtatgcaagaagtttcagtggagagatgtgatgtttgctacagaaaattgtaataatagttagaagccagaaattagcaacacctcagcagcgatcttggccaatgtaagacgcttgaaagaagcacagtggtcagtacacagccagttagaccagctaaagcaccctccaaggtcttcttagggcttatatcagtaagaggagtgcgaccaaatgcctgaaatggaaaataaataacatgacgacacgatttccttattcaaagtacaaaacttctttaatatactacttgaatgcaaaaatacagacagtaggaatacttgttcacacaacaaaaggacagcaaaattaagatataatagaaacatgagagtctgctagcagcttgtcagcaggaaaaggaaaaaccttcaagcagtttatatgtgatctaaaatattctagcagcgtggttttctatatcaattatgaaccaactataccactcagcatagtttggatggcttaatagcactgtgattgatgactggaacgcctcaagtcacaaaagtctcaaatatctactgtagtcacacaaaacaagggtaagaattacaagagcacaaggttacaaccgttccttactctaacattaccatgggcattgcaaaagataatatattttttaaaaaaaataatatatcttctttacactaaaataaaaaatgaaatcaaactggacattatagaagaaaagaacatacccgtccacaaaggaaagcagatgtatcagcggcaataatgctactaatagaaatcaaggttgctacaagtccaactgtccagtgagcttgcccaccaagaagtattggccaactgtatgcaatttctggcaaaacacatactgcataagcaagaggaatcctattcgcttgctatagtgaaatttaacagtacaaactcttgaactggtaaaaactttgctgctcaactttttatgaaccttttgaaaaaattaagactaacataaattgaacagaaacatataatttgatggacacaccatttctacatttgctaacaaactagacagaaaaggaattaataaaacgaaggcaccccaactaagaaaggacaaaacaaacttgattgaacaacatacttgtatttaaggcaggagcagctagtccagatcggagcttaacccagaaagaaggaagatagccacaataaaagagaccaaaaactgaactagtcagctgtgcaaaacgaggatttcctctttgcaataacaatgatatcgcaataaggaatgcagaaaacgtcacggtaacatccatatgcccatagtacctaagcaaatagacagatgaaacatcaggttcagaaaattgtcacatttacagaaaatgacaacttaaatatagtcatgtaccaaataatactccctccatttcttttactctagttaggatatcgacacaatctccaatgtgtattaattgcacataagttttttcatgacaaatctactaatgctattttcagttttttttcacatgtcaaaacttgacatgtttcatatattagtgaattaaggtctcaagtttgcctacgtgcattctaaaacttcatctatttgagaacaaactcatgaaggaagtagtacaatacataattccctcagatttttaatctttaacaggtgaatcatcattaagatctattcgcagtcccctcccatattttgttcaaaagtgatgcatgcctcaactgttcaaaaacagatgcctggtggttacttaagttctcatatatacagtctacattgatctttttcagaaacatcaatccacaagataaacagagaagcttaaggactatcctttgcaatattgattctagggcgtttgagcacccaaacagcaagtagtgagatccagtgcatctcttcttgttgacaaacctcaacagtcaacaatgcctttactttatgatgatggccagtattcatccccaatttccatcagatagctgattgacacccagaccgaaacctcactatttgattagactctccctgtcttctattcattcaatagagacagacaccattcagttcagtttcaactcttatattagtcagaacaggtttccctttacaaaattaaagatcctaagcaatttcatgtaccactatccttgttacatacaggattactggctaaaagttactttcactaagaatgacaccttgaaacaacaaatcctgactaaactacacatgaattgaacaccaattgattgaagcaaatggttagctaacacagttcatccaaattaaccaatgtaggtgtaaccgcgaggcctgcttacagggtaaggataggcatgagagcgcagatggcagagcagacgcgggacacgaagcgcggcggcggcgtgcctcccccgccggcggtcccgcggacgagcccgaagtactcacgagctccggcgaggacagccgcggccacggcggccgcgaacacccacccgccggccaccacgacgccgcccgcgcccaccccgatggcgacgcccacgagcacacgcttctgaagctgccgcgacttctccctcttcctctccgcctcctccccgccgccgcccccgccgccgcctccatcggcggagacagcggcggccgcgaggagcggggagcggcggaggaggcggcggagagggggtggtgtcgggatgaggaggcggaggcggagggtggggcggggacgtggctgggaggggaggagggggaggcggtggtggcggtggtggtggtggaggtgggcggcggccggcgtcgtcgctgtggccaccgcggcggccatgggagatgggggttgcagtgttggtggttgtgtagtggagggaggcggagagttcgatgtcaataggggattttgctggacttgtttgctttgcttggcgcaaaaaaaataaaagaaaagaaagactttcgtgtttaaaacgtgcttaaaaaaaaactactccctccgttttacaatataacttattctagcatttttcacatccatattgatgttaatgaatctagatgtgaaaagtactagaatgatttatattgtgaaacggagaaagcacatgcacaaagtactgtaaattggagcatgtgtattcataaaggcaacaaagtttgcaagttagaaataccttttcacccaatgatgagaaatcatttgacgcaagaataccttttagttgcaggaataaaaaaaacggaggaataaaaaaaacatgattctgataggaatgcaaatataaaacatatgattataaaatgcaaaaattaccgtttgattcgaccgtataaattagacgagagagatagactcaaataaaagctctcactaagtttcattcaaaatctttgtatgattgtccattttattggaatttttcttataggattgaaatcctccaaaatttatacaaatcaaagaggccctaaaaatatgaattcaatgacgatgtaaaaaatgtaagaatagaatgtcacgctttatattggtttcaaacacactagaattcaaccgttttgtatatatttacatggttaaaaacctagaaattcttgagaataatcttttgtataatagagataccactatatgtcatatagaaattcttgagaataatcttttgtataatagagataccactatatgtcatatagagaaagcaaagaaaaagtgcatgagaattaaaaaattaaataaaaacgtgaggtgaggttatgaactcatgcttaacagtctcaacggttgcctaaaaaccaaagaaaaaaattttaaaaacttaatttaattaattttaaaattgattttaagatatttttagcatagttttttttagtattggttttaaagtcgctaaggatacatatgttaaagttttaggtccctaataagccattcgacttgtaatcaatttttgggcaaccgatgagcccctaaattcatatagagttgagatgtgctttgtaggaaaggaactccatatattctttttttagcaatgatattcttttgctccaaatagtgcattgaaaccatccaagttttcttttgaaattgctttaatccagagagacctaaatctcttagcttcccaatttagcacaaatccttttaccccaaactcatctatgtatagaacataaagatagttttgatgtgaatattttccgatctattacaattattcgttagtagttatattggatgataaaccagttttacaaacggcttggtatttgtaaagtactctctctgtcttaaattaattcacatgaattatgtaacttgacttattttgaacaaagggaattgaattggtgtggtccatatcatcttgttactatcgattttctcataatttaattctagtaactaaaatgtctctaaagtatttacctcatatcggccttaaaaacataattttcaactttatatgctacgtctccaagtatttactcctccaatttctaattttttgacgttttggacattatctcacataaaaaaattaattaggatgcttattttatgtattttcacattaaatatattagtgcggtggttctaataaacttaacctggtagttatgaccggtagtttcaaagatttaggttggatttaaatcttggcacctactatttttctatgcttttaccgtggcgttggaaacgatacgacaatttgatttttttttccacatgatttttgcgctgctggacaagagtcgatgcacaggttaacgtgatttgcatgcatacatgtatacaagctaaagtgatcacatggagactaaaaaagtagtgatatacatattactgaaccgtacgactacgctgaaccaaccaatcacgaagttcataagtattcacgtgggcccaatcagaataagttaaaacctaagcttatgtccagttgtacacatgtcggacaaacgcagtcgtatgtgcagtcattccgagactaaaacatcaaaagtttttattcaaaaggtccaagccccgaatgtcaactaattcatcactagagggagtattatgtttatgcttttaatttttcactttgtgcattaaaatatttaataatttatatgtgtttatggtactttcaaacgagatatcttatatttttcttgtaactataaattcatcttaaaatataagaggttttggttgatgaaacatattttattctaatactatgaatctgaatatagagcctaaccaaaaattttttatattcgagagcgaagaaagtagatcatactatgatctatactaggaacaacaatacacatatgtgatacgaagagcaaactagaaaaccatggttgcgtttagttcacactaaaattgaaagtttgattaaaattagaacgatgtgacggaaaagttaaaaatttgtgtgtagaaaagtttcgatgtgatgaaaaagttagaagtttaaagaattattttggaactaaaaaccgcgcatgtcacgaacgaagcatgcaaagcagcaaccgaaataacgaatcaaccctgaaaccgcacaaaaacggcaacacaaaacacaaccacaaccacaagcaggtccggtcgagccgagtcgagtcaatctctcttctctcttctctcctctcctctccactctccgatccccacgtatggcggcggcggcggcatctgcggcggcggcgacggccgcggaggacggggcgcggctgctgcggctggaggagcaggcggggcacggcggcggcggcgcgtgggagtacctctgcctcgcccgcaggctccgcgcgcgccgcccggagcccgtcctccgcctcggcctcgccctcctcaacgactcctccgcccgctcccgcctcgcctcagaacgtaacctgccatgtcctccctcccccctcccctcccctctacccgatctctcgcaattccgctcggtgggtagatggatttggtggatagatctcgtgatctgctcctcccgacgccccgatccatctgtggatgcgatgccggggttttggatggccaactttgaaccctattgttagattgcggttgtagtactgtgggatctgtagaattgaggtttttttttagaaaaataataattgtgtgttgcctgaaacccctgctgttttacagttagaattactgcaataggattgcaaggctgcaggatctgattgctcccttcgcgattagttcactagtgaactgagattgctttattttgatgcagagtggacgctgtatgagcaggtggcagtggctgccatggattgccagcgtctcgatgtggcaaaggtgaggttgcgctcgtgttgtactggcagtggcacccttttgagctcagttcctgtttctctgattcaacgcaatttcatttaatcactaaacagttcacgcttttggggcctttagttatccaaatttctgatgaagcgatctctttcatgactttacaggattgtattggagtgctttccaagcagtttcctggcagcatgcgggttggtaagttctttcagagatcagcataatatagttagactagcatcatttgtcaacaaacgtagatcttatattttgcttttggatgcacatccgataagactggaaataaaaattacatatggctgagaaaaactaaatataaaaacaatctggcctagaacttaaaaaaatgccaccaatcctgtgtcataaatttatgtcaagttacaattagggttgacaataggccactctgtcaataacttgaggagaaaatacggaggcaaatggtcagggctattaatctagattattatgagttgcactgaattgcttaaccatagtacaatatgatgctaaaccaatcttacaggaactgatgttgatttctttgaaaagatacacctgtatctagcttactactccatatatcaagatagaacgatgatgtggtaagctggattatagcaatgctatcagactaggcattatttgatctaaagtaggagggcagtgtgcctatcaactgaacatgtcatatcttacatgtttcttaactaatgatctattacctaaatcctggtgcgcacaaataaatgccacatacacctaatatcaaattcccctatacttcatatgagtttgcaacttgatatatgctgagacatgtgatgctgattcttatggatatttttctgcatatggtactaaacactttgccctcaaatgaaggtcgattggaagccctgctgtttgaagcaaagggtgaatggactgatgctgaaagggcctatgcgcttatccttgaaaacaatccgttcgatcaggtataattgatatttctgctgctgatcctggtttatatgctgtgaacctgatgtgcaagatggagtttgatttccttggtatataaagccgttcaaatgcttgggatgataattttacaggggcatattaaatattttccttgtgtgctttcagattgtccacaagagaaaaattgctattgcaaaagcacagggtgacatggcattagctgttgagtatctcaacaagtatttggaactgtaagtatctgcatcaacctgatgcgttaaccatatatgtttacctctaatacagtgactttccctgtgtgttagatttatggcagatcatgatgcttggagagaacttgctgaaacatatgttgccttacaaatgtgagatatttaatcatcgattcattcacatctgttagaatgtgatgatgctaattttgttattcctcttgtatcaggtataaacaagctgccttttgttatgaggagctaatattggcccaaccaaccgttccactttatcatctagcttatgccgaggtaagtgaactatgccaaactcatccctcattctctcaaagtctcaaagaaaaataaaacaaaataaaattgtatcaacttatgcagtttctcattttcatgtggagtgcagcagtaatagtttgttttgttcctcaatgaactaatggccaactggccaagtcttacagtggcaatgaacatcaaaaggctaattaaaattaagcacagtaaagttattgctcatcctattgaaaacagtgttgcttgattcaatagaattccatacagagcgatatacttatttgcacattttacggacgttgtgtttggcaatgtaaatggtgtttttgagaaatgaattcaaagtttatcttagaatttgcccccccccctctgtgctgtttttataccagttctgttgttatgttgtaaagtgatgatgggaagaatttgttggagcttgatcttatggggtcttctgggattttggtggggaaaattttctcccttgttttagtagttgttgtgtatgccatatgcacgttacttaatctatacagtaggtgcaagagaatttaccgcatttaccgctgcttttttctgatttatacataataacttatttaacatgcttttctgatttggagatgctactactgttgctttttttttttgttgaatgcaaaatcaccacaaatttagtgttctatacatgcaactaattcaagcctagaacctgtctgcaactcatgattctgctggaaactcaattgatctcatcctacacctctctgtacttctcaaattctcatgaactgtgtgtaatcctttatattttctaggttctgtatacaatgggtggtttggaaaaccttcaaacagctagaaaatattatgcatctacaatacagttgactggaggcaagaatacaagagccctctttggcgtgtgtttggtaagacatcagtgctgttccacaacttctaagaatctcagttggcttccttttgttatccaatactaatcctcttatgtataccaccttcaacatcaacagtgtagctcggcaatcaatcagttgaccaaagggaggaataaggaagaggaaagctcagaactgcagagcttggcttcagaggcactattgaaggattacaagcaacgagcaccgtcgaaggaggcactcatcaccagcctgttgaagaacatgaaactctcctgatcttgccctccactcatcgaaggttttttagcttgtggcacaatcgcagctagtcagtggcgccacaatggcagtttgacaaatcaattgatagcagtataatgcttgttttttttttctcctgatggcaccgaaattgtaaaacttatgtaagatgcttcaatgggttgtaccacacctgttttgatcatttagaaatatatattcatcgtcgtgttttgattgcaaactgtactaagaccatccgttgtaatttcaggatagaaaattttgaataataccttcgaaagctgtaccatttgttaacttgccagacctcatgctgttccttcaagactgtcataaacagaaaagacataaattactttaaatctaagctccacacttcatgtgccaattattcatggtttctcaaattacagagtacttagtagtaaataaatagtactactaatcactatgtttttgtaatattggttgtctattttattttctgcggagggagtaatgtttttccatttcatttcaccagtttttaggcctagttagatttagattatagcgtggattgtctgctttattatagtgataaattaaaattttaagaaataaatttaacaaatagtttaaaggtatctgactcagttacaatgataaattcaaaattttaagaaataaatttaacaaatagctttcaagaagtggtttggagctgaacaatgccgcgcgtaagaaagtttaaaagaaacgatatttttaaaagttcagagcgaatagtctgataaatataagcttaaaaagagccagaccttagcgattaaaatgacactagtttcgttgagcgaaaatgcaccaagaaagtaaagggagcatgcatgcgcgcgacaggcgctaccaccgcacgtcacccgcgaagctctcatggcctcacacaccgcgccattgccatcgtttcaccctacatataaaccgcatccacgacgccaacgatcgctcgaattgatctttcttgctcgcgatcgattcgatcgtcgtcgacgcttcgattaattctcgctcgcagagaccaccaccagtagcagcatccagctgattaaattaagctcgcggcaatggcgcaggtgagcaggacggtcgtggcggcgctgctcctcgtcgccgccgtggtggcggcgtcgcccgtggcgtcggcggccacgtacggctgcttcgaagactgctacgagcgctgcgcctccgggaagaaggacgaggcctgcaccaaaatgtgcaaggaggcttgcggcggcgccgccacggacggccatgcccccgccgctggcgctggtgctggcgccggcgctggcgccgccgtcggggctggcgctaaggctgccatcggggttggcgccggagctggcgctggcgctggcgccggcgtcggagctggcgctaaggccgccatcggggctggcaccggagctggcgctggcgctggtgctggcgccggcgtcggggctggcgctaaggccgccatcggggctggcgctggagttggcgctggcgctggcgctggtgctggtgccgccgtcggggctggcgctaaggccgccatcggggctggcgccggagctggcgctggcgttggcgccgccatcggggctggcgctaaggccgccatcggggctggcgccggagctggcgccggcgtcggggctggcgctaaggccgccatcggggttggcgctggcgttggtgctggcgccgccgtcggggctggcgttggagccgccgccaaagtcgccggcgccgccgagggcgccgccggcgcggcacccaaggtgtacgcgtgagatcgatcgatcgagcggcgtccatctccactactccatccatatataaactcgctgtcgattgtttgttgttaataaaagtttggttaatttaaacgtcaagcgtttagttgtttaatttacatgcaaatctcgcgatttgtgataattaactaccgaaatgtgtgtttgggctgctaattcatccttctcgctccatattaatttgtccatgttacatgtgtgtaaatgttataaagatctaactcatgggcggactatatatatatatatatatatacctacgcgtttcaccttggttaaaagcaaacggttcggtgatccaacaaatccaatatagaagaggcccaaatacaaagtggatcaaagagcagcatttgcattggcagaaattaatttatcaagagatgtaattaatattgctattattctctttaagcaaagaaccagacatgaaattaagatagatatctattagctgtaaatttatatataaaaatacaatcacttccaacactgtttagattactacttgtcgtattaataaacttccatcagaatttattcctattttacctccacccactctctcacccccccaacactccaactattatcatttaataacggttcggctataattatggcgacagatttttcccacaaacacagtcgaattttttcagccttagaattggcatgaagattcgagctcacggggcatcagcacacacacgctttgctgtgattgattctgacacgccatagatgcactgatatgctttttaaactttgttgttgttgtaaattatatatttatacagatttacaaggtagttacacctcacttacacaccacttatatgtaattttagaatttacatatgtaattttaagacttacatatgtaattttgggatttacattgtaaatacactaaaattacatatgtaatttagtgacttacaatgtacatacatgccgactattttttggtgaaaaatatggcgccataaatatagctagtccctttaataaagagcaccaaaatatttttaaaattttaatctctgttaaataatctagaaatattgatattttagaatagataaagtattaaaactttgactatatctatatatctctatggagaagacataatttcagtaacaaatctactcatgatatagtacaataaaatcaattaccttgtgcaattgggtaaacagggtaataatggcctcattaattattctttgtaaatatataagataacatgtgacattcatataagaatcatgcactatacaatatataattgcattcgcacccgaggggcttggcaccctttaaggagtattcatgcatgtcgcaaaatgtaatttctagctgaattaagcttcaatgctaaatgacaaattaggttctatgaaatataggagcacactatttttctttacgaaacacagtgcaaacgcaaaacacttatatttacgtgcgcatgctcgcacgtatgaatacttactagagaccaaattggcatgaattaagattgatcaaattgtcacaaacgtcacgctatgaaaatcgataccatttttacaacacacagacaatgacacaattgacaacacactactatataaacatacatattttttttataaaagggtttcttttttttttttgaaaaagaagagctagagcatataattggatgtacacaatccacccacacatgcactctttctttgaaaaagaaagcacacacccacaagttactagctagctatatttgcagcgtcatattcttaaaaaaaacagttagaacatttttacgctgtaaactaccagtacttatattaaaagtttgcaaacttacacttaattacactgtgaattttaatagatgtactgcaatacacaaataacatattatagagaattagaattaaaagtaatcgattaactacatatgtaagagaatggaagagaagataggagagatagacatatattaacaactatagatgaatacctcattgcgttgctgcgggaaattaagttacataatatatacaaatatgatgcaatatgattattaaaactgaaacaaattaatacttataaattttgagcctataaataattgagattgatggtgttacgagagaagaaagaagggacaattcgaaccatagatctatcatacaaaggctagaaataattagggtgatgtgacttaattaacgagaaaagagagaaacagaaatagtggggatgaactatataagtatataggattgatagaagaaaataaatgatgaagaccaagtgaaaaatcaatgcgaagccctatttttagcaaaattagaccgtgtacatcttttggatgtagaggccggtttaatccattttctaaaacaaatttttagcaaaaacatctcgtagcctcacgctttgcccgggaacctctcgtagcctcacatctcgtcattctccctcctcctttctcacgtatataaacacaccctcacctcctggtgatagatcatctcttgcatcaatcttaatttaatttctctcttcatcatcatctcgctctcgatctcctacagaagctacaatagccagcaaatcaatcgatcgatcgatacgtgcaatggcggccatgaaggtgaacaagattgccgtggcggcgctgttcctcgtcgccgtggtggtggcgggcggcgccggcgctagcgcccacgtcggggttggggctggggccggggccgacgccggcgtcggtgccgccgtcggggccggcgctgacgccgccctcggggttggcgccaacgccgccggcgccgccggggctggagttggggctggaattggagccgccgccaacgtcgccgggtctctcaccggcgccgccgagggcgccgccggcgtggcacccaaggtgcatgtgtgagatcgatcgatcgatcgagcggcgcggcgtacatctccacgactccatccgcccgtagcggcgccggccatcgatccacgaccattcgccgtcgattgtttttgttgttaataattaaagtttggttaatttaaccgccaagtgtttggttgtttattttatactctatccgtactaataaagaaagtcgtttaggataatgtttaagtcaaatcttggaaatataaataatgaacaactctcaaattattgagtttgaaaatgtaaaaattacatgaatagatttgtcttgaaaaatactttcataaaaatatacatatatcactttttaataaatatttttatagaaataagatatcaaagttatgttttgaagactgtgtcgctgtccaaaacaactttctttatgagtatggagggagtatatgcaaacctcgcgatttgtgataattaattaactaccgaaatgtgtgtgcggcctggggcgttgctaattcatccttcgctcggtcgctccattaatttgtaatataaatatatatccatgtattttgtgtaaatgttataaagatctaacttatgggcggatcatcatatatactgacgtgtaaacgttgcttaaaattttgattgttttgttacaaaatctaactcatcactcatgcatggaccatgcatacctacacgtttcatcttggttaaaagtaaacggttttatgatccaacaaatccaatataaaagaggcccaaatacaaagtggataaaagaacatcatttgcattggctgaaattatttctagtctagagatgtagtaattaatatagctattattctctttaagctaagaaccaggcatgcttaaacttttgaaacaaattgagatagatagctattagcagtaaatttatatatcaaaatacaatcaaatcaattccacctctattcagattactatttgttgtatcaatgaacttccattcaaatttcttcttattttacctccactcaccctctcatccccaacgccccaaatatcatcatttaatacagaacaccaaaataatttttaaaattttaatccctgttaaataatctagaaatgttgatattttagaatgaataaatttcacaaaactacagatactttagtcaaattatcataaaacaacatatctaaggtgatgtattacaaaactacagatttaacactaaaattctcaaagaactacatatttaaggtggagtatcgcaaaactacagattaagtaacaaaattatcccaaaactacaggtttagtatcaattcaatcataaaacttagatatttataactcaaatataagactagtgttaaggatttaaactccaaaatctgtagttttgtcataactttgttactaaatccatagttttgcgatactccactttaaatatgtagttttgtaataaatttattgttaaatttgtagttttatgatatatcaccttaaatctatagttttgtgataatttggctagagtatatgcagttttgtgaaatttactcttttagaatagatagagtgttgtactttgactatatctatatatctatacggagaagacataattttcaataacaaatctactcatgatatacgataaaatcaattaccttgtgcaattaggtaaacagggtaataatagcctcattaattattctttgtaaatgtataagataaccagtgacattcatacaagaatcttgcactatacaatatataattgcattcgcacctgaggggcttggcaccctcgtaaggagcaatcatgcatgtcgccaaatgtaatttctagccaaattaagcctcaaagctcaatgacaaattaaggttctatgaagtatagaagcacattatttttctttacgaaacacagtccagacgcaaaacacttatatttatgtgcctacgctcacacgtatgaatgaatatataccttaccctataaatacttcctagagactaaattgacatgaattgagattgatgaagttggcatggacatctcgctatgaaaatcgataccatttgtacaacacacagacaatgagactattgccaatactcaacgctactatataaacatacataatttttttatcaaaaggatttttttttaaaagaaaagtgtcgatgttttaggtcacgactacggtatttgcatggtatggagatcgttggtaccagggtatatgcaagattgaagtaaaagagacagaaacaaggatttttacgcaaattcgggcccccttcacaggaagctaatgaccctactcccgttaaccgaagccagtgttgctttttattcggctgaatcacacaagtacaataattgcgataacctatctagctgtcttcgacttggcgacatggatcaccaacacgtagtcgacgacagggtagtcttcctcctcgtgtacgaactcgtcgaaatcagagatggcgctagatccctcttgtcggtctccacaagcaccagattgggtttgtctaggttaatctctaatgccgatgtctggcttgttttggcttgtgtgttgatttgttgtgtgtgttctctcccctaggggattttgtatttatacaataaatgtcccattgtccaagtagaactagggagaccaaaatggaaaaaatcctaatagtccttatagtttttatatagaactctatttgtcattccttatccggaattccttctatatacgaggtatgattccttataagatttggtatatggtgagccccgccgagtttagtcaattactactaggtatgtgctattcataaccatgataaaaaagagctagagcatataattggatgtacacacaatccacccacacatgcactatttcttaaaaaaaaagcacgaacccacaagttagtagctatgttcatagcgtcatatttaaaaaaacagttagaccatttttacgctgtaaattactcgtacttatatattaataaaagtttgcaaacttactagatatactgcaatgtttgtaatacacaattaacacattagaattagaattaaaagtaattgattaactacatatgaaaagaagataggagaggtagacatatattaaaatagaagaaaattaaataactgatgaaaaccaagtgaaaaattaatgcgaaaccctatttttagcaaaaacaaattaaacctattcacgcttgtccgggaacctctcgtagcctgacatgatcacatctctcgtcattcccccctcctcctttctcacgtatataaacaccccctcccctccggttgatcgatcatctcttgcatcgatcttaatttctctcttcatcttctcgctctcgatctcctacagaagctatagtagccagcaaatcaatcgatcgatccgtacaatggcggccatgaagatgaacaagattgccgtggcggcgctgttcctcgtcgccgtggtggtggcgggcggcgccggcgctagcgcccacgtcggggttggggttggggctggggccggcgccgacgccgccctcggggttggcgccaacgccgccggcgccgccggggctggagttggggctggaattggagccgccgccaacgtcgccgggtctctcaccggcgccgccggcgtggcacccaaggtgcatgtgtgagatcgatcgatccatcgatcgatcgagcgcgcggcggcgtcatctccactactccatccgcccgtagcagcgccggccatcgatccacgaccattcgccgtccattgtttttgttgttaataatcaaagtttggttaatttaaccgtcaagtgtttggttgtttattttatactccatccgtactgataaaaaaatcatttagaagaatgtttaattcaaaccttaggaatataaatcatgaataactctcaagttgttgagtttgaaaatgtaaaaattatatgaataaatttgtcttgaaaaatacttttataaaagcatgcatatatcactttttaataaataattttatagaaataagatatcaaagttatgttttaaagaccgtgtcgctgtccaaaacgacttcctttacgagtatggaaacctcgccgatttgtgataattaattaactaccgaaatgtgtgtgcggcctggggcgttgctaattcatccttcgctcggtcgctccattaatttgtaatataaatatatatccatatattttgtgtaaatgttataaagatctaacttatcggcggatcatcatatatactggcatgtaaacgttgcttaaaattttgactgttttgttacaaaatcaaactcatcactcatgcatggaccatgcatacctactcgttttatcttggttaaaagtaaacggtttgatgatccaacaaatcatagaagaggcccaaatacaaagtggataaaagagcatcatttgcattggctgaaattatttttaatctagagatgtagtaattaaggaactagctagcaaattcgagtaattaatatagctattattctctttaagctaattaagaaccaggcatgcttaaacttttgaaacaaatttatatatcaaaatacaatcaattccacctctattcagattactacttgtcgcatcaatgaacttccattcaaatttcttcttattttacctccactcaccctctcatccccaacaccccaactatcatcatttaatacagaacaccaaaatattttttaaattttaatccctgttaaataatctagaaatgttgatattttagaatgagtaaatttcacaaaactacagatactttggtcaaattatcacaaaactgttgatttaaagtgatgtattacaaaactacatatttaacactaaaattttcaaagaactatatatttaaggtggagtatcgtaaaactacagattaagtaacaaaattatcccaaaactacatgtttagtataaattcaatcataaaacttagacatttataactcaaatataacacaagtgctaaggatttaaactccaaaatctgtagttttgtcataactctgttactaaatctataattttccgatactccactttaaatatgtagttttgtgataaatttattattaaatttgtagttttgtgatacatcaccttaaatttgtagttttgtgataatttggctagagtatttgtagttttgtggtatttactcttttagaataaatggagtgttgtactttgactatatctatatatctatatggagaagacataattttcaataacaaatctactcatgatatataataaaatcaattaccttgtgcaattgggtaaacaaggtaataatgacctcattaattattctttgtaaatgtataagataaccagtgacattcatacaagaatcatgcactgtacaatatataattgcattcgtacggaggggcttggcacccttgtaaggagcaatcatgcatgtcgccaaatgtaatttctagccaaattaaggttcaaagcttgatgacaaattaaggttctatgaagtatagaagcacattatttttctttatgaaacacagcgcagatgcaaaacacttatatttacgtgtgtacgctcacacgtatgaatagatatgtaccttaccctatgaatacttcctagagaccaaattgacataaattgagattgatgaagttggaacagatgtctcgctatgaaaatcgataccatttgtacaacacacagacaatgagactattgtcaacactcaacactactatataaacatacataattttttaatcaaaaggttttttttttgaaaagaaaagtgttgacgttttaggtcacgactacggtatttgcatggtatgaagatcgacggtactaggatatatgcgagattgaagtaaaagaaattagacaatgatttttatacaaattcgggccccttcacatgaaggtaatgaccctactcccgttttccgaagccgatgttgctctttattcgtctgaatcacacaagtacaacaattgggataacctatctagctgtcgtcgatttggcgacatggatcaccaacacgtagtcgatgacagggtagtcttcctcctcgagtacgaacgcgtcgagatcatagatggtactagatcccctcttgtcggcctccacaggcactagattggatttgcctaggctaatctctaatgtcgatgtctggcttgtctttgcttgtgtgttgatttgttgtgtcttctctccccctagggggatttgtatttataccaatagatatcccattgtccaagtagaattagggagaccaaaatagatacaatctgaatagtacttatagtttctataaagaactctatttgttcttccttatccggaactctttttatatacgagatatgattccgtataagacttggtatatggtaagccccgtcgagcttagtcaattactattgggtatgtggtatccataaacatgacaaaaaaagagctagagcatataattggatgtacacaatccacccacacatgctctttcttaaaaaaaagtgcaaaccacaagttagtagctatattcgtaacgccatatttaaaaaaacagttagtccatttttatgctgtaaattactcgtacttatttattattaaaagtttgcagacttacacttaattacactgcgaattttactagatatatactagcaattgattaactacatatggaagagaagataagagagatagacatatattaacaattagatagaagaaaattaattaactgatgaaaaccaagtgaaaattaatgcgaagccctatttttagcaaaaactaaacctattgatcacgcttgtccgggaacctctcgtagcctgacatatgatcacatctctcgtcattctccctcctcctttctcacgtatataaacaccaccctcccctccggttgatcgatcatctcttgcatcgatcttaatttctcatcttttcgctctcgatctcctacagaagcaatagtagccagcaaatcaatcgatcgatccgtacaatggcggccctgaagatgaacaggatggccgtggcggcgctgttcctcgccgccgtggtggtggcgggcggcgctggcgctagcgcccacgtcggggttggggctggggctggggccgacgccggcgtcggcgccgccgtcggggctggcgctgacgccgccctcggggttggcgccggcgccgccggcgccgccggggctggagttggagctggaattggagccgccgccaacgtcgccgggtctctcaccggcgccgctgagggcgccgccggcgtggcacccaaggtgcatgtgtgagatcgatcgatcgatcgagcgcgccgcggcttccatctccacgactccatccgcccgcagcggctccggcgatccatatttttataaattcgcagtcgattgtttgttgttaatcaaagtttggttaatttatccgtcgagtgtttggttgtttatttcatatgcaaacctcgcgatttgtgataaataattaccgaaatgtatgtgtgtgtggggtgctaattcatccttcactccattaatttgttataaatatatatccttgtactagtgtaaatgtaataaagatcttaagttatgggtggatcatcatatactccccccgtcccaaaaaaaagacaaactctggtttccgttcccaacgtttgaccgtccgtcttatttgaaaaaattataaaaaaaaactaaaaagacaagtcacacataaaatattaatcatgttttatcatctaacaacaataaaaatacgaattataaaaataattcatataagacggacagttaaagttggacacggaaacccatggtttgtcttttttcgagacggagggagtatgtattgacgtaacgttgcttgattaaaattttgattgttttggtacggaatctaactcatggaacgggccatgcatgcatacctacacgtttcatcttggttaaaagcaaacggttcgatgatcgaacaaatgcaatatagaagaggcccaaatacaaagtggataaaagaccagcatttgcattggctgaaattgattttaatctagagatgtagtagctattattctctttaagcaaagaaccaggcatgaaaaaataagatagatagttattagcagtaaatttatatataaaaatacaattacttccaccactgttcagattactacttgtcgtattaataaatttccatcggagtttcttcctatattttacctccacccactctctcacccccccccccaacgccccaactatcatcattaataaagagcactaaaatatttttaaaaatttaatctctattaaataatctagaaatattgatattttagcatagataaagtattgtactttgactatatctatatggagaagacataatttttaataacaaatctactcatgcaaaatcaattaccttatgcaattgggtaaacagggtaataatggccacattaattatttttgtaaatgtattaagataacatgtgacattcatacaagaatcctgcactatatatagtgcgcacccggggcttggcaccttgtaaggagtaatcatgcaagcatgtcgccaaatgtaactaatttctagcaagccaaattaagcttcgaggctaaatgacaaattaagactctattaagcataggagcatattattttcttttgtgaaacacagtacaaacataaattacctatatttacatgcacatgcttacacgtatgaatgagtatacaccttaccctttgaatacttcctagagaccaaatcagcatgaattgagattgatgaacttgtcatggtcatggacgcctcgctatgaaaaccgatactatttgtacaacacacggatagtaagacaattgacaacattactatatgaacatatatttttttatcaaaaggatgccttttttttttggaaaaacaagagctaggagcatataattggatgtacacaatccacccacacatgcaaactttttctttaaaaaaacgcacatcctcaagtgactagttatttttttagcatcatattcttaaaaaaaaagttagacctttttacgttgcaacttactcttacttatattaaaagattagaaacttacacttaattacactataaattttaatagatgtactgcaatatttgtaatacacattatggagaattagaactaaggatgtgtttggataatgggaaatggagagtgggattaggattgagaaatgaatgaatggttaggattaaatggaagagggagaatgaatggttagggtgtgttcggacccaagggttcccaatccctctccatcgtattccgcgtgcatgcttttcaaactgttaaacagtgcgttttttgtaaaaatgtgtctatacgaaagttgcttaattaaaaaaatcatattgatccatttttttaaaaaaaattagctaatacttaattaatcacacgctaatggactgctccgttttccgtgcttgggtgatatgttcccattcatcaacagcgaacacacccttagcatttaaagataccttttgatgggtggaaaattattttcctatcccattatccaaacaatgcctaaaagtaattgattacctaagagaagataggagagatagacaaacattaacacattacatgagaaagataacatgatgaaaaccaagtgaaaacttactgcgaagccatatttttagcaaacacatactcacgcttgcccgggaacctctcgtagcctcacatctcgtcattcctccctcctcctttctcacgtatataaacaccctcccctccgggcgatcgatcgtctcttgcatcgatcttaatttctctcttcatcatctcgctatatacgtgcaatggcggtggcgcaggtgagcaggacggccgtggtggcgctggtcctcgtcgccgtggtggtggcggcggcgtacgtgccggcggcgaccgcgtacggctgcttcgacgactgctacgagcgctgcgccaacgggaagacggacgacgcctgcaactccatgtgcaagcaggcttgcagcggcgccggcggcggccccgccgaggcgcccgacgaggcttgatcgccgacgacgagcgccgccgcgccgccgtccatcgatctccatatccgcccgtagccgccggctatatatacactcgattatttgtttgtttgttgttaattcaagtttgattgatttaaccgtcgagtatctaaattagtttgttttgtttgtttaatttatgcaagctggtgtactctctcagcgatttgtaattcttgtgtgataattaagtgaatttgttcccttgtttcttctttgattaattaattaccgagatgccttgcaaaagaaagatcgatcaattaccgaaatgtgtgtgcgctgttaattcatctttggtggccaattcatcagtgcggtggaatccatcttacaaagatatttaatacttggctcgtaaaactatatatatatacatttttattatgtttagagaagagatattgggagtatacttgctaataaatatgggggaaggaaggaatagaaataaaaccttgtggtagatttatggtttgaacattttattatctcagttgttgtaggagatcgaatggcctctagatgacatgttttaactagaaactcatattaggctgaattgaactggttataagtggctattttgatgtaacaagtgttgttgatattttctttaacctatggcaaaacatgaacaataactatgttaatggatagctattgtttgggaactctagattacgttcatggatgtactacacatgaaaaagaagaaaagttgggtgtaaaattgaaagatagatatgttttttttagggggagggggtgtttaattgttactatctaacaaaagccaagtaatgcttatggcttgggcaacatatcctatacacataagctctcacgtgtacacacatgcacaccaactaacaaatatcataaaaaatctaaaaaatattcatgtatgtactttcaatagtattacacctagggataaagtcttaacctcaaattcgttatattttagttgtaacaaaaaaacaaaaaatctaacagttttaaggttgtaattctgtcagaattttgtcttttttactttctatgtagaattaatgaatttgaagatgtaactttacatgtagatgtaatactattggaagcaaatgtatgaatttttttagaatttttatgataatttttagttggtgtacacggtgtgtatatacgagtgcataggatacgctctctatggcttgctacccaaaattgaaagttagtatacaatgtctcgtttttcaagttttacggcgctccatcacaatgtttaattaagggcataaacaatagtttgacatcagcatttggaaaaaaaaactcatgatgttaaatattggaggatgtaaaagagagagattatcgttggtacaggtgacggatttgacgatgggccattggtttgatgtcaaaatatgcctaccaaactgttggtattttaaatagtaatttggctattgtttgatttactaccaaaatatgccaataagatacataagttaccaaaaacatttggcactactaaaattggcctataatttggcattgccaatatttggcatggtagcaaaccaaacaagcccgataccagtaagcaaattaaacaacacaattaagtacaaactttatctaagactgcattaattaattatgacacgaaaaattttgtactcctaaataacaacgttactaagagcaggaccaatagcaggctatatgccagctataaacacataacgaggagatgaaagaagagagagatgagcagcggactacagatttatagccagcagcaatacgggctccaagacgaaatgtatgtataacaggtgggactatatactaatagtgtagtatacgtttatatgctactattgcatgacttagctattaaattgactatagatgatttggagctagtaattggctatactattaaacttgctctagtcactttttgtgtcataactatgggcaaactaatagcttcatcttttcgcttatacttgtggtaattgtaacggctcattaactaataaaaaataattaatggacattttttataaatgtattccaagcgattttaaaacagatggtgtaaagtaaattactctctccgtttcaaattataagtctttttattttggtcaaagtcaaactacttcaaatttaattaagtttgtagaaaaatataataatatttacaacaccaaattagttttattaaatcaatgattatattttcataatatatttgtcttgggttgaaaatgttactatttttctctacaaatttgaacttagagtgattttactttaaccaaagtcaaaacgacttataatctagaactgagggagtataatagaaaaccacaaaatcaacttagattaagttttgaaatttacattttcactaaggcttataagacgaaaattaaacgatgggggtttaaatttaaaaaagaggaaatggatgcgacgcgtgttagtcgagtagccgagtccgacccaaaaacactcactcggcccacatcacgccaccaccccgacccaacccaaacttcttttccacgccgccgccgccgccgccgccgccccacgcccgatgccacccgccgccgccggctgccaccgctgccggcggcttcctccccaccgccgttgacctccccccacgccctcgccatgccccgcctccccctcctcccctcccgctccccccgccgccgccccctcctcctcgccattctctcgaacaccttctccgcgtccacccgcgcccctcccccgcctctccccccgctctccccgcttctcccgcgccgagccgacgccgccaccgccctcacccccgtcgcctccgccatcgccgactccttccgcgactggttcctcctgtcccgccgcggggccgcgggggccgccgcgccgcccgcggcgctcgacgcgatctacagcgccgtcgcggccgaggaggccgcggcgctcgacgcgctcccgctctccgagcagctcgtgctggccgtgctccgccaccgcccgcgccacctccccgacgacgacgcgctgctgctgctccgcctcaggttcttcgactggtcggggagccgcgggcggtactcccacacgcgcgccgtgtaccactccgtcttccgcctcctctcccgctcccgccgctccgccgtggtggtggactggctccgcctcttctccaacgccaacgcgacccccgccaggtcgcgcttccacgacacgctcgtcgtcggctacgccgtcgccggcgatccccagcgcgggctcagcatcctcggtcgcatgcgattccgcggcctcgacctcgacgccttctcctcccacatcctcctcaattccctcgtcgaggcgtcgctccatgagtatgctgattccttcgctcgccaccttgctgcaagtcctgtggcgacctgcattcgcatcaagagcctctgccgccaagcccgcagcagagatgccgtggctctcctggacaccctccctttcgaccaagcatccagtgcccctgcagctggctcgatcatcacagacttgtgccgccgtgggcgctttgatgatgcagctcagattgttgacaggttcccctccgctgatgtgtatggctcatggattcatggcctcgtcgaggccgggagactcgacactacgttgcagttcctttctgagaagaaagaagccgaggggtatattcctgatggacctcggtatgacaagcttacgtatcgcttgcttcgcagtaacaggctcggtgaggtgtatgacttgcttgtggaaatgatggaggagggcattgctccaggccgttcaaccatgaatgccgcgctttgcttcttttgcaaggctgggctcgtggaagttgcggcacacttgtatcggtcaaggatggagcttggggttaaccctaacaaggatgtgtacaacaatttgatcagggctctttgtcgggttggggacacagaagaggcgtgcctggtgttggagcaggctatggcagaagggtacttccctgggcgacagacatttaccatgtttgcaaatgtgttgtgtcaggaggggaagctagatagggtgcgagtgctccttgacagagcactcaagcaggaggcatgcccaacggacagtgtcttggccaagtaccttgtggcattgtgcaagagtggggatgtggaggcagcatgtgcagtgcctcagatggcaggcagcaaaagtcctaagggcttatatcgctacgaatcaacttacaagagcttgattcgggcattgatattgatcaggagggtggatgtactgccaaggctcttactggaaatgcaagacatggggcacatcccgagccgaagcctctatcagtcggttgtttgtgctttgtgtgaggtgagcaggtatgctgaggttctggagctgctgaacaaccagctgcaacggactgacctacacccccgtgtatgctacaactacttcatcgctggggctgggcatgctaagaaggctgacatggccagggaggtatataaccaaatggagtattctgggcttgaaccatcaggagacagcaatgtccttcttcttatgagttatctgaggagtaagcgtattggcgatgcactaaacttcttcaacttcattcgtgacaagaagacacctggcaccaagctgtacaatgtattcatatctggtctatgtgaagctcagaagccagagcaggcaatggtgttctggagggaagcgagggagaagggtttagtcccaagcatcagctgctatgaacagcttgtgctcctgttgtgctctgtgaaagattatgacaatgtcgtaaaggttattgatgacttcaaagaaacaggtcgccctgtttcggctttcttgtgtaacgtgcttctgttgcacacattgaggggcagtgaccttctgaaggcttggaaacgttcagagcaggcaacagtgaaaccagaagagatccagggtaagggggtaggacggttcttgattggcgaacttattatgatgtttgcaggtggtattaggaacatgaatgacttagaggatttagaagaggacctagaaaaacattttccagttgatgtttacacttataacatgctgctgcgagggttgagcatggtggggaggatggactctgcctgtaacttgtttgagaggctgtgccgcaaggggtatgaaccgaatcggtggacttttgatataatggtacatggcttctgcaagaatagtgacagggatgaggccgagagatggatggaagcaatgcaccgaaatgggttctatcccacatggtacactatgaggatatataacaatttagcgttgcgatcaactgatcataaagtcatctcatttgtataagtaatcatctctctgccaccgctttcatgccttggtctgctgtgatcctatgacttcactggaacaggtaaaactattatcagaaccttgttctatggttttagttatttaagaaggtactcggtgcgattcatttgctgttatgttttttgtgtaattccttctatgttttcttacaacacaagtcacattagacctttcgctgtgttttgcactctatcttggacacacattagcggaggtaatttgttaaacatgacaattttcagttggcagtcgcattcgagttccactgttaggaacaggcatgcagttgcttaataacatgtaaatacatatttatctatcctacttttacaagtccattttgtttgtacaattcatactgcactgattgaaaaccttttaccgcacatgaattggttgtgatcatttttagtctatataaatatctaatagaccaagctcaagttaatctagccttttgtattttccaagccaaggtaattcagtgcggttttctggatgtttgcaggcctaatttttgaacatcagatctgtacctgtggaagtttattcctaaatttaacatcactatcctctgaaccacatctcacctggcccaacacagttccaagatgcgtctaggatatcagttgacatgtaatctagttttacacaattttgcgatcacatgatatttttgtgcccagaattttgaggttttagctatccgatcattcggtattgtttcatttggttgtttaacaaccattagggccccactgtaatcagtaagttatatcaagcaatggtcattctttttcatctggaatttaagcactagaaaatagaagttgaataaatgcagattgtacaagttctgtatcaggtaagatgtgtgatatgctacttggcaacaacctgtaagttatatcaagcaatggtcattctttttcatgaccaccggcttttccagcttttggaagtggaacctgcgagttcttagttctttacatgctaactgtaacgaaattgcttttgccatcaagatagtattttctgaattgcttttggcagttcagtattcattttgctgccattctttgtttagtactcccgaagcactgtcaattgattgttttttttctgcttaatcatatatgttaacgatcttttaggttgtaaaattagcaaagaactaatgttggcacttcgaaggattgatctgcagaacagactaccctttgattatttcacaactttttataacgtacagtatcttgagataaaaactcaacaatcttttgctaacaattagctcgacggtgattaaagaaaacaatactattggattcaaaattcagttttataggctaacccagtgaactgcacgttgtaccatcggagagagaaaataaattgaaccattcagcattgatctttgcaaagaaataaatggatcacgtggaaacaatatgtacattacactgagcatgctagcaaaccaaactacctaaatttcgatcttatgtactatggttcattgaaatactcaaaagttcttgcactagtaggagcatcagattacacagcttattccacgaaaccaaaggtggagaaaagccaaaaattggggattgggcgtgatacaccttgagcttcagtcaatgtccaagctagagtatggctcatgaccaacctgcattggtttaataatttagggcatcatcagtctatgcatattgaaagagttgcgcacaggaaaagaaaattgcaactgaattcttatatatagtaacatgagcattaagacatgaggtgtgtaattaattggaagcaccaaatctagcacataaaagagcagagtttgcgtgataactggcaagttgttgctacttagtactcactgagcaatcatcatgaacacgccagattgtctcgcctaaaaggttagcaactgaaaggatagtcagctgcgggaaactcttgtcctccttgagaggtatagtgtttgtgatgattacttcttgaaacaaaccacttgataacctttcaatggcgggcgggctgaaaaaggcaatgtacaaatattataaattttccacagaaaaataacaaagcatgagtcaaatttaatgtcaggaacgttatctttgctgcatagtcaagtgtggtaaataattgtaacctctgtattgtttaggagaacttgtacaaaactgagttccaccaaaagcatgaataaagtatgtctataacataacaaaggattctgagcttctccatggtaaatcaagttcagctagcttactacatcaatatctactggaaataccatagttggtacaaatatagcatacctaaaaacagcatgtgtacagcatgcatagacttctcttgctccttcttgatgcagcagctcagctcctttggcaatagttcctaatttaattggtttcattagaatattgatatttggaagcgaaatatctcaaagaaaggcaaagagtaattttagttgtgtgtgcaatttaatgctaaaattaaattctcaactgccttggatgaatcatgaatgagaacagttcagatgagaacttaccagctgtatcaatcatatcatccatcataacagccacttttcctctaacatctccaataagattcattacctgtaaaaaaatgaacatgataaactgtagtggtttaatctcacaaagcatgaaaatttaaacaagtatgcaacatgtagtgatatagactcgtctgaaaatgcattaagtactataacatgcagattgaatctaggaaaaggtgccagagaatatttccttctatgcatcatcgtagactgcagttaatacacacaatatggagaagatcagaagaacttagaacgaactaagttatttttcctacttgcattcataaatgtttatcctgtataaaccagaaagcaaagaatgctctacttgcctcggcaacattgtgtccatgccttcttttatcaacaattgctagaggtgcatctgatagctttttggcaaaagcacgtgccctggcaacacctccaacatccggagacaccaccaccaggtcatctgaacatattgtcttgctggcgaggtaatcaagaatcacaggcttgacagatcaaagaatcaaaaagaaagacaaagttataatcataaatgaaatcacatgcaagcagttatcagtcaacatgcatcagtgcatacctgaccataaacatgatctactgggatgtcaaagtatcccatggcttgactggaatgaagatcacatacaaggacacggttcgcaccagcttctgtaatcatattagctacaagttttgcagctatagattcacggccttgagactgaaagcaggaaatgcttttgttagttttgacatgctagccagagtgctgtgccataacacaagtcttcaacaaattgagaacttcgacaatatattcttgtttcaaaaaaataagatgttcctcagatgttaagacaatatgtaatgctactgattcctgactgtgaggattccacaaatggacacatagactaaactttatacaataataaagtttgtccgtcattgctctctttgtggaaacaataataaagtgtagtgttacaagcatgtgacaaatgccactcaaaaaataaaatgatcccaaaaccactaagataatttggaggcaaaaaattgtatgacaagttgacaacattaccttcctgtcagctctggcataaccaaaataagggatgactgcagtaatattcttagcagatgctctcctacaggcatcaatcatgatcagaagttccataagattctcatttgcaggagggcacgttggttgcacaaggaaaacatcgcatccccttacgctttcttgtaactgaacatatatttcgccatcagcaaacctttttatgttaatcttcccaagttctaagcccaagtaacttgctatttcctgcagataagacaacaagaaaaacttccatcttagtttggcactgtgagattaaccattcagtcaaacaagtgctacttgtaacaagtcacacttaaatactactgctagacttcttttgaggaccagctgtccacttttcatagttcatggctatatgcctctttaagcctaattatgctcaatgtacatttttgcatctaccactactaacagtctgttttccggaagttatggatgaactgaataatattcaatatcttgatgttacaaccacagtaaaccacatagcccaattcgttgcatctgtcaaatttgaaacaagagaatgcaaagcatgaaaaagtaatgagagattcagctgacctgggaaagagaagggttggcagtccctgagaagatacgcaaccttgtatcattcttaatattcgcatcccggataatcggcagcgtcacaggacttaacaacgatctgttagacactggagcgtatggtggtattccattgactgccctcagttgatcaatcttcttgcacctctgcacgaccaaagatcctttcagcttaagtgtgcaggagtgcattaatccaatccagtacactaaattcaacatgactacacccacacttgctttgccaccttatagcaaaagaatgaaccccacttttgtttgaggcgaacaaatttaacacaaaaaaccaaagcacgcacagctccaaacaatgaacaagaatcgaaattccttgtgcaataaacacaaccctcccgtaaatcagccaacacaacctaaccaaaagtccaaaaccaacttaaaattcgacgcaaatacacctcctaagctccttgccccatcacaaaccatcgcaacatctacaaccctatcgataactgcatactgatcatcataccactgctgcattaggggataattttttttttcaaaaaaaaaaaaacagagcggggcaaggagggtggcgggagctcaccacgacgacgggggaagagcgcggcggtcggcggaggaggccgcggctgcgcgcggcgagaggggacggcgcggcggcggcggcggctgagtaggagagcggcatcgggggacgcgggggggggggggggggatggtcggaggtggatggctagggtttaatttgggttaagttggggtttacttccagccgccggattattagattttaaggacacttcgttgattggtttgcttgtacttttaccagtagatcgttttcttcttttcttttttttttcccgttctgttttggtttatgcagtcgtgtgatcatgtgtcctcggagaaaagtcgccatcaaaaaatgggggaaaaaacaagccagcattgatcagagctggagcagtgaagtggagtagtagagtagagtaactttttttttttttgcagggagtagagtagtatttctttttgtaaggttatggttttgaggtttttaattgatactaactggactgttgttgagaaattgattgttttatacttacctttatttttactactttcaaaagtctaacagtggttcctcgcaaaaaaaaaaagtctaacggtggttgtgagaccgatattcttctattcgagatgtatcatcacttcgttactatcatcataaaaaattggtaatagtatcaccataaaaattgtgctccctccattccaaaatatagggcacaactactttttaaatgtgtttcataatataaggcgtgcatgcatgcatgaaaattaatagcaccttatctctcctaaattattttttttaaaatcaagatgtttaattctattgtgtgcatgtattatattagttgagaattcttggtctttgggtaaagggtgattgtgccttatattttgtaatggagggagtattcgctttgttctattcgcgatgtaccgttgtaattctcgtatccttctggctgatcttttgcacagtcaaagaagtattccatctacgttcaaatccctcaatggctagtgtcaccgtcactgttcccccccccccccccaccataatgtgtggcttgctcccatcttagccttgtttggatcctctgagctattaaatagccctccaaaatcttgctatttaggagtattaaacgtagattaccgacaaaaccgattccataacccctaggctattttgcgagatgaatctaatgatgtatattaatccatgattagcggctgattactgtagcatcactgtatcaaatcatggattaatatacctcgttagattcgtctcgcaaaatagcctaggggttatggaatgggttttgtcagtaatctacgtttaatactcataagccctccggatctaaatagggctcttgtcaaaccaccaccaactatcctaccatttttctcgtaataccatcccttctcccccgccctcctttcctttcctgttatccggcttcaataaggctgtgttcgcatgcaccttttcccatcccctttccctcgttttccgcgtgcacgcttttcaaactgctaaacggtgcatattttgtaaaaagtttctatacaaaagttgcttaaaaaatcaaattaatccctttttgaaaaaaatagctaatacttaattaatcacgcgttaatggactgctccgttttccgtgcgcagaagttgggttcccatctcccccatccgaactcagcctaagactgtttgcatcatctatcgtaggagtctcggatttaggtatcgctttcaaaggatccaaatatttttgttgttgtcatttgacctaccaaccgatgtgtcccatttccgtgcaggttgtgctcttgcccttatccttttctcggatttggtgtgaagggctagagcagcaagtaaaagatgcacaactaatttcactattttttataggaaattgttggttgtaaaaatagcggtaacctacggcgaatgcttatcgttatcaaacaagttgtcaataaagattactactttgcgcttgattttaaacgatctgttgtaagtatagtgtgccctgcaagatttgagatcgtgcttgttatatatacattccattcttcaaaacattagtatcttctatcatcgatcatttatagtacaacctaagttcaaaagaaattaactttttgtgatgaagataaggagttcctaaaaagttgcatgtcacaagctagagactacggttatgcaactttttaccaattatggatggagattcataaatagactacaataaatgtgttctctcattgttagtttggtttatccgttttcttttatggtgtgttctatttctttagattcacatcttttctcaaatgttattatgtaataattggctgtagctctttttagtaaaggccgggatactatattccattatcttaaaaaaaaagttcaaaagaaaataacttttgacctgatttgtagcaagaagtttctttcttttcttttttactgagtaacacacaggcacatcagaaaatcaaaaaaaagaacttaggtctaaggagtagttcatagacgttaaaaaaaatgactttatgatatcctgggggcgttttttttgagaaatcaggatgatatcttagcattgatagacctttccttccaaaaatattaattcccaccccacaaatgaacaaacgctgttttcatcacaactgaatttataaatgtcaaatccaagatcgaaacactaatttactgttttttttcttttttcttttttctagggaatctttatcatcgtaacttctgtagttaccattttaccagtcgcacattcgcactaattttaggctaagggcttaattacccgcgttaatgatggataataaaaacctgcagcgagaccctggcgttttcttctcctcttctttccccggtcttggagggtctcatccttccttccccctccattgcatgcatgcgcgtcgcggttacaattaattaaaaccgcaagcgcatgcatcttaatcgcccccatgcatctccgcctaaattaaatcgatccatccatcgcctcgcgcaattaacgatccatcgatcgaatcgaagctcgctagatttcgagagatcaatacatacatctcatcaatttgggttgcatttgagagagaggaagaggaagaggaagagaggaggagaagagcaaggtagctagggtagcttgggcatggccggccgccggttgctggtggcaacggcggtggtggcggcggcggcggcggtggtcgcggcggcggcgctggaggcgatcaacgtgacgacggtggcgttcgaggaggggtacacgccgctgttcggcttcgacaacatcctccgctccgccgacgaccgcaccgtcagcctcctcctcgaccgctccaccggtaatttttttgaattcttcgattgatttgcgcttgagaaattagttaattaatccatgaattcatggatttttttttcctcctggttaatccgattcgaatccctaattggctcaccaggctctgggttcatgtcgtcgtccatgtaccagcacggcttcttcagcgcctccatcaagctcccctccgactacaccgccggcgtcgtcgtcgccttctacgtacgtaattaagcacaaccaccaattaatttaccccgttttgatgagagtgaattttaaattctcgaggaatcgttccttatcgattcacttaaatagttagaaaaaaaatagaaaaatgagaacatatattaacagtgtatcaatccgtaaatatgaaagttaaatttcaacttttaaaaattgtaacaaaaataaacaaactaaattatacaactgattagcgtatatttgcagttaaatttgtttttttcgttgcgatatctagaagttaactttgaccataaaaaaaccttttgatgagagaattttaaattctcgaggaatcgttccttattgattcacttgaatagttatggaaaaaaatagaaaaataagaagatatattaacacttgtatcaattcgcaaatatgaaagttaaatttcaacttttgaaaattgtaacaaaaataaacaaactaaattatacaactgattagcgtatatttgcagttaaatttaatttttttcgttgcgatatgtagaagttaactttgaccataaaaaagatgaatattatggaattacttaatatcaaataaggtgaggatttaaatccaagtcgtctagcccatcaccttgtgcagctagctggaaaacgactgggtgtttctcaaaatttgaccatacatatgtgtgatatatcacaaattagtctatctagttgaatttattgataatcattttgaatggtatgcaaataagaggggttatctcggagtttagaatttacatcaattaaactctaatttaattgattaattatattgcagacatcgaacggcgacgtgatcgagaagcggcacgacgagctggacttcgagttcctgggcaacatccgcgggaagccatggcgggtgcagacgaacgtgtacggcaatggcagcgtgagccgggggagggaggagcgctacctgctccccttcgacccgaccacggagttccaccgctactccatcctctggacgcgcgccgccatcgtcttcttcgtcgacgacgtccccatccgcgaggtccgccgcacgccggcgatgaccggcgacttcccgtccaagcccatgtccatctacgccaccgtctgggacgcctccacctgggccacctccggcggccgctaccgcgtcaactaccggtacgggccgttcgtggcgtcgttcaccgacctcgccctcctcggctgccgcgtcggcgaccccatcggccagatgctctcctccgccgcctgcaccgccgccgaggacgcgctgctcgcctccgacctcgccgtgatgacgctggagaagcagcaggcgatgcggcggttcagggagcagaacatggtgtactcctactgctacgacacgctgcggtacccggcgccgttcctggagtgcgacgtcgtggagtccgagcgccgccggttcaagggcagcggccacctccgcctcgccttccgccgccgccgccgcacccgccccggatcccggccggcgaggcccaccagggccgccgacatgtagcgcagcacataatcatatttgtttcatcatttcatcgtcgcgccttcgagtcatgggatgatcgaaacgggagcaaaagaaaaaaaaataacggacacacgcaacgaccaattgggcccacgaggaaaggagaaagcggccaggcccaatttggaagttgaaggcccattccaaattgggcctgaattctagtggttgatccaaatgtcatctttaattattgaacccgacgtggtatatcctaatctagaaaagcatatgcatggatataccgttccaaaatacacggatataccgttccaaaacccagacatttcatgaactaaagaacaccaaaacatttcttcggaagtagatagacagaggaaatacctcgtttcccacgtgcacatttttcaaaccgttaaacggtgtgtttttacaaaatctttactccgtccctctaaaaatataaggattattagttggacacgaagactaaataataggaggaggttgtgattggttgagaagtggaggtagctgagaaaattaaatgatgaagggttgtaattgattgagaagataatgttggtgaagaagttattatattttaggataaatctaaagggctaaaagttgttatattttaggacggagggtgtaataatcaatcaatcctatgttaattgttctttaaagtatcttctctaatcgtgtgttctcagtcactcccttgcaatcgatgtaatgcggtgacgtggcacacagtaggagtagcagtccaagtcatagcaaaaccagcggagcagcaaagtgagagcggcacacagagagacaggtagacgaacgaggtgacgtcactccatcgagcccatccagcaaggcagagctgatgctgaacccctcctccaagacacggcacgaaaaaggcatcttccgggagatactagaaaacttcacgacacgcaggcgcagatgccacgagcagccgctgcctcgtttacccaaacccaaacaccacctcctcctccgcctccgcctccgccgccgtaaaaccctcgccgccaccgccaccgcctccgccgccgcggcggatccgctcctcctctccctgccctgcgctgcgcggggcgtggtcgaggctcgacatggtgctgtgggagctgacggcgatcacggcctacttcctggggctcaggcggacctaccgcctcgcgctccgcatccagcgccgcctcatcggccccaaccaccccaggatccgccacttcgtctacaggtccctctcctctccttcccctccccacgccccgcgcgcgctctgatccgagcaatcggtacggattcgcggcgcggggacgcccaaatcgatacggattcgtccttgatttcatctttgttgggggaaaatcactggggcgaatcgcgtgtactacagtaccatgccactgggtagaaattgcgggcgcgccttccctgaaatctgtgataaacctgtcgtattgtgatgttgaccagcttcagttagctcagaaatgtcgctggcacaatacggggcgctaggttgggacattgccagcatttcgtttgggttgtccaaaccacagctttgctgctacatcctcacagctgcaattcgatttgtcatgttcattccgatgtgaccgtgtcaaccatgaaacttacttgcactatacccggtgttatacacaagtcccgtaatgaaatcttgtcaaatgctcctatttttgtgatagattgctcaacatggaaatatccctcaatcctcatatattcattttcctttactttgcaataaaagagattatacctgaatctcacactccatttatgccttccatccgcactttggtttgtactcatttgagatacagatacctgtaatactaatacgttaccttatattactaactatgcctccgcttttgcctaatgttactgaaccatgtaggcgtattgtccaaataaaagttcttgttatgtctctcgaaaaggagtatagtattgtagttttttggtgtattatataacctggaagttccatagcttgatgatccagtgtttctagcatgaaattgaatttttgatatgctgacatttttaaaatgtacacattgtactttatgctttccggcttgtccattgttgttcagctggacttgagcaaagtaactgtgatgatggatctgcatattgcgtacacaatcctgactccccatccatgtaatttttctggctaattttttggttttatgccatacctcacacgctgatggtttcaaccttgtccatatgtggatctaacaataatcctgtccagtctactaaatctgtccaattgcctttgtaaaaactaaggattgaaatgattcagataagcagttccttaaatggagtttcatcttcagttcttttgttgatccctgaatagttctagctaattaattactatagtacacaatattacatagtcatttcaattgattttacgtgaccaaacaattcttctctgcaggcgaacacgggatgttttcaatgttgcggtttcagtgcacaagaacattcagcagagagacctagaagttggtcggaaccttggtaacatgatccttcgctggcttgaccgcatgaagccctcagcacagattcgtccccatcctccaggcccaccaaatggcagctcagagcaattcaggcatctttcgagtacaagcaagagcacaggagctcagaagcctacatccaaaactttaccgtgcgatggtggaaaggtgttgttttcacctctgaacattcgacccaagtccttccctgttctaccgacaatgatgcagcccaccagaattagtgctagcagccagtgtaggcggatttcctactcatcattcccatcggccaccgctaagaggaatgatttcatgcagggtgtgttccgcaaggacattgcacagctcatggtgtgatgatctgtactgtcctggaattcaaagttcaattgacttagtttcgcgtagaacagaagtctcatgactcatgggtgatggatcctgcaataataaagggctgaacaagttttttgttgctcaaccagtttagcaaatagattttctaaccaatgatcataagacagtatgtggtattccataatggatatgtttactccattcgtccttgaaatgcgcaaaaggaactatgtaggattgaaacattatctcagattctcactacttcctcttcacttctctttttttaattgtcagatttccatttcagaaatggcactactttagagatatctcctttctccaaactgggagatttctttttcctaggaggaattcacctttaattttactgttgtatgacccacatatggaaatggttgaatctgttgctgttgcagaccacaattcctggaattttttttgggaagataaaatatttacttgtttctccacatttccttgtcaggcagcagtgcatggcaatagtccctgagctagcgaatgattccatatttcatatctgatatatgcactttattcgggagcttgaaaagaagtgatatgtgtcatttccacgaaaaattctcatcttttagtgcttgtacccatcggccaccgaataacgaatcgactaattacagaaaagccatggatgattagcattaccactgaccagtgtacatatatacacacactgactcactgagaatctctcatcagcaatcacaactgaatttacagtctataggctcctagaagattcttattccctatcaaattgtgcactttttttaaacttcggacagtcggtactaattgtgatcaaaattgtaacaaatgcacggtcattaagttaattagccagtatcattacatgacattttggtcatttctcatcaaaaagcttaaaatgcccttaacatgcgtgcccgtgtagagtggcttctataaatagacaagctaagctggctagctcgcccaacaacaagaagtgcataagtgacacactgattaattaagcaaaaaacagtagtagcttaatttgctaccatgtcgatgatcactagcatgctggggcggaagcagaacgcgcagcagaagggcggaggcggcggcgggcgcaccggcggtggcggcggcggcgagatcgagccggtgagcgtggacatcatggagccgttcatggacgcgatctcgctgacggcgttcgcggcggcgccgtcggcggcggcggcggcggcgggcgtgccgtcgacggcgagcatggactggaaggagacggcggcggcgcacgtgttcatggcggacatgcccggggtgcggagggaggaggtgcgggtggaggtggaggaggagaaggtgctcaggatcagcgggcagcgggcgcgcgccgcggaggagaagggcgagcggtggcaccgcgtcgagcggagctccgagcggttcgttcgcaccgtccgcctgccgcccaacgccaacaccgacggcgtccacgccgcgctcgacaacggcgtcctcaccatcaccatccccaaggacaacgacaggaagcctcacgccaggatcatccccatcaccaattaaactaactattaattactagctaatattccacagcttaattatcgagtaattatattagtactgttaattaataataattactactcctactactaataataagaagcatcatgcagcgtgtatgattgcattatatgcatggaatagatgtgtaaacaactcaccagtttgcttggtgaaagctgtggcataatgcattggaggaatataagaataaattttggtgtgtatgccattttaaccttttattttacaagagcctattggtaaatactccatattattattcggaccggcagatggagacctaatttctaaagatgtacggcctccctgcgttgtgccctgctggtgcgaaacaaaaatctaaaaagctcggcaagcagtgtgattccaacagaaccagctgccttgttaacacagcttttaattttttatctcatggttcatggatgtttcttctacacataaaaggattaaaagaactcatgcaatgttcaaatatatgtgcagatgtgcttcaaagagcagcaacatataccctctgaaaatactcaccaccaccgtgaggactgagaataggggcctgtttggtacagtttcaacttctaaatataactccaggagttgagtctggagtggagttgtggagctgtctaaacctagctccacaactctagtacattttgtgagagagctccacccaactccactcccagttttggtggtgctgaaactgtttggctgagctccagctccacctggagctgtgccaaacaggccctagatagtagtgagagagtcgagaggcggattagtgggccttaattgttagcctggcccagcccaatatggcccaagtatagagattcagagtttactgctccctatgacttttttcttcttgttctttttctttgttgatttttgttttttttatctatactgtcatgtcagctttgttagctacgtaagccctctacttgcagttagtaatgactcatgatgcaaggattaaggtaatatcggtgtattggagtactatataatataagaggttaattaagatcctacgtgttcgtattagctataagtttatattagagttagctcgtatacagtacatgagctaagatatcatctctatttttcttatcctctctttcttccacatctctatcagtgaatgatgaaccttaaaactctactctattgatccacgtcagaaataaaaaacgtataccaacttattaccaaaaagcaaaaaccgtacgatcagaccggtaaaaaaaaaaagaattgtctgatcttctagagttttcaagagcatgtgaagagataacatttattcccttcctctcgtaatataacaccctaatattaaatgagagacatgtattataattcacggataaatatgtcacattatatcctaaattattatattgtgggacagagggagtaccctatataacagccaacatttctttttttctcttcatatctatcctctacatatgtttctaacttgctattttaattacctgctctaaaactacaacgtgctctccactaccaataatcagtcgtcaagcaattaatcaactaggttaacttgtctttcctcttagctgtagctgctgtgtgtgtttttctctttcttttctcttatttttatttttaatgcagttattgcgtcgtgattaaattaatggtttgcacatggtccacatggtgaaggcagcaacgccagactaaccggttgccacatcaaatcctcaatcaaccactcagaaagatgcaataatctacctcattatatgcatgcttactcgataataattgccatcacctttcgtgatttgattatttgctcatccatggaccatataatctctccctctcatctcacctaccgcaaaaaaatagtattagtactctatttatccatctcaaaaggcaaagtaaagcaccacaagacaaaacaataatgcattttctctaagtgctttggtttatcctatatcaatttttttttaactttgaccaaacatacaaaagaatgtatcaatatttatagtaataaattaatttcattaaatatgccattgatatattattatatatctattttgtgttgaaaatgttgctatattttactacaaatttacttatacttttttttgaaaaaaataacttatgataaatcaaaacaacttattttctaactttctaaaatgaaggaagtacttaaataagcatggtttcttacatttacaactaattatttctttcgtttgaagacaaaatacccgttaacagacataagacatgtcgctttagtctcttattacttgtaaggtaaggtgtacatgtatgtttataacaataattagtgtgtacgcatttatatgagtttctgcctatgatgtatggaaaaagaatatattgtacaagcagataaatcaaatgagctaaagttatgaggtcaaaaaagagagagctaaaattaaactaaaaataataatagtactaataagctttacgcccttgtgctgcagtaaaaccccaaaagtagaagcaaaacgagcccacggatagcctcatcgccctattgacaattctacccctccgccgtcggatcaaccgcttcgcctccgcctcctcctctcgctctcctcctcatcggagaaatctcgccgccgccggcgatgggtttcttccgccggatcgccggcatgtttggaatctccagggacgacgccgaccaccacccccaccaccaccaccacgacggcgccgcgggggactccgccgccgccgccgaagtcccgcaggataaggtcgtcgccgccgcggccgccgcggcggctgccgggaacgtgcagaggcgcgggttcagcgtccaggtccccgtccccgtcgagcggcccgggcccgggccggtgctcgtgccctgtccccagggcgacggcggcgttcaggtaatcggattgtgcggttgtggtggtctcgcctgtttgcgcgcctgtgttagtacgatctgggagggaggtttggttatcggaagagcgcctcgttggatgttgatgctagtattgcttgctgaaaatgggcgaccttgctgtagtggttcccagaattgtgatgtagaagaacagtagaagagctcgaagcagtagctatttttaggctctaagaaagtcatgcaatgcaattcaattcaattaaattgtgctgccgcaattgaatctagtctcggctatgcggctatgccccattcgatgttagctttattataggattggttatgttaatgttgatttgagtgcagtcgtgagttcttcgactttgttctgtgagatagtattgtctctgcggttccacctcttgtggaggtagttctaccttcctcttttaacctccgtgaacataagattagtccagcgccaaaatacgctgcttcttgttctatgattatcttagtaggcaatgcatatgcgattggttaatgcaacggtgcgttttattaggatgtcttgttatgtcaaggaagatgcaatagttaagtagagagtggtagcttagcttactttggtgaattcttacctactaacatttatagtttgtgggatggaagaaaggctaggcacagatttccttggatggatttgatgagtagaggagctcacctaattttagacataagtggatcacctttgttgttacagatgatagaaggttttgacttgggtttctgccactgcattaattgttcagaaaattggagtgcataggttatatctttggcttacaaactctttttattgatatagcaaatctttcactattttacaatcatggtttcttcacaatggtgtacgtatttttcttcgagctaatcttgttacatctgattgtccatttgtgcattttgtcatctgatacttgtttggatttggttggtgcgttgttagcatgataaagtctttgtgatctcctctaaaaatacgagagcaatgctaattctgcaagtcatttaaaccatgaatgttattaagacctagcactgtatattgctagtggagcactctgggaaccattgttacatataatcgacaaaagttcacaaacctatttgcattataggaagttttcatgcatagtggacctcacaagtctggctgctatttatattgttgaaaatttctgcagatacaagttatggcatgcatcatatgggcatgcaaaacaatgaatatttttcaactgggaatcattttaattgttggtttaaaggtcatatttaatttatcaaatctgcgaactgcccaagtcgatacttgtgctgcagtgtatacaaggttgttatattaaatgtaataaattggaaaataccatttgggcattattgattaccaaatttactattctttggaagctttagataatgatgtatgatcgcgccaagctgccgactgtcaatgaatattatcaccaactttaccttttataaatttgttggtgcataatagacagacactatggggaacatctagctagtaatgttgatattcatacattcagagcacggtgttatactgatattatttggtgcccattcctcctttttattttgtcacaattttctttttgttgttgtggacgttgcacattttatattgtatcctcctaagatatttcatgcgagtgtcagctgacaattatggtacttgacggctactcttaaagcacatggccatcacaacaacctttttttttctgtagtagaacaatttcaatttggaatgacattcctttttcatggattggcagatgcagataatggtgtcttaccttttgagtgttttttttggatgtttgtgttttcaacacattgatatgttcccttatgtatttgaattaatcatggattctcttcaatgctgtcaacttgctgtggtttgctgcttccatccctcttatcataatgatcattggttttatttttgttcgactagggctttaggtggtatacaaggaagctaaggattgatgaggatggtgatgtcgcagatgagttcttggatgaagttgttccagaaatctcgatcaacaacgactcaactccagctggaagatatcaagtgaaatataatacaaaatcagctgctctagcaatgagaaagcaaatatccgtcattgatggtgacatctgtcattccttggagtaccaagggcgcctgcgttgggtgtgactgtcatgtaagcttgagttgtagtgtgctgtcacctcaagaactgccaatcactcttggccaaaggattgcaagaatttgatatgcgcgtctgccttggagcctcccaggagtgtggatctgtggagttcttggttgatgcgtcattcttaaatttgagtgttttgggatgcctggtttggtcccttgtaccactagcagtagttgtacattgttgaacttgaactgaacaattacaggagtaaacaagctactgctagaacagcagaaagggaatgtgtatttgcaaatagagccactgaatccttgatcaatctattttgcattacacggagtgatgtgttgattttattgtgtcttttgtttccattaatctccggaatttttacacatacatcttgtttaaataagaaaaaaaacaagttattcgacatatatttcccaaacaattctatgcaggacactagcacagtaaactagtttgaaaaattttaaccgcgacttaatcttgtacgaaatgatgcatgcagggcaaaatcttatttacttccttcgaaaactataattgtggactatatgtatcatatgcataaattgctgttaaatgattatagtacgacgaatggaagttatatagctatatttatgatgctacgtggcttcgataatacactatattttcaagtaaaaacaagtggtataaacttgaatagtgttaatgccaattatccgagaacggaggccataactttcacttgacttcttgacttcctttttaataagaataattaaatgagaagatagtatatgatctcaaatgattggattaataataaattaatcaattctttgatagtatatgatctcaaatgattggattaataataaattaatcaattcttttctaatacgaaaaatcaattgagaagatagtgatctcaaatgattggattaatgaataaaataataattagttgagaaaaaagatatggccaggaggaatccaagatggcggcgacggttgttgcagcgtcgatccgaggtgggccatcctatccatccatctcatcatcccatcgcccaatagctttcctccctcctcctccgctcctcgtccaccatggaccaggcccacgcccccttcgtgggccccacccggcagtcacccacccctacccacgcggcccaccgtggacgcggcccacgaacgcgaacccgacctcccatctcttcctcctcctctcctcgattcctctccctcccaatccacctcctcctcctcgccgccgctcgccgccgcaatccgctcgccggaggcggactcgccggcgtcggacgctgcctgcgccgagggcgctgctgcatttgtttgcctgtggctcgggggaagagcgagcggccgtgtgggcttgctctgctcgagggccgcgttcgcgtggtttctctcctcgtgtgggttgctagattaaggttggtgaatggtgaggggttgaattgtgtggcctcgtcgtgctcgattgcttttgcattgtgctttgcgtggattctgatttctcctccaatttaagctagtttgacatgtatccgatattgacgaggggtagatagaattcggtgaattgtagatttggtttggtgcatcataatgcatttggtgttttttcaaatttagtgggaatttagattagtgtccagctgaggaaatacgggatcgagacagtgagatttgtcattgcaaaatctatcatgtttttccccttctttgctgttcataccaggattgtttatttcacccagcaggtggcctttttgctatcacaatttatcaatatccgggttacaatggaatgagtgtgcgagtttggttgccgggaagcattgttgacgaatcagatgggtactaatgatcctggcacgccgtccaaggcaacaaaggcatcagaaccggtaactgatcactcatctactttctaaatgaaccttttctgcttaatttgtcttacctgtattagcctaagacaataagattggttcttattattattttctagtgccccttttccccatatgatgtatgctgttagtttttctcgagaagaatgctgtgttgctgccaaattaagaaatgtgtcgaacatttatgataaagcatgaattggaaagaatgtgcatattctgtttttatgcagattatttggactatattagagtagcaagatattctggcttgtattctatacttctctttgcatagataataataatatgcctatgtggacagaacgaatatcccttcacagtagaagtacagaacacatatgtcctgtttctttttcacagacgttttattttatttacctctttttatggtttcttgcttgcacattctcaggagcagtctccagccactacatctggcactacagctccagtttaccctgaatggcctggttttcaggttattgcatctttacttattaagatgaacttatagctttcctctactggattttcaatttaattttaacgacataacagtgctttatattttgttttttaaccttgaaggcctactcggcaattccaccgcatgggttctttccacctcctgttgctgcaagtccccaggctcatccctacatgtggggagctcaggtaccctttgtatcttaaaactttattggttccttttatctgatatctgttgaaattacgggaaaagtggcagtaggagctttgtgctatctggaatctaggtctggcttatccggactaggacagtgtgctaggttaaattggagcaacgtaactgaatcctttactaaatattattatctgtttttactttaatactcactggacacaagcatatagatataggtaacatcaaaatgtagatggtttcatctttcaaagatcagaagaattagctagtatgcaacatgtagattatggttctattgttaaatcaggtggtcgagtgcaatgcaaaaaattaagcattctgccggaggtaaaaaatggctatagaagttaggcaactgcaaactgctttccttaacagcatatttgtgtgttatttataactattttcttttgtacctcaattcaaaatattgtccctttaatttcagcccatggtgccaccttacgggacaccaccaccttatatgatgtatcctccaggaactgtatatgcacatccctctactcctgtatgcattttctacctgacagtcataatcaataatcttctctttgtacttgcacccatttattgacatgcttgtattaacaatgaactaattggtagggtgtgcatccatttaatcactaccctatgctggcaaatggaaatgttgaaactgctgtaagtaacccattttttttaaaaaaatattttggtgatcatcatgttcatgcaatcctgagatgcttctttcagggaactgcaccaggtgcttcagaaattaacggtaagtcttctgcaatgtcaacatcaaggttttttgtgcaagtaattcacatttatgcttctgatcataatttcagggaaaaatgagcttggcagaacatctggtccatctgccaacgggattacctcccacaggtttttttttttaaaaaaaaatatgagttcatttagttctgacaaaacctaatctcaggtagcttgaacatgcagtgagagtggaagtgagagtgaaagtgaaggaagtgatgccaactctcaaaatgtgagattgatctctatatatatttcattcaaatcacttatttggtgcattctttaggcaggaagaaaaatcattaaccttgaaagatagcctatcaaccctgttttatgttgctccaggattcacattcaaaggaaaatgatgtaaaggaagatggtatgtacttgaggacctatttatggttttgtgagacaccaatagagcatatttctttgtgtgagattaagtatgcatttgattatgtaggtagttctcagaatggcatatcacatacagcattaaatcagaacatgtcgatggctccaactcaaacgggtgtagtaatcgggggagttgctcccacaacaaacttgaacataggaatggactactggggtgctgctggttcttcgcctgttcctgcaatgcatggcaaagcatcgtctggttcagttcgaggagagcaatgggtacaagtcctttgacaacgagcgtttgcattatttttttgataagttttgaattaaaatccttgtatatggtaatagaatggtagtccacaaggcaagaaaaaaatttgctctactctagccataacgacttccataatgaatgttaaatccacttattttgggaatggggattagcatgtggcaagatgccatcttttaattttgaagggatgatttatatatttattttggaaagggttgttgtcttttgaagatgcttatttttattctttgcccttgtgtatatgtcaatgtaaagatgtcgctacttgtataatttaattataccttggccattttcaggatgaaagagagctcaagaagcagaaaaggaagcagtctaatcgggaatcagcacgtagatcccggctgcgcaagcaggtatgatgttaaattgttaacatgacattggactcgttattttcttcagaacatcatggatagtcttattgaagcaccaaaatatttgttccaggctgagtgtgaagagctttctgtacgcgctgacaatttaagggcagaaaactcctctcttagggctgagcttgaacggatcaaaaaggagtacgaggcacttctttcacacaatgcttcactcaaggtggctgagctcatgcatttcctgagtatttaatttcttcgtgtttacttgccctttatcatctttctgtgttggctccatgaaaaatgttttgcagctatgaatctaaactagtgaaactctgcagtattgctggaatgttggtccatgttgcaacgtctgaacctatttatgcatatgctcttgttgtgatgtgtttctttcagattgttttaatcttgttttggccacagatattgttgtctgcctcattggtgatttaatatttgcaggaaaaactagaggggaacagtgattcaataccttatatgaatgaacagaacgacaccaatggcacccaccagaagcaacaggattctgatgctcagcctaatgatgcgccttgagagttatcatcacgtgtagtagcatctaattgtttagctcatgattctagtaggacatcaccatttgtgttagatgaatttactaagcatctttctgtgccaattcgatcagaatctgacatggcaaattgtcgagaccaaactgtctcttacctctattccagttgcttgcagctccattgataatcttaacctcgagtagtttacctcgtattgtgcgtcaaaacgaaaaattaacattataaagatcttattagtctgtctaatatttgagttaaaataaacaaaaatactcagaagctttgcccgtatagcaaaatgaggatatgattatcagttcgattcaaaccaaaagctgcaacagcctatgcggttatctgattgtacatttccttctctttgcgtagaattacatagccccaaaatggcgagaaagcatcagcctctatgtacaccaccaggtaaaacctatttactcgccccagccaagccaaacaaacccaggaaaggaaaggccctacctattagtacaaaaatatccaaaagggagaaataatacagggattacaaaatttctccgctagctcgagaaatagtccccctagctgctttagctgttatttgcacccagctaattgggggcagaacagttagccgtcgggattttgcacatcctggaagctgtcaactctcgtgcaaagcacttggattggaatgatcaactgttgaatgttgctcttccaagaaactgtgtactcgcgtgcggaacttctgggctagttcagcgagatcgttcgccatctggatgttgatctcaccaaggtgtctcaatgggtatttgctcctttgcggcaactgatttgcgacatcaattgtcaaggttgcacagagcttgctgcttgtgagcacttccagtgttggctttgaaaaattagcatgcgaagctagtcggtttagaaggattagaacctctctcattagcaaatacctacagaaaagcatatgttcatcagttacaaataacagagtgcagacaactctaagctaaggtccatggttttatttttctgtatgattcttataatattatttgcatatatatgtatctgacttaaaagtatccagcggtaatttaatataagcatcaaaaggaaattaccaagcagtcacttgacaacatgatgcaattttgtggttatctgcatgggcagcctatctccacttacacgctactacctccatccacaaatattgagggattttgggtatgtaacataaccaaaatcccttgtatttgtggacagagggagaaaaaaggaacatattcaaaattgcagtttaggatgggaagttcaagatcacctttctttcaatagctcatgttctccatttgaaagggctgtgtcatattccatctgtgacgcaaggacttccatgatcaactccaagaaattggcaccacggacagtaactggacctagaagcacttcataccccaatttgccacttgaagctatatatgctaacagagtgacaactacccgacaaagcttgatcccctgaaaataatagttttcttagttgtccagtgttggaagtaaaatgtaacagtagaacttatgtcatcttttgtttctctctagaactccagctttaaaacctttaagaaataccatgcaacacctttttttcaaagaatggcaagtaacaatattactatttttcaatatatgcagtctatgttcttaataatatggaagttagccttcaatctaaacatctaaatgaaaatatacggtctggaagaggagcaacataccagagaacttgttgccctacaactcaagcattcagataggtccttaaaaattgagcttatagcttcttgtgatctatcattttcacatcttatagcttcaatctgctcagggctatctttacctccattgcatagcaacttcaatgtcgttgggcctaccagcaacaggaaatccagatatcggtaaagagagaaaacaaagtaacagaaaggtaaaggttttatcttcaaaatggaaaataaatactctccttcccaaattgatcatcatatagtggaaactaaaatttctcaaattgatcatataaccacatggacacagatttcatcggagtacaatcaatacagcacgggagaatgtgtgcatgctaaagggtgtaattgtgcattgtgttttaatcgatgcatgcattgtgggagaatgtgtgcatattgtgcatgacatcttgattgatgctgtttaaattatccttggtcttggtgcacaaacggatgatcaatttgggatggagggagtatgatttatgaccccaaaacatccagtattccaataggaatagacttgaaaagaaatatatatgttatttcttggagcacatttttttaacaggtatatagactgaacaagatctaattaaatcctggccaagcagccaagctagcaacaagactttgcaaaagggcagaattaagttcgagaagttgcaagggtccagactccagatcaccattttgcattttgcatgcatttaatgcaccagttattgtctgatgaagcgtttctgtagctatattctctaatactttaaatatttgagttggtggtggttgatagtcaataactaaacatgaatcgaattccactgcaatagatgggcacatttcaagctcaccaataaaacagagctatggagaaaaaagagccagtataacaggtattctaccagaggaagtgaagcattcatttagcctttaaaaattcttgaaacgacacattcatttctaaaactaatactaagtatatataagcctgacaacttacaattcaatagcaagaaaagtagatccacagaatgcttcttaacaagcaatccattttccttctgcaacagttgatgcaatttttccattacagaagtaaatccgaatctgaaagtagcagcacattatcattagcgtaaagcattgcaaccgattaaagaaagaaataatactcatgtgattgcttacttttcccgctccactttgggatcacttgtccttgcaatgataatcattatagataatgcatcaacacgaatattctcctccgaatgcctgtccgcaatttgtagcattgcagtgaagagtgaagtccagactgtaaaaggaagctgtgtgttttcagtgtgaagcccatcatggcttcttgatagactcgatgcatcaggtgtattcagcgaagtggagctacctttgtgactgttccgctccatgtgaacagtattgttaacacatggctcaatagaaacattattcctgatgttacactgaggaaaatcgtattaaagttcataagcatgagaacctatcattataaacaaggaaaaaataatgaacaatcgtattattgtatatacccacgttcttgttgtattgctgcctatgtcaaatacttggttgattacaaggcatctacaaaataaaaacccaccccacccaattctctcagaaataacaaatacaatggaacagaaaacaaagacaattcaccgtgctaaatcaatatcaatatctattaatatttctcaacatttatctgatactactttatttctactatgcagtgattgattgctcagcctggatgaagatagcagcccacaaaaattgctcgaagcacagctggtcagttaacaactataccttccaaggcatgcacattgtaagaatcaaactctagttttgccaacaattaggctaactgatttagtgacactaaggtgatactgccagatttgtatttaaatgtactttcattttctcatgattttagaattaaaagatagcattttccaagagagatttatggtcaaagttcaattcaagcaatacaaaactgaactgactggtaggttacagaagagaacattggtaaggtattgaatgcaatagtagctgctattctataagataaggttggctggtcaatatctgagttcagtgacgaatccaattatgaaatacacttccatggtaactagaaccatattcaatgtagtagtaaagcatacctctgattagacatcgttctgttattcagcaagtgctgcaagacactatgtaacatccgcagggctctactaacaacagcatcctgaaaaaaaaacagtaggtaaaaatgataattaagtccaaggaataagagtaattgcctaattggaaaattgactggttcaattcagcatccacaacacacacacacacacactacagaaaaacaaccatgacaatagatcacaaataaaagcctacttcagcttagatagttactgtatgtccaacaaactcaacctaaagttactgtatgtccaacaaactcaacctaaagccatgtaagtttgcatgtgagaagctattgttactagttcttcaaataaatcagcaagctaactgattctcagccggctagatatttccacaagtatatgatgaaacttggtttgaaactgatctgagtaattctgacttccttgcataataggaagcactaaaattgggttgtcccgaatgccgcatctattttttctagacctagtggggaagcccataatcatagacctgagaaatgtactacaaatggtaatgcaatgtaaatgactatataagcatgtaaatgaagttggataatcagttcatacattaccaacagcagccaaatttagcaatgcttcgagaagagtttgtataggtattgtatcactgctcgtctgcagggacaaaacagataatttgacaatgtgaaacattaattcaaataaaatagagtaacatggaatgaaaaactaaaagtaaagtagagaacactctaactacagtatatggagatgaatgcattgtccctattcaatgttgaaatctagtgcagactacagagaagatagtccgttcaagctgaagtttttgccttgattagtaaaagttcaaattccacaaaatagatggtcagttcaagctgaagcagaggaaaattaaaaataaatgtatattttctatctttggcatgtctattacctttatgatgatatcatatacttgggaaatagcatttctgaccgatgagctcgcttcagaagaggcttcacacttgtctagcgatcccgtagactggacaagtgtcaaaatttcttctgagcaagaaaccaggatctttgatatcagactcctccccatcaaactgttagttggcatgccccacactgcacacagattgctagagatacggtcaaccaatactttcttgtgctcaagatattcgttattccctggaagatctgtctgaacccctacagtcttgatttccttgtgtttgctgccttttgattcaaagcgaacactttcctagcaatcacagcagaatagatcactaatggaatatgctagcaccatataatagaaagcaatgtgcccaggcaagacaagctacctccaagacctcagatgcatatgtttgattcctttggttcaaacagagaccgtcttgaggggaactgagctccttgtttctaccatttaatgtctctgctcttctcgtggatgccaagcaagaatccccagtatgcaaagccccatttgcaggggcatgaacagactgatcaatatccatagccatactgccggcatatttgttagcagaacccctgaatacacaaaaagggatgtcaatgatattgagcatgcactcaaatacagtagccatggcacatgtcaattaacggttcaaggagaactatttcatttcaattcaaattgttctcattcagatagcatgcatggctaaatcatgagcgattccaggacatgatgagacaagaccatgggttactaaatacagcactagagtgtcacttacacatttgcccttctcaaactttgaatctctgcttctttagccttgatttcaaggtctttccttgtcctgtctttcttcagctcactgcattcgtttttctgcattcgaaattgaaacaaactcatctctagttgatcataccggttaacttaaatctgcattgatcatttcatctgttcacaacatcacattgtatagtagtcaagtaagttcaaatatcccagcgcccccccccccccaattgtattaggcaagtcctcatttgaaagcagactcaaactagagcaaaatgcactagctctgcgcagcattagagcacaacagaatcatctagtgagatacgcaccacgtcgttcatttgcttcgagacacgattcagctccctctgcagaagcaaacaagtatttcagatcacaagcattaggaggagcacaggcaagcgaagcatccaaacgagcatatgtttacaccgcacgcgccaatgcgccatcgcaaacctcaccttgagcctctcgacctccctccgatcagccgcctccctggcatccctctccctccgcgcgcccccgcccccgccccctctgaagcgatcagcaccggcgatgcccgacgacaccgcgacgatctcgcggctgctcacctccgccgccgggcgctgcgagagctcgcgcggaggggagaagtcacggagcccgacgtcgaatccctgcggatgctgggagagctcgcggggaggcaagaagtgaacaggggcggcggagaagacatggggcccgggggtgatgtaggagagcggaagcgcggcggcggcggcggaggaggaagggtacgatgaggtggagggcggcgggaggtaggagatgaggtcgggaggaggaggagggggagggggagtggggttagggttgcgggaggcgacggcctcgtcctgggcgcggaagagctcggcgaggaacttgtcgtcgtcccactcgtcgtcgaggccgtccatccccctcgcggcgcaccgcgcctcaccggcggcggcggcggcggcggcgcgaggtgagagagagaaagaggggaagtgggagagggtgggtggggtcgatgaagaggacgggagtgcggggttttgggctgcatttaatagctccccaccacctttgacgttggtttctctcatttatccttcggataaaccattcttagtactccctccgtcgtattataaattgtttaatttttttaataaaattttgataagtttaatcaagtttataaaaaaatttaacaatatctaaaatataaaattagttttattaaatcttgcattgaatataatttgataatatgtatgttttgtattgaaattaatagtatattttttcataaatttggtcaaaaacttaaagagaaatttaactaggaaaaagagacaaacaacttataatatgaaattaagggagtgcaaaataacaagaaagttaacaaggtgatgaagggcaattttcctaatgattagataaactcaacgtgaaataattttgaggagaaattttggattttctttctgtgatcgaccttgcaaagcctaacattatttgatgaacacacaatacttatcaaatccaaaagatgaagaggactcgggctccgattgtttgagttacggctgataattcataaaaatatgaatgaagcaatcaaaattaatttatacgcaaaaccttcatatctatgttttatttaaaagctaatgttggaaaataactgataaacccccccccccaaaaaaaaaaaaaatcaactctaaaatttatcaacggaagaggcaagaactgactgagcacatgctctatttatccaatccaaaacaaggcattcagaactactacatgtcactatgtcagaatcagcctatagcacgatcaccattagaatcttttccaatgatcaacagaacgaaaacttctctgtcacttacagagcaagaacaaggtagaataaaaaccgcaccactatatgcctgtaacaacagaagaacctatctgaatcctgaatccagctccatctatcagactagcacaactatagtttcttgtttctgtatgacgaatctgttggtgtatcttatcttctctagctaaccacccatgatctgcctgatggctgcacgctgtgaagatgacagcctcgtcgggaaggtcacatcaaacttgatcttcaggttccccttcttccccggttccttcctgatcggccacccttcgttcgcgagcacaatctcatgcccaggacgcacgacttcctccaccctgatgggaagattcctgccgtcaagggtcttcagatgtatggttgtcccagcaagagcatccacgagagggatcacctgggttgctacaagattgttcccttccaggaggtacacatcgtggggcttcagatcgatgacgaaggtgaggtcttgtggcaactgaccagatagcctatcgcctttgttgggaaatgttatctttgttccctttttccagccgggcaacacttcaacaggtaagacctctgtctcgatttctacctttctgcacaagattagacagtagagaagcaaaatgcttcagtaaacctattatcaggattaatatctcaagctatgcaatgctgcaaagcaagaggaaaaagttttctcattgcatcaattgtgaaagtataaaaagcgaaagtaacaaatcaatacatatccttgcattgcctatgctcttcttggttaaaaacagggaaacttcgacatatgaagctaactcaagaagcgcagaattaaattgtaaagctaggacaccaagtatgctgccagttatggcatggttttatcctccagaaactgttttcctatcaattatcaaaccacattgtgtagtgagcagtaaccaggattatcaagattaagaattaacagaattcgggcaaccattagccatgccaatgccaccaacaaactctttagttgtaacttatctggattccatttttggaattgttagcagatccaaacgaaggtaataacctaatatgcaaccaaaccaacagagtatggagtatggactgctcactgacacaaacgtgtggtgaaaaattgtcaaatataacaaattgttttgtgttcacaagtaactgtaaaatgttgttccatacacaaaataggtgccaggcacaggtgctcaaattcaacaccatataaatacgttggagcataagccttgaatgactaattaattagaacctaaatgcagttacatatttcttacaaaaatactggagttggcttacagtgcaaacagaaacttaacaaagagtgtcaatagcacaactcctaccattttggtatatttcaaaacccataataatgcaattacagaataagacacaatatttgaaacttaaaatttttcttacaacaaaactatgtataagttcacatactttaataaaggaaaaagtacgaattacccccttgaactattgcgatagtatgaattgccccccgaaccacaaaaccagacatattaaacctcaaactattgaaaccggacgaattacccccctgactcaatctggagcggttttggtcctacgtggcatacacgtggcgccgacgtggaaatccaatcagcaaaattaggtggtcccacatgtcatgctgatgtattttcctttcttccactttcccctctccatctcttccagggcagatagaaagcggcgcggcggtggcgctctccaggacggacgggtgaagcggcgacagtggcgactgcgccctccaggccgggtgggggaagcggcggtgtccaggacgggcgggggaagcggcggcgtcaagggcgggcgggcgaagcggcggcggcggcgacctgcgcatgtctttcttcatcttcttgccccttctctctcctgttcatctcctgccaacctgccctgtctcaaatccggccagccgtagctcatggaggagagcagagtagcaggaggtctagtgaagtgggaggatgcagagaagtgattgaggcaggcgtcgtccaaccactactgccgtccaccatggaaagggttacaagcaacagaatggcgacggtcaggaggaaaagaaaacatcggtgaggtcgtaagaaggtcgatggatgcactcgtcagtgctcttgctctgtacatcgctcgttcctgctgtagaagtgttcctcgatggtgaggctgtcagattcgtagctttcgatttgtagagtggctgcgcgcatcaatctctgaacattctttttttgaacgaatctctgaactttcttgatgtgtaatttcttcaatttctgcaagagcgatttctgcaatttcttcagatgtcatgtgtattcgatggttcgattatctgaatttgccaaatgttctcaaccccgcgcttcctcccggacaaatccaactgctagcccaataccaccaccattggtaccaggcgacacgggcaggggaagcggcggcgatgacgacgccctccaggtctagcgggggcagcggccacgacgccctccagggcaggcaggggaagcggcggcggcagcggatctgcgggaccatgccagcgccgagcggcggcgggcgcgccggcagcggtagcgggcgcggcgaggagcggcagcgacagatcgcgctcgtcgacgaccatgagagattccctgccgtcgacacggcctcggcgcacgtcccccggaggtaatgcggacaccggtgaggccagcttcaccaccgtcattccagtcgctcccgtcaccactcgccgcccatccgtgcctatcgccgctcgcccagctacgcccaatgccaacatcacagagaagaaggggttatatgacatgtgggccctatattacttttttttattttttgctgattggatttccacgtcggcgccacgtgtatgccacgtagaaccaaaaccgctccagattgagtcaggggggtaattcgtccggtttcaatagtttgaggtttaatatgtctggttttgtggttcgggggggcaatttatactgtcgcaatagttcaggggggtaattcgtactttttcctttaataaatgtgttcccacattaatgaaactccaatacagtaaaagaaaaagtgcacagtaaagagaaatcgtaggcatacatacccatcagtatttgcaacattcctagtgatcttcatcttcctttttgttccattatacaattcctcaagagtgcacagtaaggttttctcaatagctggtggtttttctagttgacttgtactggtactgctttccttatgtgaagcagaagatgcttcacctctagtgttccctgctgtccactgtgatcgtggttggaaccgcgttcgttcttggtcgaaggagtaaggtttgttgcttgccatgaactcagcaaagaaatcatcagggtcgctcggattgtaccggaaattactaggaccacttgagccagcagctgcggaagtccggctctgtgaaccaggtggaggcattccctttaagccttcttcaccatatcggtcatagattgcacgtttttctggatcacttagtacctacaaaatcagccagagttaattagaaaataagatattgaagtgagtacactacaccatgacccaatattgcatcagaataggttacatcatgcagtattactatgcgtttgacatagttgcaatcagaatacaaatgaacatacacttttccctcacttccgtccgtattttactagttcaaatttcagatcgatgttatgataaactaattataagttagggaaatgaacttatgagatgctggagtagtatagcgctatagcttgctacttttcaactgaagtacatccacacttccacagaattgaaacagtcttcttttgcggtagtactttgtcagccacttgaattgtcaaaagttactcttttcctcatgtttcaaacaagagctggaccaaaggtctcatgttgcaaattaaaaatttatcaagatggatcataagcacagcagtaaataaaagaagggccccttgtaaacatggaatgaatattccaaatgtggtatctgagtacacttggagatccaggttacaacaagcttgagattaaaagctttgtataacacatcatccacccaaagctatggtcacagtcttttagtaccactgaacggtttatctccttagttacactacgaaaaggcaggtattaagataccattttgaggatacaaataaaaggaaggtccatcatatctctactataaatgctcagttgtcctcctatggtcctaaccacgcacgcccaagacaaaccgccccccacaaaaaaccgcccccatagaaaaccaaagaacgctatggacaaccattggtccatagaaaactcaaaccgtaaaatcattggcccatcttctcctagatcccgttaagatgcatgggcatgtccctagtcatcatttattaaaaccgttaacgctccatagccgccttctgacatcaatatggcaccaccatagttgcaccaaatggtaagtagctatgttttcttagcaaacttggggagcataccccaaagcacatcatatcacaaggaaaatggatgcacaaaattcacttgcctcataggcctcagttatctgcttgaacttggcctcagcctccgcgccgccagttggattcttgtcggggtgccacgtcctcgcgagccgccggtatgacttcttgaggtcctctaatgtcgcattgcggttcaccttgaggatattgtagtagtccattcccatccttgctctaacaaactggcaaacaagcaatgaaaacctatactcctagagcttcataaacctaaatccagtggaggcccaacaaattctgacaagaaaggaaaattttatcaatcgacccttccaaaatttactccagcatggctgccgaagaatcgcaacgagagctaccgaatcagtgaaaccgatgtaaaataccgagatgctccaaacccagaatcaatgccgagccggatttatgcggtagcgtcgagaaatcgatgaaatccaccagagccacaccgaattgctcctcctccggatggccctgaaacgcagaatgcgcagacacacacgatgaggcgccttgttaggttacgctgcggtttcgaaatgcacacacgcgattcagccatccaacgcaatcacgcaccaacccaatcgtagatctcacctcgggtttggcggcggcgcggcaggtcgtgcagggtttgggttgggggttggaggggcagaggagcctgcctcgcgccggcgacctccgcctcgatgcgcctcgccgacgccgcggacgcgggatgactcggtggtggtggtgcgacgaggggcgcagaggtgaggtctcccgctccgccgccgccgccgccgcagccgccgtcctcagaccggtttgattacacgtaattaattggtttttttgttttcagatggtttttggtttgtttgagggagcaacaaggtgtttgtgggattctccgtactgatcgctttgtcgcttggaaactgagctttctttctggccctgtggatgttgggaaacttttagttttttttctttttttttctactaggggtgattttgttgtaatctaaaatgtaatgtttatgatgttaaatactatctctgtctgaaaatactcgtcgtttttaagtttttttatagcatttgatcattcgtcttattaattattatttattttgtttgtgacttaagtacgacttatttttttttatatttgtactaatcttttaaataagacaaatggttaaacgttaaaaaaaagtcaagacaacattgaatttgagatggagggagtagtagtagcagcttcttgggatggtagtggtaaatttgttttgtgtgtggtttttaatagagctacagttcgagacacttaatcatatttattttgtagagtaatatgtttaaatacttcctcagaacacaagtttaagaaaatatatgagtatgaaaaacgtatactttaataaaaaaaagtattttatcgaagaattgtaaacacgtaggaataatgattatttagatatatcataggaaaatgtaagaattgggtgtgagaaagaacaactcaaatgaaagttctcctgaggttgtacaccatgctattttttctataaaaaaaagaaatcttcttgtctctagtcactctataaaatattatatgactttcggtgttctggccctttgttcagaggttcgatagaaaaacaaattatataagcttgctatattctaaaatggaggaagtgtgtttttatacaaacgtcaaaggataaaaaaatttattattccatcgtggcttcatcgctaaagtaaaaaaaatctatcattattacttctattagattttgggcatgtttggtagagaatgcagtgttgttacggctacgttgcagccaaacaaggcgcattctctgttgttggcttacagatacatctatgcagttgcaggaaaaggacagctggacatgcccttagtacatttactcttttaaaccatttcaataacaatttcatactctgttctatcaaattattataaactaccttactatattcgtattatgtgagagtatttttcctgttaagtggatgcttcaatgtgatttcaaaatactaatctcgcaaagataaactaggatgcagatgcaagtaaaccatagtttccttgtaccatatatacgtagagttaaaacaacaattcacattgggtgtgttcggaggatattttttacagcgtagtttaaaactgccgaggcttgcagcgactttgaacgacaacgatggctgccttgccaagtcattatacattagagtacaaatactcgatatcgggaactaataaggctaatatatatctatttcacactaaactgactagtaaaagtatttaggttttagattaaactagttctagaagtgtttcaaaccaaacggaggaaagaaaaaccatcaaggcagcaaaaaaaaaaaacattccattctgtattcctgcaaccgtgtgtgcttttttcctgggtctcgtgccagaaaaaccaaactagtactcaagaaaaagaaaaaaaaaacacagagaatacttgcgagctccgatctcttcttcttcttcgtgagctctcaccaaaccaaccccaaccactgccctcctcctgccgcgatccactcctgctctccagctcagggaatccacctccacccgcagagaccaaccagcagctgtccgtcctctgcggcggcggcggcggcggcgagatggggcaagctctgcggcggctcttcgacgccttcttctccaccagggagatgcgggtaccgtgcgatcctcacccacatcctctctcccgcggttctcctttgcttcgtgtgtggttcttggccggaatgggtgattgattcctcctgccgccctgcccctgtggctgggattcttgcctagggttttcttgttgaacttatttattattatacctaggagctgaaatctcgactgtgcaagaaataggttgaattttcagtggtaggtaattaaatcgtgctagtggttaattgggcaacttttgagttcaagtgggtaagagaaatactagcaccctagcagtgtacattggcaatggaagggtttaatttagtcttgccaactcagttaattttgcaaaggatgattatgacatcggcgaatttgttatgtgatcaattttaagagaacggggcttttgccttacaagttcttctaatccacagcacttatgaaattcagaaaatggaccggttactcggcttcttaactaaacctatggcaaccaggatgcatcatctcatcaagtgtatccatagcattaggctccgcatccctgtctatttaacttgtgaagttggagattatttgaatgttacatgtttttcgctgatagtgtgattgacctcttgaaggttgtgatgcttggtttggatgcagctggcaagacaacaattttgtataggctgcacatgggagaagttctttcaacggttcctacagtaggtacgtggctcaagctcaatgactcatctaacgcatcgtttttaatgtacttatttatgtatcgtattaaatgatcgtagattgccatgcagactattgcagtacttgacacttagcttcagcttatatgggcaataaaagtacatgtccgttttttgggtggttgaagggatccatgatatgattttcctgctaagtacagggtcgacactcaacagtcagaaataaaccgaaaaacatgaccgacgatatttggttaatcagtgtacagggcatgcttggcaggcataactgttcttgtggaattgatttggaaactttaagcttacaactgattgtttaaaaaattaattacttcaaatcatgtatatttccaagaaagaaagtgcaatatgatagaagctggaaactggcttgacgtttcttgataaggtattagtttgtagtacctcctggtaccttggcatagaagatactgagaggtgccaaagatttacactaaaaagtatattcttgaggattgtaaaaaaacaaggttataaaagcctatatattgttattttaatgagaagccttgctatgattttggacatcaaacttgatacaataaatatggtcactctatgtgattattagacaaccttatatgtacctttcctctacagtttgggctttgggcagtaaagatggaaaacttatgtaacaaaaatacattgttggatttggtttcctcgttatgtgggtggtacttttttcctttcaaatcacgtatcactcaagacagcttttcctcaatccaattgaggaagtagcacagatttgtttactttttttcagtcgtttataataaattatataattctatacctcataattcattgatgtgctcgactttttcccaatcattgatctcatgtctatatccaataataccatgtaccctctgcaggttttaacgtagagaaggttcagtacaagaatgtggtatttactgtgtgggatgttggcggacaagaaaagctcaggccattatggaagatgtacctcagcaattctgatgcactggtaataactagtagattgaatttatatacacatgttgatatttagcttggcaccttgtcattccgccctgttatagtgcctttagtactttcccaagtcttggtttgatattgtcatgcacatattgtttgttttcagttcaggttgatatcatatattagcaccttttgcaaatttttttcttgtcgttgaatgtgtccctaaagcctttcagtttttaggtgaagtttgtaaatcgatatgaatgacgtaagcgaggagcgtctagtcttctttataaggacatctctttagctaattcgattaggtgtttcatgacaattccaattgctatatgcatcatatgcatatcttttgctgctgaagttaaggatgtctttctgctttcaatttgttgttttttcagatacattattgaagccatacatttctgtcatatttatgaaatttgttgctttcaatttgttgtagatctacgttgttgattcattggacagagaaaggattatagacgccagacaagaatttcaggttagaattatattatctctgtcattgtagtagttcctgtctccccaaattatgttggctgagaatatgggatcctactaacttggtattcctttacccttttcagaccattatcaaggacccactgatggcaaacagcataatcttagtatttgcaaacaaacaggacctggtaagttaaaccaagaatttgaataactaatgattaattgcttgcctgttcatgacctcatttacacaccttttaaaattactgtgtcgcgtgttcattctttttaccagcttgtctgttattatgttcagtatcgtctttgtttatcatgtgcagtcttttttattatatatagatctccttacaaaattctccatttctttttgtatgatgttggttagttcaatttacattatgagatgggggtagtatgactctatctgctacatattggactaaagatctgagttactttcaacaatacacggtgttgatcgtgctgtcagggattttgtactctgatgaggctttagcttagaaatatcaattctttatgttccatattgctaactggaaatcaatgtgtagatctgttccactgttgaagccatacatttccatcagatttatgaaattgtcaaatataagagtggtacttatagactaaaatattatcttcacacagagaggtgcgatgagcccagatgaggtgagcgaggggctaggcctgcacgacctcaggaacaggatatggcatatacaagggacatgcgctctccgtggtgagggactctacgatggacttgattggctcgcatccaccctgaagcaattgcaagagacaggccatgcaacttcagtcgccggcccttccatctgatttcgctagagaaggtattgtctcactttgagtgctgaccttttttttttcctcatgttctctttcttgcacctgacatagttaccacttacactacctgttctgttccccccagagatgccaatgcctcaactagtcaaccaatctgatgctcctgggcagtcatccttctgttcatccaatgagaatattgagttccttggtgcatgcgtgatcttcgctatcggctttcttggtgtggctgctcgcagaggagggcattcaatcgctgtgttcatatgagcaaactcatttgacagtaacttgcggcataattttctcctaaaatgtttgtaaagtgtttggacgtctgtgtactttgttgtagtgaacaagagctgagtagtttgcacggaccgtgcttgtgtatacttgatggcacgtccacatgattgtttgctgattgcctatcaataagacggttggatgatggatgttgtttggtgatatataaactgggctttggctgaatgttcctccttatgattgttcacaagttcagagattgttacgttggtagaagatatgcaaagaaaagaaaagaaaagaaaagagagtgatgtaggtatcctttgcggcatgggcaggaatgttcagaattagttacatttagtaatgttccgcagaaaatatagcatataaaaagaaaagaaaaaaaaaaggagcggtgtagtaggctactagcctttataacatgggtagatgcagtttgagaaatggtagggagaaaaaaaaaacaaaaaaaattgaacgacgcctgagagattcgaactctcgcggggaaaccccatgtacttagcaggcacacgccttaaccactcggccaaagcgtcgttgttgaatgcggatacagtgtagaaacagttataattttttgtcagaacctttcatactccaaaaatacctacgtcagcgttgggacccactgtcatcctcactatttagcggtagtacaactttttgtctgccttggtttcatcggtagccacgtggcttactcgctataggccgaaaggcccacatacgattgggcctcttaggccattcccaacccaatgactaggatagtgtccataatattaaataaactgtcacataaaataaaaaatgatgtgacaagtgaataaatgaggaaagagaaggaaaccatgtcagagacatagtttctacacaacatccaaaacatcatttgagataaatatcattaaatttaagtatgaaatagtggtgtttgcattaaaaaagtagtgtctagtactagtttctttgataatgtggagtttatgaaaactatgtctagtgttttaggttggggatgcccttagtccacggcccacctcgagaccatgcttgtctgcctgaggtttcgtttcattttagggagaagcacagcttcaacagccagacatctccacagaattcagaacaaaaaaatttcatcctagtaaagatttccccttcccttccgtaagttcatttccatcgtgttaataaatcaggttccaagttcaacacatgctaggctacagatgtgtcctagccagtccaccatgccgcaaattgtatttgtacatcaatgcacaacaagtctccccatttttctcctctcccagcacatcacaatgtgctatcagcgtggaatcatcaatggggagatcttggcatttgctatcagtctcagtagcactgctgctgcatcgttcacgtcattgctccttccagatgcggccggtaacccgcagcttgagctcctgcctgttgccgccggagaagaagagggccatgttccggtggatgatgaggccgtcgaagctgtcccggaccttcttgtggctgtccctgatgctccgggggatgccctgccatgtcagcttccgcccgttcccgcccacctccaggctgtagcagaagttccgggcctcgctgtcctcgcccatgaacctcaggaacgccatgtacactggtgccatccccagcaggaatgcctcaaaatgcaggcagaagtgctgtccaaaacacttgaaaacctgcatggcaacagaacataggggaaaacacatcaatatacctgatatagacttaaccgagaaccaataatagctgatttcaaaaaagatggtaatatgatcgcaccccagaatgaaaaaaatatatatatgcagattgcttgttatgcaaattctatcctaaccagcatgacacctatgtttgagaatgaatggctagacaaattctctttacatatctgagaaaaaaaatgcattggggtaccacttaccgtcagcatccatgtagcgttttccacttcataagggttggacttcacataacggtggttaaaggtgcagccttcatgcaagtccaccttatggtcgtttatgagatgagagacaagcatcggaacatcgccagcaatcaggcattctgaacctgcatatggacaactatatggcctgaacctgcagagctcctcatgcttaagtttgttttggtaaggatgaatctcagcacagcctaggctttgatatttgcatggaagctgaagtgactcagccaccttctcaagagccaaacatctgatattacccagttcttggcgacaagtagggcaatgattctccaccctatgcttgcagttagagcatattgtgtgaccatttgggcactgcaagaggaacacaaatgaatcaattgattattacctttcttactttgtgtgttcacttttcagttcacagaagtcgttccaaatatcatgatccaagaaatataacaccagtgctacgaaagttatgcaataacgcctacagttcattcaattcgaatgaaagaccagaggtggaggcatttacaaagttgaattgaatgatcacaacaaacttacacaactcatctggcaaagaaaggtaaaataaagtacaaacagcattatatacacaggtggagggagcttgcatacaagaaaaactaataatcgctttcatgaaaacacagaaaagtcgtgcaactgttgagagtagacaacatgccaatgttaaagaatgcattgctattctttcctggacagagttttttttttatcaaaagggtggtacccctccatttctatgagcagaaatgtgaaagtttcctggacagatgaagtcttgaacattcacagatcactttgaagatcatgaacccagtattgtaaggacagggacaataagcacaaaacaattgagttacatgtgcaatgtaaaacttgtcaatgattagaacatagaaattaaagaacatgcactattatactaacaaacggctgagtttattgtgaaaacaggacaaagcagtcaatacttgtcttcgaatgaaagaacaggtaaacttcaccaacacaacattcaaataacaacaaatccaatgacaacttacatgtcctaacttggtgtatgtgcaacacatataccttgtatacaaaatatattcaaagtaaaatgtcaaaagtggtgggaccagtaaagctttctagactgatcccacttaaatatccaatagagctagatgaaaactagcaactacatttttctcaggatgaaatgtgcaattatgtagatggaaataatcaaataatcagctgcctctgaaggatcataaagagaagaagatatcatcagtacgcaaacctgcagtataggtgggcgcattgagtttgtgcagactggacactcgagcaaatcattcaagcccgtcagcgatgatagctcaactgtgacaagtgatgtagaccagggcttgcatgtagaatctccatcaagcctaatgccagtgagtgcctcagagagcccatcagatacacaatccgactcagggatatcggtcacaatgctgcttcctggggccattgcaaaagcttctttcacattgggaaacactacaaaatatcaccacacccaccactccatccttccttgtaattagctgcattgttcagttagaggtatattagttgagattacggagaaagtactcagtttttacacaaagaaggcagttatacatgacaaaattaagatgctgcacgaatgaattgacaattttcaatttaagagcttcatgaagtctacatcatagttcttcattgcatattaaggtaaaatttactgtctaacctactactaattgctaactgccatcaccaacagcacaatccaactacacacataactctgttcagagcaaaagtacaactaaactcagtcaaataaagaccacctattccggtgaacctgatccacaaaactatatagctatagagcatgaacacattattaatgctatctacttcgtccaatctaacatttggatgcacagaaacaatcaacattctcaagaaacagtagaactgctcacttgctcagttcgtctccccaagcatcttatttctgcttcaagattcactggcttagtgcatagaagttactagaatcctatcagaaatcaaattcactctcaatcaaacaacttgctgccccctcactgtcacccaacctcaaaattgggctcggaattttcccctggaccgcgcaaaattttgcccctctcactccctttacaacaaaaaaaacaagagtcccttttctcccttgaagacttgcatctgcagcatggtcgaatctgcataaacaaacggctctcggcgggatcctaccgttaccagaactggaatctacatcagttcatccctcgaatcaaatccttccaacgaaatgccggttgcacagcagctcgaccaaaccgcgcaaacgcttcctcttttgcatcagatcatctccagtcgtcctcgcagcgtcagctatgaatcgcctcacacacaccaaaaaaaaaaaaaggaaaatccagcgagcggaatcgctccatttcacaccaattactccccccattccccatcaatctcgcccatgcgccaccggatcaccgaaacggcggaacacacacccaccctcctccaaaatcaaccacgaattggcgaattcgaaccgcaatagaacgccctcaaaatccccgtctcgaacaaacggggtgcgaccaattcaaaccaaatcacacaaccaaaaaaatatttaaaaaaacaatctaacacgcgtctccatcgagtacacggaacattccgtcggtccggtcaagccgctcacctggagaccggagacgccgccgccgccgcgaatcggagaggagagagacgacgacgcagacacagtagcagagtggagtagagagagagtactactagtattttttttcttttctttatttttttatttactccttttattattttttattccgcgtttcctcttttggtgtcttcgcggaggcagggggatctggaattttccgccttccacggcggccggcccacctccccacacgcccggtgcacggtggacctaatgggccggtggcccagtggggcccaagagtcaggggtgggtgggtctatggacgcggtgtatggagtggggtgaggaggtgtgtgtgagagagaaagaggccgtggtgggcccgagatggcggtggtccagttgggtcggggtgagacctgtcgggaggtgggcccggataggcggtggcagaggccggaagtccggaacgccatcaagacgttgcatgtatgtacagtacagcttgtctgctttcgtatatagagaaattttaaggtcttaaaaaatgtttcaggaggtatctaaatttttcactgatatttttaatatcttaagctacataaagtctggagttatcaaatttcacactaagcatctcctgataccatttcaaaaatgataaaattaccctagcatatatgtagagcaccatggtcatatcacggacacgatcgacatttcattcgtttttgggcctgttcggtggcattggctgctacagccactgtatctatgtagctatagtggctgcggtagccagccaacaccagctgtattttgtaggggctgcaggggagtggttttttctgcaggggttgaagccgtttccacagctgaacggctgggttgtgaagcacagctcaaacagctgtgaaaacgggctaccgaacatgccctttatctagttagttgagtgtgcaggtaataagttgtacccaaagtctccatcgacaattttggtcattatattatagctcgattatactccaaccaaaattagttatataggaatttcggtcggagtacatcgagttattccagttgcactacgtggtagcctggtagggcttgagacagaggaaatttgacacgtacaaataccgttggcaactgtgccatatttctacgctgtggcatatctccaatccaatactctactctacttgttaataatagacattgtttaatgaatgctgctatacaactcatatataattagagacatataactatagatcaattgaaggagagtatatttatatgcactgcagccgtttataaccgttgatcgaattcggtcatacataaatcaaacacttggatcgtatgcaaagcaatttccattccaaaatttcaagtgtactgggcttaggagacatgcaagcatgggccgtccgttgagcaatgccattgttttatttggaccggaacacaatagcgaccggtgaagtcgtgggccgtatagacattgcatgtacaatatcaatggctagactacaggggctacattagcagttgtccctgtactttgcacatgtcatggtcctatatatacatacagcaccatggtcatataatggagacattttatttattttcaccctaatatgtagagtgtggtagcataagctataaactgaatccccgtcatgatcgagtgccagttgagcttgacatgatattttgcctttctattatactccagtaaacattatgtataaatgccgatcgatgataatatgcatcaaaatcccccaatttcaccatatgctagggcttaggaggcacagggaatatgacatgcacatatacggtaagtagttcttccatcttgtaccattttcgcctcctttattgcccactgcatgcatctctcactcctatgggtactaaacttgtcatcttctcaacgtgtctgaagagtgacacagcttcaatttccagtatactgtttatctttctttgtgtttaattgagggatcatttgcgaggaagacatgcatgtgagaaagggtttttcggctagctccacaagctgagttagccggtctggattcgaagtctcaccccttctaagagttagggttactactattttatcagttcacttaatttttgctaaaaagaaaaggatctgacaagcacaagcctcatgcatcatgcaatttatctagtactctgaccgtacaaaacataaggaattttagatgatagaacataccacagtactacgaatatggacagataatatatctagattataatgataggatgtgttctatccatccaaaatttcttatattttaggagtacagagtactatcgctgtctcttcacaaaatttaagaccaaagagaggcatgcagttgatcaaatttaactaccaactacctactgctagctcataaacacaccacacatatatatgtagatacattgagagagagatcatcgagatggacgttacagtagatcgttggaggtgcaaacaagcagtgagaccggccaccactgcacatacatacatgggtcggcactaacacacaagttcaggcactttccatgtaatcttggtaggcttcggaggcatcaggaatcgatgatgcgtgaaattatgtcgttggggttagagcctacgctcgatcgtcgctgatagtttgaacatatgcacgaacatcaacgataacagaatccctacctagtcttgatggaccattagaaaatgacgttgaattaccgtgtgatacttcctctatctaaggcgtgcatatattccaagattcaactttaaaaacatttgaccaacaattattataatataatataaattttatttgctaaaattaatatcattggattgaaatttaaatttactttaagatggttataattttatttcaataaaccttatacttatagtatatgatattgtaaattataagtcaaagattagttttgaaaactgtgccaagtttgatcatgccttatattacaaataaaccttaatagtatattaattcttccttagcctccgtggtcgtgtgtccccgagcattagaggccggcgtgctgccttttgatttcccgttcaagctagccagatgaccggctgcagcgtatgtgttagttgatattgtgaaatcagtgaccatcttatttactcagatcatgtttgcgagttgagaagggcgaactgatggttaattaggaaatgttactactttttctttaaaaaaatacttctgaatttttcttaaaatcgttgatgatcgtgggcactctctggccaggttgcgtggatcaatgatgatcgtgacagtgttcatcggtgtgtagtgacagcacattttggaccctacatgcaaatcaatatattgactgaattttacagtttttcttaattttttgttgaatttgatcaaagtttattcaaatccaatcaatacctgttaaaatttttataaaatttcagtccgaaaagtgccgacaataacagaatttcgtaaattttggtcctaccgaaagcaccgaaatcgaaagggcaaaccctcatagtgagtagtgactggtgagatccttggggacggccgggtgtgccaacagctgcggatcatttcagtgttcatcagttatgtccattaattgcctgtatcttgaaccacatatcaaggaaacaaaaaagagagagaagagcagctaactatagatttgtagccagctacagtataaagtgctagacgtaatgtgtgtatggcatgtgggacaagatatcaatagtatagtatatgtttataggtaactattgtatgtattggctattaaattgattatagatgatttgcagctattaattactccctccgtattcgtaaaggaagttgttttggacagcgacacggtctcaaaaacacaaatttgacttcttgtttctataaaaatatttattggaaagtgatatatgtatacttttatgaaagtatttttcaagacaaatctattcatttaaattttatattttcaaactcaacaacttaagagttactcatgatttatattctcaagatttgacttaaacattgttctaaacgacttcctttatgagtacggagggagtagctctactattaaacttgctctaaacccgccgtgtgttgtgctcgccacgaggcgccgatgctgagggtcacagtgccacgccgcgccgccaacgccggctggtttgatgattcgatcccatggcaaaccctaccacgtgagtgctagccagcttagggggaatgcacgcacgtactctctccgtcccaaaaaaaaaaccaacctcgtattaggatgtgacataaccggtacaatgaatctggacatactctatgtacatattcgttgtaccagaatatatcacatcctagtattaggttgtcttttttgagacggaggaagtatgtgcctttccggtgggctgtgcagtgactgggttggtgccttttgggcttttagtttggcgaggaaccgtaatgttttgacccattgatacatactactaccatgccttcttcaccggccgtctagcgtgtcatgatgacacatagacacagacacccataaacacgcgcgtacacacccacctcatgataagtacgaagtaactccctttaatatgctttttatgatcttgacaaaattaaagaaacgaaacggtctttttaattgctcccaactagtgcaagtacacgttgattgttgcttgaccataaaagcaacagagagagagagagagagagagagagtcatcaatcggtaatactacaagatggatgcaagcaagtgcgtgtgtcgatctagttagccatggaagacagcaggaaccagttagttgtagaaatatgaggtcgtctgtagcagctgagcgtagccactgtatggtgtgtgcgctgacttgcagccaaattccaagcggtggtgccatcttcactggaggcgcagctgcaaaatcttggtcatcataggcgctatgcaacggctgcacaatggattaatacgggagggggttcattaatttttccccgtgcacatcaaatgtgtactaggtgttcttaattttctcctataatggacttctgcgtacacattagccgtcaagccagcaatttgttggtcttggttgtatcccttccttgcaaattgagtgggactcgatccatatgcatatgagaattttattttaagtacatattgattgttaattggtttctagttgctatgtacacagtcgtatgtcaaggtttgcactttcgattttggcgaaaatttcagtaatttcagcgggaccacaatttacgaaatttcatgattttaagcacttttcatttgtttgaaattttaatagattttgactgaatttgaataatctttgaccaatttcaacataaaattaagaacatctaaaaattccggtcgatatattgacttgtcggtggggttcgaaattaccgaaattgcaatcacaatgtaagtaccttcgcttgggaaagtactatgttttggaagttcttcgacatatatatactatatattgtctcactcatcatgtatgcatgtttccgttttaatcttcttcctcaaaagattaaagttggatttaactactcccaacaagtacccactgctaggtgtacatcctcataataaacacatcaactagtcatagttgaaatattcagtgccacatctagacacacgcacgaagagctgatcacaattgatcgagacatgttttgacttttgaggtttcaaaaatcaattaaacaaacacagcaaggccctctatatctgccatatgaatgtgtgcactgttggttgatgctatatctaccaagtacaagctagtttgctgtcaagctatagctgcttgcattgcgtatgtttgggtatataactatgggcccgtttagttctccaaatttttttcctaaaaacatcacatcaaatctttagacatatgtatgaagcattaaatatagataaaaagaaaaactaattgcacagttatgggggaaatcgcgagacgaatcttttaagtctaattagtccgtgattaaccataagtgctatattaacccacatgtgctaatgacggcttaattagtctcaaaagattcgtctcacggtttccagacaagttctgaaattagttttttcattcgtatccggaaacccctttcgacatccggtcaaacgttcgatgtgacactcaaaaattttctttttcccgactaaacacaccctatacctatctaggcttgggggggcaacaggaacatttgtgacaagaggtcaactcaaaaaggatagcgcccacttgcaaccgatgctgtgcacacgttcctaatagcgaggagttgttggtgtacacaggtaccggtcacatctctactctcttcatgatgtgccaacgggcagctacgataagtgcgttgtcccagctcttcatcttgatgtttactactatcatattccgatgtaatgagcatgataatcatcagcattgcacacttttttttggacgatcggagtacgcatactgatatcttgtattcattgtggaacaagcacgtcaacacctagttgtgaacccaaagcaaaattaactagaattctaacatattaggctgcccccctttgaaacggaggacttttaaagttatttttgaaggatttaatttcgtaaggaatttttggtatggaatcctttgatccataggaaaggatcataattttccatgttacattcctatggctcgattttgtagaaaaataagcaaaagttaaattttgttggaaactttcatttgctttgggttttccttcttacgatggtatatcaaagagttcctcttcttcttttgtgtgtttttctttcccgtggaattagagaagcagttgggcccgaataagagatgcagctggaatgcataagtggaaggcagataaagactactactaaatacgggaaacgaatttttgtccctcgcatggcattttaataagtcatcatttttttttagaaaaatagcaagatagatcgatatataatatatcacttcataaacatgcaagtacgaattcagtttatacaattaaaaataaaaacaacaaatttggctctgaattacccattctacttagagtcaaatatgtttttctacctttataatttgaatttgaactgcatgcatgtttgtgaagtggcatatcatatattgatccatctcttacaaaattttattcaaatctttcgatatttttcgagcaacatgtaaaatcgaggcaacatcccctccaggaatgaaatagatcgggtttccccgaaagatgttgcgatatcaatgggtacaggaacatatatatgtcattctcttatatatacaacacaccatatggtcatataacggacatactttattcatttctgcctcatcgatcatgcatagtgtaacacggaagatacaagcacacattgtgaattttgtgtacctgcgtgattcactctttagaaaatttaagacagccattcatttaatttaactggtcccagctagccaagccaactagctagctcacaaacacattatggccttgtttagttccaaagtttttctttaaactttcaactttttcattacatcaaaactttcctacacacataaatttttaacttttccaactttaattttcaatttcaactaaacttttaattttgatgtgaactaaacacgtacgtagcgagagatatatatcaacgatcaatggagttggatggatgctggattgttggggaggtgcaaaaaatgcaaaataaacaataataagactgatcaagtaggtacaataaacagtaaactaaggcattgtccatctagctatagctagggtatactccctccgtccaaaaaaaaagacaaatgctggtttccgtgtccaacgtttgaccgtccgtcttatttgaaaaaaaattataaaaataattaaaaagataagtcgcgcataaagtattaatcatgttttatcatctaacaacaataaaaatattaattatagaaaaatttcatataagatgatagtcaaacgttggcacgggaactcacggtttgacttttttttttggacggtgggagtatgcttggaaggcatcaggaatgtgtgatgcacgtacaaaagctgaccactgacggtcacacaatgtcgacccaagcgtgacggatgtgcagatcacggtggtctttgtgtacttgcacatgagagccctggctgatcataagttgttttatattataagtttgacttttttactagtcaaactttattaaatttaactaatttatagaaaaatttagtaatatctaaaatattaaattagttttattaaatctaatattaaatatattttgataatatgtttgtttttattgaaaatactactatatttttttataaattcgatcaaattttaaaatgtttgactaagaaaaaagattaaatgatttgtaatatgaaacggagtgagtaatgcttatcttctcgcatgacagacggctaatctgatgactagttagtttccttctcttgccggctgctttcctaatttctttataaaaaaaaagactatgcacgcgatgacctctctatcttagggctgtatccaaaccatgcacgcgacactatggaattaattgatgtctcacccacatgtgtgctatcgttttagtttagaccataagaaacctacatcagcagactgactgtagtgatctacacatcaaacttataatcactacacatcaaacctatatgtaggtgaaagagagtggaagacagaagaaagaagcactggcaaactttcttaacgtttgcctaattaatctgttattagcgaatgtgggttactgtaacacttatgactaatcatagtctaattagatttaaaagattcgtcttgtaatttctctctaattatacaattgattttttaatttatctatatttaatactctatgcatgtatccaaagattcaatgtgatgtttttgagaaagttttctaggaactaaacaaggcctaattgagattggaaaaattaaaaggtgtgtgtgtatgggagacgtgcacagataagcatgcaactagctacatactatgtagaaaggtgatatgttggctactccctccatcaaaaaaaaaaacctgggtttccgtgtccaacgtttgactctccgttttatatgatttatttttataattagtattttcattgttgttagatgataaaacatgattaatactttatgtgtgacttgtcttttttaatttttttcacatttttttaaataagatgaacggtcaaacgttggacacggaaatccatgagtttttgttttgggacggagggagtatttctgaagccaatagctaaaatggactattagccttactctaattaacgaggtagtgcatatataacatatttttgggaagaatcaaatgaagaggttagctgaccggtcatacacatgtagtacattgcttgctgctgacctctacaaatacaagttatatactcgtagtatcctaatacgtattgttgtgctagtacacaacatctagctagctgtatgcatgaatgcaaagctaatgctgaggcacatctcggcctagatccatccatccatcgattccatatctcggcctgggaggcattgggaagcgttgatgcacgaaggctagtctctgaggttggcgtctgccggttgccgccgctgtaaactctgccgtggcgccgcgggccgaagcaggccttgcggtttgcaatgctgacagcgtacgcctctaaccgatcgatgtgcctactggcatgtacagtggacacaaggggcctgttcgttgtgcctacagctgccaccatatatcttcattgtattttactgtagcagctggttatcaactactccctccctccgtcccataatataagggaatataagtgattttaagtttttgcttgtgctttttgaccactcattttattcaaaaaaaatagaattattattattttttgacttaccttattatccaaaatactttaaacacaacttttcattttttatatttgcataaattttttgaataagacgagtggtcaaacagtacaagcattccttatattatgggacggagggagtagcagcatcgaacacacccaaggacaatacgtgaaactggatttggagttctggagttagacacagctgattcggtgccctgctttgtgtacccgcctgatcgctcgcaaagatagggttcacagatcgataaagatgaaacttgacaatttgctggacaatttgccaacattccttctctaatgaaatgcatatgtttccctttttatcttagcctttcagtaattattctcttgatggatagagaaacaaattctgtaaaataatgcgaaaatgtatatatatgtaattagtagcactgactaccggttaaataattaattaaatcttacacggagcctcggttggtatatatatgtatatgttcttgtcatcgccgtcttgcttttggctgctgtcataaaaaagctaactctcgataattaatttatgtccaaacatcttcttcagaaaattaagttaaaaccgaaaggagctgcaaattcaattgattttttatatactccttccatccaaaagtctgaaaactattttttttcaccaaaaccaaagagcaatgtgataaaaccaatggacatacaactaataagtactaagatgacttcttggattccgatcaacaatttaatttagcacatgataattacaaataggacttagacttttaaaaaaacaaaaaatataatatatcttaaacttttggagtgagctagagagtactattgactacttcttccgtcctaaaaaaaactcaacttctggagtttgaattttgtcaaaaaaaaaaccaaattttatccttcaataccctttacctacctatcaccattatacttttttcaataatgatgggcattttgatcattttcactctttactaattttgcattgggatgttatggttggattttggattttatatgggacgtacagagggagtactcagcaaccaacgcatccagtcattagactcattaccatatgttcataaatgcatatagacgacataaagagcaaagatcgagctgatcaatcaatcaatccgaggtgtgtgttggggtgccaaaaatcaaacatgaagagcaagcaaggcctccgaaggccatgcctcgtccttttaccaagttagctatagtgcccggccgtcagctgctggctatccgggcccttatcagagcaggtacaatatagcagactattagccaactataaacatattttaataagataaaaaataagagagaagagcagcgggctacagatctgtagccagctgcagcacggactctaagacgtaatgtgtgtatgataggtgagaccatacactaatagtataataagaaattattgtatgaattggctattagattggctacggatgaattggagttagtagtgggctatactattaaacttgctcttagctactcccccgtccctaaatatttgacgtcgttgacttttttaaatatgtttgatcgttcgtcttattcaaaaacttttgtgaatactattcaaaaacttaagtagtactagtatatttaacaatgaatcaaatgataggaaaagaactaataattacttaaattttttgaatagagtaaattttagaaaactgtaactttgtgacaaaactatcagtttgttgcaacaatagcgtgagaaattcataaaactgtaacttttacgttatatgctgctacagtacatataggtgacaactgtagtagcgtatgacataaaagttgcaattttatgataattttccacactattgtcgcaacaaactgaaacatatcgctaatgttgtagcaaactgatagttttgtcactaaagttgcagttttctaaaatttactcatttgaataagacgaacggttaaacatgtttataaaaagtcaacgtcatcaaatatttagagaccgagggagtacttccattgacacatagtatatgcattgttaggataactctacctatatatctagccagggtcttacccttgccatacatgcgcgacagtcccggcagttgatgtgcatgcccttcccctccactactacagcacatatcacatgggtgccgctcctatgagtagtaacggttgaattaaacctagcactgataagggcaacctcaatgttgggttgctgaatgagcgataggggtgggcccatgtgtagatagctttagctatatctatctctacaatggttatggccttggatgagaaacaagccgggtcccactgggttccatcaaagaagaaacataccaccaattcacaaccatatgctgataggttccattatatatcattttttaatctcttaagttcaactataagcttagagctgtttttaagcatttaatgccttatgtccatgtccacaatgtatatagctgaaaaaaagtcttaaggctcacttttatggtcacattgtggatgccctaagggtttcgtgcccctcaaactctcgtacacgtcctaaaaatgcatagcattgaacgatggaacaaacattagtgccggatggagagcaaaaccggcaccaaacaacatgagccgaccagcgagccgagaaaaaaaaagtctagaataactctggaccactctttccttcgatcccaagtctcaaatatccatccattctcccccctcaccctgtctcctcgctctccccgtttattcctttttgtctttctgcgatgccaccgcacctccgagctgtagcttctttctcttctatttttatttttggtgatgtggacaaatctcatgtatccatttttggatccaacactagtttttaatttttcactatatatatatgtagcttgcactacatattttccctcggtttgaaaatgactattttggacgttcttctactcctatatactatatgttgtctcactaattgtgtatgcatgtttccgttttaattttcttcacaaaattaaagttggttctaactactcccaacaagtactcactggtaggtgtcctcataataaacaaatcgactactcctagtcctagttgtgatatatattcagtaccacatctagacaagaaagcagagatcgagctgatcacaatcgagacgaatgttggggtttcaaaaatcaaacagtacacacagcaaggccatccatcattgcaagcattgtgggttactgttctaccaagtaaatctagcgttctagctagctactcacattgctcatctctgggtaactagctaccaatctaggcttgagaggcaccaggaatgtttgatgcacgatatcaacttaagaaagatacactacaacaagaacccccctctagcaatacatgcttggcaacgcattaagcatgcgttgccaaaatgcgaccctagcaacgcttagcagtgggtgagcccaatttgcaatagataatatgtgttgcagaacatgcgttgcagagattgagtatcttgcaacgaccgaatccactttacaacagatatcatgcgttgcaatggtcttgatgccctgtaaaaacttttggaataagcgaacttattgtattttttaaaataatcgagtgagatatttatttttcatttcggacctctagcgaactgttttttaaaagaaattatcaagtgagttgcttttttttcctgttaaaacttttggactaagcatgctttttaaaaaataataataactgagcgagctgctgatacctgatatgaataaattaggggggcaaagatgcaaacagaggattcgaacctgggtctcaaggatagaatgtgcgcaacccaaccaactgagctaatcacatttcttattaaatgatttctttagatgtttatatcataacaactaaaatacgatctgtgaaattagcactttagcaggcaaccttagtctcccactttctctcctctcctctcctctcgtgtctctcacctcacccaacacgcacgagagcgccgccccatcctgttcccacaccgcatctcattttcttctcacgcactcgcacatcactgccacggcgcacaccgacggccagcggcgcgttctcagcagcggcggcggcgagcccgcgaggggatcggccgcggcaggccggcgacgggccgaggctgacgacagcgggtcaacggcaagcacggtccttttcttagccacttctcataggttgattccccatttggccccaaatccaggtcagtgtcagatccaggtcaatgtcaactttttttaattattcaggtttgttgcatcatgagtctatctgattgagtttaataacacctgcagatttttcttgttcatccgaacggatatttggaacataggttttaaacgcatgtgcttctagagtcatcatctgtagattaactagaggtaatttatagtaaggaatttaacttggagatgacagctttgacattagattgctggatgttttttctgtaaattgatttaactcttctctatttttgcagagtaaaagcttttgtttcagtgtataaaggaggtctattaggttgtgacaaaattagctgacactgattttatactggtatttttctaattgccctatttttgctacatcatgatcataagagacaattccttgtcattgttattatctacaagaacctgaaatatcaaatttttttatataggtcgaaatggatttagaaaccatcaagattcttttgcgctaccctagaggttctgttgagtacttagctggagtagatggatttcttgaatttgcatataaagataagttagaggatacaaagatttattgtccatgtgaaacatgcgtacatactatgctactttcaaaaaatgatgtctatgatcatttggtgtgcaatggaatgcttcagagttataaccaatgggattttcatggtgagtcttcagaggagcaaattaggaaccaacaaccacagcctcacaatgaagacatgcgtgctaacatgcacgaattaattaatgactcacttaggactgtgtatgacgacatgcctatgagtgattctgcagattcgccatgtacacacactgatggaccaaatttagaagctcaagcattttatgagttggtgaaagattcaaagaagcctttatgggatggatgtgaactatcacacttatctctgctagtgcttttgttcaatatgaaatccatgaacaaatggagtgataaatcatttggagatctacttgatattcttcacatggcaattccaaatggaaaagaattgccaaaaaacttttatgaggctaagaaggtggtttcaaaatttggtctagattatcaacaaattcatgcatgtcccaataactgtcagctgttttggaaagagaaggttaatgatgatttttgttcaacttgtaaggcttctagatggaaagataaaaaaccagaaaccaagttaacgaagaaagaaagaaagaaagcaacaccaatcaaagtcttacgatattttccaataaaggagaggctgaaaagattgttcatgtgtagagaaacagcatcgctcccacgttggcatgatgaagagcgcttagtagaggatggtgtgcttcgacatccagctgattctccggcatggaagaactttgataaaagattcaagcaatttgcatctgattctcgtaatatacgatttgggttagctacagatgggtttaacccatatggtatgttgagctctacctatagttgctggccagttgttttagtaatatataatcttccaccatggctctgcatgaaggaacctaatcttctaatgccattaataattcctgggcccaaaagtcctggagataacattcatgttttcctctagccgcttctagaagatttaagagacatatttgccaatggcatttccacatatgatgcatttagaaatgaaacttttaatttgagggtagctgtactgtggactataaatgacttgccagctttaggaatgcttgcttcacatatggtgcatggagaatttgcatgcccgccttgtggtccaaatgtatggtccaaacgtttggcacatgggaagaaatcttgttttatgggtcattgtcgatttttgccacctaatcatgaatttcgttttgatagaaattctttggatggaaccacagagattagtacagagcctatgacttactatgggcgtctggtattggatgaaataaattctatcggtgattttaagaagtcaaaaacttataaggcagtaagtagtttattcacactaccttactaggatgtcaatcttcttcggcataatcttgatgtgatgcaatatttatggtacacttctaaatttagaatgaaagtcaaaggataatctccaagctcatcttgatctcaaggaaatgaacattagaggggagctccatccacaacaaagaacttcaagcaagttctacttaccacctgccagctttactatgtccaaaagtgagaagcaattgttctgtaaagttcttagggatataaaagttcctgatggctattcttcaaacatatctagatgtgtgaactctgctgaaggaaaaattcatgggctcaaaacacatgattgccatgttctaatgcaacaattgatgccaattgctttgaggggtattcttcccaatgaagtcacatctgtcttgtttgacttatctgcttactttcgaggaatatgttcaaaagttctccatgttgatgagcttgaccgtttggaagaagcaaaaatcacattgtgtagaatggaaatgatatttcctcctagattcttcactgttatggttcacttagtcgtccatttagctactgaatgtaagattgctgggccagtttgctatcgatggatgtactttattgaaaggtactaaaaatatattagcatacaatttataatatttctcatatgtcatatgatacaatactaacttattagttttgtgccttgtatgtatattacaggtacctaggtaaattgaagtcgtaatgttcgcaacaaagcgcgtccagaaggttcaattgcataatcatatttggcagatgagtgcatggcattttgttcgcgatacttggaaggtttccctaccaagcataacataccatcaaggaataatgacaaaccagatcaatttgagactcccatgagtaggcaagaatccactttgtttcctccagtaggaaaaccattgggaaaaccatcggcgtactccttaactgatagagagaaattgcaagcacatagatatgtgctatacaactgtgatgctgtagtgccatatctaaagtacgtattgtcctaacatagccttttttttatgtgttgtaagtgttttgcttcaaatttatgtttatttgttttgcagagaacatgctgctaatttgcaaaggaagaaacgcaaaaggctaactccaaaaaacattgagaacatgcaaaatgaacaattccctgattggttcagagatcatgtaagtctcaaaatttaggtttctctttttcaaatatgagtacaactaatacatcttttggtttggtgtagatcttgcagttggagaatcaaagaggtatcgatagtattgatgaggatattagatggctggcacgtggaccaattgaggtagcaaaatgacatagagcattcaatacccgtgggtataggttcatatcaaagcgttatgacagggtgactcaaaacagtggaattgttgtgactgcaaaaacatcgagctacacgtccgccagtgatactaaccctgtccttggtgatatcatgtattacggaaggatacttgatataattgagttagactactacggaaatttctcagttgtgttgtttaaatgtgaatgggtcgatgtaactaaaggaaaaggagtgaaaatagatatgtttggctgcacacttgtgaatttctcaaataaattcataccggtgaaaagattgagcatgagccctttgtatttgcaaatcaagtcgaccaagtgttttacattgaagaccatttaaatccagggtggtctattgtaaggaagatgaaacctagagatgtatttgaactgggcgaagaatggaatgatgtggaatgcgaaccataccatgtcaataatcttggggagctatttgacagtgcacatgatggtcagacatggattcgaagagatatagaaggaacaactgtcaataacatagtaactaattaaaggtgaggttatgaaggtttttcactatctatctgtccattatcaatgatttccttatattgtttatatcttcacttggggagcactttatttttatggcagtaattttggatggagatttactgcgatgaaggcttcttcaccacaatagcttttctggacgaaaatgtcattcgtatatttccttggattgtctaagtgattgagccagatcgattcaactttttatttgcatacataagtcctgtaataatgttctacattagttatatacagaattggtggttagatcttatttttaaatatctaggatatcatattgtttatatgatgagaaaaaggaatgggcgtttataatctttgcatctattgtgttctgttataccatttccacctatataaatacctggagaaaactatttacgttgtgaatggaaactatttacgttgtcaatggcacctaacgtgaataagtaagtcgaacggacaactcctacatgaagtggacatagcctggtggtacatggcttcttcagccgtatcgaagactgtagttcaaatcctaacaaatgcgtttttttccatttcttctccagtggcgattcttaaaattttttccctctccttagctggctagataacgaggaaaacaaatatgccagcctagattttttttattttttttctaggggcgattcctaattttttttccctatccttcttagctggccagataacgagaatttttgaactttttatttttaattttaaaattaaactgatcgaaaacttattttttcaatataaatatttttggccacactaactattattttatgacaaaatatgttacgtctggatttgatcatgcgatcagtcagtatggtatggaccgagacgacaacgaaaaaacatatggtttttcggttgtgctaacataaattaaataacaattatttaaagaaaaattattttacatcatgattttatacggcttgtccagaccaggtcgacaacgaaaaaacaagtggtttatcagttttgcaaacataatttaaataactattattttattattttatgaccaaaaatattttacgtctcaatttcatgcggtctgtccagactgggtcgacaacgaaatagcatatgccttttcggtcgtgctaacagaatttaaatttccatcttatataaatacctcgagaagtctatttacattctcaattgcagctaacgtgaaaaaataaataaagggggacatagcctagtggtacttagcttcttctactgtattgacaactctagttcgagaactagcaaatgcataatcttttcatttttctctagtgtcaattcctaaaaactttttcctctccttgaacgggaaaaaaaattctgttgccccagaaattttttaattttttgaacttttttattttaaaattttaaaaataaaccattcaaaaacttattttaagaatatccggatttcatccagtctgtccggaccgggtcgacaacgaaaaaacacgtgtttttgtcgtgctatgataaattaactaactactattttaagacaaaaaaatattttacgtacagatttcatacggtctgtcggatcgtgtcgacaatgaaaaaacacgtggtttttgttgtctaaaaaattaaaccactgttatttaattatatatatttttcatgtggtctatccggaacgggtcgacaatgaaataacacgtgatttttttggtcgtgctaacattttttaaataactatattttaagaccaaaaatatattgcatctcttttccatgcggtttgtccggaccgggtcgacaatgaaataacacatgaattttttgtcgtgctaacatttttaattaactatattttaagacctaaaatatattatgccactttttcatgcagtctatccggaccaggtcgacaacggaaaaacacgtgtcttttcggacgttctaatataaattaaataagtactattttaagacaaaaatatgttacgtccgaatttcatcccgtatgttcggaccgggtcaacaattttttttggtcgttataaattaactaactactattttaacacaaattttacgtccagatttcatatggtctgtccggaccgggtcgataacgaaaaaacacgtggtatttttgtcctaaaatattaaatcactgttatttaattttatatatatatatatatatatatatatatatatatatatatatatatatatatatatattcatgcggtctgtccggaccgggtcgacaacgaaaaacacgtgtttttttatcgtgctaacattttttaaataactatattttaggaccaaaaatatattacatgtctttttcatgcggtctgtccggaccggattggcaatggaaaaacacgtgtcttttcagtcgtgcttagataaattaaataactaaccaaaatatgttacgtccgaatttcatccagtctgtccggaccgggccgacaatgaaaaaacacttgttttttggtcgtgctaaaaaaattaaatcactgttatttaattatatataatttttcatgcggtctgtccggacaagatcgacaatgaaataaaatgtgattttttgattgtgctaatataatttaaataactagtttgacggacaaatcaaccccaaatcgatctgaatttagcaatttatgcctctccgaaaattattttcttctccctccactctttccctccttttttttttgctcccgcaatttttttctgttttcttttttttgccgccaactttttttttgcccccaccttccccatcgagaaaagcaagccaactgcccctaaaaatctctttcctctatcctgactccctgagtaaatctctttcctctgttgtgggattcccctttcctacgaactctcccgtcgttctacggttctcctcctcgtcttcatcggtgttgatctgtaggtaagatgccgggcactttactgacccaccgccccaagcaggcgctcctagatcttccaccgctccgctccgtcggctgctgtaccagccatcactgctgtcgcaccttcctgccgattaacagccacgagcaggcgacccccatgccccatggatgatgtagggcatgcggcgggccggagacgcccccagccgatgtgccgggtgaccggggcactgcaattgatgcgggttatacctcccgacaccggctgtccacttcgctctgctccacgccgcgcggctagcggcaatgtttccaagccctggaatctctgcctccctctgcacatcttactacctctctgagtcgccaaattgcaatggaggctaattcccttccagtactacaatacttaccaatttgatatgttgtattttcaggtttggagtcagatgcactgaccgtccatagctgaaggagcctggtctacgtacagctaggcttcacacaactgtaagcaataaatatgtgatctagttttaccttgcagccaattaaattttgttatttctacccattacttgtttcaaattgttggcctataaaatggacaaatgaattagtgagtatgacaaacagatccatattatagcattacttttgggacaacagtactctgttgttcttcaaaaacaaatccaaaatggctcagggtataatcaattctgaaattattctttttgaaactatgtacagcacagtcctacttctgaaatgagaatgatatactttcgacgccataaatgacagataggttttttttgggtgcaagagatatggcaaggagtagaagaaggcgtattgttcagagcaatgaggaatatttgtcagaggaacagactgaagaagaaaatacccttccacagcttgccacaccatctgaacaaaaaactgtatgtgatgattctggagaaggcaatgaagacactgatgacgattttgatatcaatgatggagaaggcaatgaagacactaatgacgatgttgatattgatgatgaaggcaatgaagatactgatgttgatattaatgttcgaggcaactgctaagtttaatagtcctaatggtaagaaataatgacattattactcgtatccctgattactaaggatcacttttgtcttcgcaatttaacaccgaacagttgaaaatggagcacctgaaacacgtggcaagacaaaactgaaagatgtttggaaccttccgaaagggcttagaattgtggtacaatgcaatgatctcaatcaggcggtaggggaagaagctggagttttgggtaaatttcttggaatgatagctaggaatggtagtctgtgtagcttaggctacacagactggagatatgtaataggaaagagagagaaaaatacaaatgaactaaaagttaaaaaggacatacttaagcaagtaaaggtaattccttttcagatcaacatttttgctaacttcttgtattatgttatgcatatccccatatggccatatgagtttctgtgttgctatatgtagatgagattcctttatgctcctcggatggaagagttcatattaaaaaaaattggagaaagatggcggcaatataaagcaaaactaaaagatttgtattttgatgtgaatgagactaaggaagctaattgcaacaatgtcccagaaggtgtgctttctgaccagtggattgctcttgtcaatcattggatgaacgagaaatcgaaggtacatataccatattcatttctgtaatggtcttacaaattagaactctgtactaaacaaaacaatgcaatattcttttttgattgctaactctacgagaccataacagagaataagtgagcagaataagaaaaactgccaaaagaagaaggcaattcacacagcagggacaaagagttttgctcgcacaagagaagagatggtaaaacatgtcttgaatagtattcatctatttccatttcaagcatgtatagctactattaggactttactgatttggtcatgtgttccatagagacaaaaagatcctgcaaagaagtacccacatagagctgttgtttatgtccacacacacaagcgcaaaagtgacaagaatataaatgggcatgtggtatactattaacactcaaccatagatatttttcagttattctcatatgttgttttattcgtattaatttttcatatgtttaggataatttgaagagacttatagctgaacaaccagctttagcggatgctagtaaaggaaagactgcttggaaaggagatgcattgaaccaaatactaggagatgacaagcctgggcgtgtgcatggtcttggactagttccaaagcctaaacaagtgcttgatgtgccaacttcccgacgtttgcagaatataaatcttactacagtggaggataactccagtgaagatgtaatggctattagactgcagatggaaaagttagaacgccatgttgagaataatgatgctgaacttttacaattaaaagagaaggcaaccaagttggaaaaggcacaaaagaatcaggtgaatttaagggagttgagtcttaaaaaaattatatgaacttgtgtgtgacccaatgaatgcatctaacttacctaattgaagttacagggaggtttagatggagcatctacaaataaaaaagctatttgtgatgacgtacctaattcaaaaaggagggtatgtatctttatggaagaaatatcataacattttctgcattatctcataaactgtggtatagatctctgttcattttctgttatggacagagagtgtatggtgacaacccctcgcaagaaatttgtatgtttgaggagggaaacattatggatcagcaggacaacagtttgatggtaatgtgatatagcaccatcttataactgggaatagctgtgtttttttacttgggaatagcatttattttctctcttttacaatagaatacacaaagccatgtgcacgatgagaatttgcaaccaccaaccaagcattctactgtttacaaggtccttgcctttgcatttaaaatattattatatatatattcactattatttacatagcattcattataatcatatgccttcttttactctagaatacacagtctttgggccagaatcacagtgggaagcaaaggaagattacttcctgtgcaaacataaacaaataattggaacattatagtttgtgccaattttatgacctattccattgcagcgcaaaggaaatttggaccagaatgagcttatgcaaccagggaagagtatttctagtgcatacaaggtgagttgattaagttctctctttatcctttcaaactcaatgccatagtcaataagtgtttgaaagtagtttaatttcgatatataaatgtatatatagatttgtaaaatttatttgttaccttccactgtagaacaataaacctgacaaccaggacaactatatggtgaatgcacacaaagttacaagtacacacaaggttattttttcatcactttaagtcaccatgtctacagatataagctctttgaaactataacacacatgatttactagttataataattgtattgcagaacaaagagaaccttacccgcaagcttgttagaccaagcctaaacaagtatagtactgcttctaaggttagtctaattgtttcaagttcaaaatgctatttctgtttattgaacactacacaacaactaaaatagcacacacagcatgttggtttttactgtaaattctctctattttttcagaaacggcaatgcaacacaatggactttttaactgacaattcaacagtggtaaaccttgctaacattttagtctaaatagtttaataaaatctggtcttaatgtccttttattttccactgtgatagaaagtgtatggtgacggtcccttgcaagaaatttgtcatgttgaacaggaaaacattgtgatggtaatatacataaatttcattgttttatacatgggaatagttgcactattttgtaactgggaatatatgctctctttgacaacagaattcacaaagccatgctcaagatgaggataagacaccaccaaccaagcatgctactgcacacaaggtccttgtctttcaatttatatttttattctgaactcaccatggttgcatcctattatatggttatcatggatacatagcattatattatttggtattgtttgtaactaactatgaatgtttactatagttcatgacaatgtgatgtattcttttattctagaacaaacgaacctttggcctaaatgaccatgggaaacagatggagattatttgtgccaaggttagttttcacttcttattgagttcaaaaattatttgatagaaaagtttgaaagtaaaatttcttaatatatataattttagcactaatttgttgccctcccctatagaacaagaaacctgacaatcaggacagccatatggtacatgcacataaagttggtggtgcatacaaggttgtttttttattcaccatgtttacaaatatcagtccattcaaactataacatgcatgattcactagtattatgattgaattggagaacaataattagctctgtttggtctttctttctttctatcttgtggttaaattgcaaaccatgatccaattttttttataggaacaacagtgcagcaaaatggactttatcactgacaattcaatggaggtattttactgtgaaattatttatgatacttgaatttcttaaagtatattgataatattgatggatgtattatgcacttcaggttggaactaaagtattcttaaaaagttggaaaaatcggaatacaaacgtggctcttgccactattgtaagctgtgatccaacacgcagagttggaggtgttgagctaggaaatgaatttttaatggttcatgtcgatcttgcattggcaaaatccgaagatttgattaggccatacaaaggctacaaaattgttggtcatgttgtaggacttgaaattgcgtggcctgcaatttttatatgttcctatctcttacttcttacttcggagatgtgcttttcgtcttcataatggtatattaatgcttatatattttttctattataggttgacaagataaatgggtgaagatgtgggggaaattttgtgactgctagtacgcaactaggtcacctgtacatgtcacggaatgatgatggctgcaaggtggagaatgggggcaacaagatgtgtttttttatatactttagattctattttctgcattaatgttctgaacaaaggtttaatgccatgaattatactgatgattgtctatgtaatgcaaaatactatatttaatatataatcgattatcatgattgattggactattgccacttgtgcatgctttgagttcatgggtctcttgcctgacaaaataattggtcaaaggccacctacagtggatagctcaaattacaatatttgtacatgttgcagcaacttgattatatccattgctaagattatataaaactgttcatctctcaagggaacaacatatataagtattgctgaaacctattaaaattgttgctaagtagcaacgcttatttccacttgttatcaacggttgtctatgtgttgtaattgatcctagcaacggcagcataggcaacgcatattaaatgcgttggtgcagaccctagcaatacttatagagacttttagcaatacatatatgtattgctaaagagggttcctcttgtagtgatagtgcctgcttgcaatcgccgttgtgtttgctctccttcgagcgaggagttgttgatgtttataggcatcggttacatctctactctctacacaatgtgccgacgggcagctccgatgagtgtgttgtgctagagcagccggctgtaggtgatgttgcattctttgaaccacatcaacgtttgacgcttgttacggatgatcggaggtagacgcaatgaccagtcgacactggtggagaaaccatctttggtcggtcagccaaatttcacaatagttccggttctaataaaaaccgggactaaaaagcatctttagtaccagaactaaagatcatttttactcccggttcaagaaattgtcaggttcaagatataccttaactatttttactcccggttggtataaacaaccgggactaaagatctatttttagtcccggttgcttataccaaccgggaggaaagaacacctcgagccgcgtgcgccatctttatccgctctcctctcgatctcctctcccctctcattaatatttcctctccatcccttcctctccccttcattccccatctgatccttcctctccccttccccttcctttcccgttcgcccctttcccctctccggagcaccgggcgggcgggagcggcggcggccggccggccggccggccgcgcaagcgcggcgagcggccagccgagcgggagcggcacggctgggcgggcgagtgcctaggcgggagcggcgacggccggccgggcgagcgcggcgggcgtggcgggcggccgggcgggagcggcgacggccgggcggccgggcgcggcggccggccgtgctggcacggaggcgagaggacaggaggccggtggcgccctcccctctgctgccggatttttttttaatatgtgattcattggatttaatctgtgatgtatgtgatattggattggatttgatctgtgatgtatgtgatattggatttcatctgggatgtatttgagttgtggtgtatttcttttaggatttgtgatgtattttttgtttgagaatctgtgatgcatttcttcctaatctgtgatgcatttctttccagatctgtgatattagtttggtttgtggataatttgaggatatgattgaggatatttagggagcagatcaatttgagaaaaaaaaagaatcaaccgggactaaagatggatttttagtcccggttattttacccaggactaaagatgggcatctttagtcctggattcgtagtcccgattgtataaccgggagtataggggggttcccacccgcgagtaaagcccctttctccaccagtgcgaccacgcaccgaatatcttgtattttgtctggcagtgctagcacagcgatacctagttgtgaacccaaagcgaaaactagtatgaatccttacatttttcggctccctttgagatggaggattttcaaaggtattttcgagaatttaacttcctaagactttttttagtagggagccctttgattcatatgaaagatcggaattttctatattatgcttctatggctcaatatcataggaaaataagcaagagctcaaatcttttcgaaacctttgtgcctttttctttcttgtgatgctattaaagggatcctcctcttctttcctgtagaacttcagaaacatgtcactccaattattgtgtttttcttattctggccttttttttcctattatgcatgttttaagagaaattttatgaggtatcgaaatatatcattttttacactaaaaagtgtgacaccttccaatacctcctgaaggatggtaaaatcacacacgttttaaacatctaatagtgtaattatttaatggtatactagttaccctggcttaaaatagctagaaataactagggtgtgtgctatagttaacaggtgggtccagaaaggaggtgcagctggaatgcattacatctaggagataccaacgatcgatgcacatggatatatcctccgtcccataaaaaatcaacctaatatcagatgtgacacatcttaatactataaatctgaacatacatatattcagattcgtagtactagaatatgtcacatccggtcctacatttattttttatgggattgagggattgctggattgttagggctcggggtgcaaataaacagtaagaccggctacacaaaatatatgtacatatataataaacagtaagctaaggcattgtccatcctgcagctagctatataggtactcctatatgcttggaaggcatcaggaatcgatcggtgatgcgtacgagcgtgccactgcctgcttcgtgaggacacatcacaagttgttgaccgacgatcatgcagacaagtgacaagtgttccacccaagctagcgtgacacagcgaacgtgatcctcggcagatcgtatcacatgtgcctgtgcatatgtagcttgcatcacgtacagtcgtacagacaccgaccggccgccgtgacgccaatctgatgatgagtttagtttcctgcttctctatgtagctgtcgggcgtacgtgtaattaagcaggaacgtcgaccctattgacttgattatatcagatgaaaaagatcaactgacgtacggctatatatatatatatatatatatgctaaaacaagacaggcgtcgttttccagttgtctaaagaaaaaaaacattttgtaataaacaccttggttatattaggggattcaggttgtccacacggtctcttgctataagcactaaaagggtctctcctaatattaaaaagatcggcatctggcgaaactttggttgtcatggctcatcccaaagggactataaaaaaaacggtcataagtttttagtagaaattaaactttcgaatgtaattatagtccgttggtatatgcaagaacattagtgctctgagatttgttgggacatgcgcgtgcaacaggcgtcaatcgagaagataactcccgtacagcgggcgacatgcctctctgtctgtgggttgaatccaaacgaatcggaatcaaaccgtgcccgtggaaatgtagaattaagtcgcggtccgtgaggttgctgagtaggaagcgggcatataggtacagcgcgccgtgaggaggcaactagcagggtctttaccctggatcaggattctctacaaccgactgctgcaccgtgcctttgtcactaacatgtggatccggagattattgaactcgcatgtcagtaacaaaggcacaatgcagtgactgtagaggatctcaatccctctacccttgctttacgtgcgtaatcaagtcctagaagttcatgtgcacaggcgagagtcatgtgtggtttgcaatttcgaatccctggtttttgctggtgggcatcgaaagaaccgaaatcacaccgatatggtgagtgcggctgcctcatatctatccatggagcacatataactacaccataaattaatattatatacaaattataatataattatatcataattgtactatattaatatctattaaatttttatgaaaaaaatttgtcgacaaatatctagatagtcccgctgtacaccctagctagcaaatcaaatctccactatttatatatagcaaatccccaaatcataattaacaaataaagcagtcaatacttgtgtcttaaatataagaataaagcttacattaattaatattgtgattgtgccataaaagatagacgcgtcacatgtgacattatcaatggctactagctaggtagctctaaggctgtgttcacatgtggatgatgggaacacagtgcctccgcacggaaaacggagcgttccattagcacatgattaattaagtattagctatttatttaaaaaaaatggattaatttgatttttttaagcaactttcatataaaaactttttataaaaaacgcaccgtttagcagtttgaaaagcgtgcgcgtgaaaaacaagggatttggttgggaacctagaggtccgaagacaccctaaggcaataagcccagagtaccagatgatgcacgtgctctatataaatattgggggatgaaataatgaacccaatttatttatttattccaagtcagagtgtaatagaactacaaagaactgaatctcagcaccacactgatttttcacaataacaataagggatactaagttcgaagtatatataattggcattcttattgattattcaatacatagtttatgtagatggccggggtgtatgtatatatggatccaaattgaactacaagctacctagaagtttgtaggatacgtaggaataagagttaggacaaatgctggtgtgacatttaaattcatccaggcttttttgcaactatttataacatgttggtgctttatgcgattatgtgtgtgtgtgtgcttattcgaattcgggcttaggaggcattgggaattcgatatgcgtagacatggtaggcagtgctcctactcgattgttggtacgtgcctttgattgggtgctgcattcggtgcttgttctaagtaggatggatctatttcttaggccctgtttctttcagcttgggattattataatctagattattgagtcagattactataacctagattattataatctatagtagaataagcagttagttgtttctttcctagattattagaatctagattattgagtttgtgagtctaaaaagggagtggggtggcatggtaggtaatttttacccaataatctggaaaaagctcatctaaatgagcttatcagattataataagctgggctccagattataataagctacttcaataagttatctgtttctttcagcttacttccaataatctagattataataattctaagctgaaataaacaaggcattagtctctgtctaagatggaggatatgctttgtccgggctccatcttttccttgcacttaataatagacattggcttgaggttgagtgcaggggccgggcaaaattgaagctgcgcggtgtgtttgtcagacgtacatctccatgtctagactcatgtatgtaatttgtgcagtttttatgtcgtcagcagctgtgtgctctttcgttctcttcttcttcagaaattaataccggttcctatttagactgtacacatatcaccgcagcgggtgacttagggttaatttgtatccgtacctagttttgaaaaatacaattaattattattaatctatttgtaagcattccattattgcaagcatctcaaaattgtatacataccatatcctgtacagtacttaattggtacacgttttgaatcgctttttatgtactttatttttatatggatcaaaatacccctgattttattggttgcacaacacatgtatatactacagatgctcataaatacatcttagaagactcctgcatatatattggcttggcagctggctagctaaagttgttctgtgctcctccttttatttaagtattgtaaataatctttaattattttcttataaagttatactatagtttttcctgaagaaaaataaccacataacatattacatacatgagtctagggtataaatatagtacacattgattaattttagttcagggcttgaaaggcatcaggatagttggacatgccacccacccggccaggtttgttcatcgatgcacgaggcgacattcggtcttgtgccgtgtgcgcaagtgcttggcttggcacggccatggagtcatcgtataactagcacacacactgcctcatggttggctctgtctgtgatgagatcgccgaatatttagccttggaagacaccaggaacagttcatacgagcaaacacgccactgcagctcgtttcctgccgcagatgcagctggctgtgaacgctagctgatgcaccacggactgtggtggaagatcgatctagatcggtggcgttcagatagggttccagattgacgcgggggtgattcttagaactcaatgatagtactctagttatcccgacaatacgatgccaaagagctaagtactctttcatgagaaaatctactgtacggtatcccgtagacaagggataagtagataacgttttactcttatccaatcccactcctttttttctctcttccatatccttcgttatcctcctcttccgcatctccttcttcgcccctccttttcctttccccctcctctccacaaaagagtttctatggaggcatggtgaagatagagcagccccaaaaataaatctagagtattatgccctcctcactgctagatccagggcgagtgggcaacaccaatctcatagcctcctctgtctcatggccacctcctccgtctcatgcttttgaggcatggtgacacccactggatctagctctcatggcggcggggcaacttggaaaaagcaaggtcatcgggaactgggaggataaggcccaacgtgtgctcctcagcctcctccttcaatgtgcgttgtcgatggtgatgaaggggcaacgtgatggtgagccatcatgctcctcacccgattgtgtgcaggtatgtctacaatgtatcatcagtagccgatactcgtagatatcatgcctgatacctatggtttcgcagctgatacctaggtatcagacccggtaccccgtatcatgcctggtacctgtgaatatcacgattaatacctaggtatcaaacctgatacctgtaggtatcaggcttggtacctgggtatcatggttaggtgtcagacctggtacccgtatgtatcaggcctggtatctaggtatcatggttaggtgtcagacttggtaccctaggtatcaggcctggtatctgggtatcatggttggtactcacacgtatcagatctagtacttaggtatcaaggctagggctggtacctgcaaagtatcaactatcaacgcttcctctcctcttttcccttccccttggctcaactctcgttccttactgttgtgaccagtatcgttgcctacgacactactggcactagctcaaggtgtggggggtgcgagaacatggaagttgggggagggggatgacgctagatttatggggaggaagttgatacgctagcctctataaagtatcccgttcgaacggtatcccgttctctagcaaccctcctcttttatccactcgtgtgaatggccacataggcacatatggggatataccagcgtttattggttccagctagtgaaaaatgcatctcgaatctgcaggataatccaacgataaggaacctaagtagatatccccgcatgaggataaaactatgacgttttgatgatagagatctactccctccgtctaaaaatatagaaatgcatacacatctagtaaattatgaacacttagatattagttcatttggactatattaataaaaacaataaattatgaataagtgaaatgctataagatggtatcccgttcggaccttgtctataaaaacaaaaaattaaggggaagcagattgatatacggtctgattgatcgaaatggatgcctgctgccatggtgtgagttcatataaacagcaaggtcagggccatacaagcgtacgtgctgctcccacaagttcgtgtgcagatcgagactcctcatgttagcacacgcactagcagcccgtatatatgtgttgggattggaaggcatccgggaagtttcgtgcgagcaaatacgccttggcggctcatgtcatcgtgcagctgcaacggcgtcgtacgtcgatgcgacacaggcatcagaggttgctcccgagcactggctacgatagtgctcgagatcgacgtcgcacggctgcttcctcgagctcaacggttgtgctctcatcatcgcgacgatccaatggcggagctctagaagcacaacaagcggcagatgatctggaaggagtactggtccgctgtctgcaatgtcatccaggtccagatgtctaacgatgctcaagctggagctccaatccatggctgtggtcatgcatgtgtaatcccgctttcaaattcatcattgtttttttttcttaatttacatgtttaatcgagtaatttattttcgaacggttagacagttaccgacgttttatataaagaagaatacgttctattttttaaaaaaaaattggaccaaccaatacaatacagaattaattagaattaattagagtaactggggcaaaaaccaccactctatcaagaaatttatgtatgcgttcttcatccatagcggagtcctaacagtacctcatttcaagaaaaataataaatagaaatggcttctagggggttcggagttttaatctccgacctccttgacctcgcgtccctaaatgtgtgaagctgtctatcacggtgagccttgctagctcgtgttagtttgcggactgatttaaccgatcgatgttgtaaatgtgtgaatgattgatcggattcagttaagtgaaaaattaagattgaaagcagaattctttggctcccctgaaatttttttttgtcctcttgaagggaaagctagcatgtgaagttgagaagttttgcgttcttatagcaagaacaaaattaaatatattagaagagtagtacatgtacctcagaagagatcagcatgaatgggaggactaacaggaactataattatttttagccagggctagacaataattttagatgttaaatattttcttcatcccaaaatatagcatctcttaggttgtgttcagcacccctagcttgttcccaacctctcttccttgtttttcgcgcacacgcttttcaaactggtaaatagtatgttttttttgcaaaaaaatatatatatatataaaagttgttttaaaaaaatcatattaatctatttttcaaaaaaaaacttaattaatcatgccgtaatacatgtttcgttttgcgtcccgggaaccccttctcccgaacacagccttagtgttcaaaatatgtcccagaacatagtaacttctccacctactctcttatctcaaccatatatatatatatatatatatatatacacatcctcatccctaccgttcgaatattcttcatttaatttttacgtctgacggagcttggggctcctcaccgggagaccgcgcaggcccccctttgccggttcggccggggaccctgggtgaggttctaagctcctgatcagtggaaagttcgcgagagtggaaacacacaagacacgggcgatgtatacaggttcgggccgctgagaagcgtaataccctactcctgtgtttttgtggatctgtgtatgaagaagctacaaagtgcgagccagccctcgatcgttctgggatcctttttccctcgatcctctctctaagtgggcaaggtcctccttttatatctcaaggggatcccacatgcaccatctctccctctctttcttttgtgtggggactcatcctctcttccctccaacttgccttatcttcattaatggacggagatttgtatggctgccgtccgaatgaccttctgatgggacggcccatacctacctccacttccgccggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccggctagggacgagtgcttggaggctctcgtcctgacgggatggggcgaggcgtgcgtcagaccgcctgtcgccacctaacccacgatctgaccggtctgtgactgatcacagaccggatgaacgagcgcgctgcactgcgttacatgcggcgtgacgcgctcgtccaaaccgcaataaatgcggttaggtgagcgccgctgcgctcacctaacctatacacgcggcgcaaaatccacaaggggtcggggcgccccagccctcggggccgaggcgggagcggtccgaccccctcggggagacaaagaggagggcgaacacatcaccctcgggcccgacgccccccgagggtgccaggccacgtgggcgattgtgtctgcctcaagcctctagtcatgatactcccggtcctatgtcaccgacaacgtcaattttaatttccactgaaaactcctagaaatacttattttttggaaactcaggttgtatatggaggcactagaatataaaaagttagcacgtgaattgatcacagaagtgtgcaaggtcagcatgcaaaaggccaatatattcaaggtttcaaagcatgcatgtacatggctcaaaaacatttgtgatttgggttgggcttagggggcatggggaattcaatgtatacgttccatattgatctagtttccacctcatcgtagcgatgggcctttgcttgtatgcggcttccagctagtgttatcttgattgcgagccgattgtgctctataacgtagctgcagagggtagtgttgccgttagtaagatatgtgatgtttcttcatcgtaattgaacggaatgtctttatgtggcattactcaacatgaatcattgagcaggaatgctttgaatgcgtgaagcatctgtgagattcagctctgcttgatcggattctagggtaacaatgaacaatatctgcacaacattggaggaacaaacaacaagcagtgtctctcgttcaatgtagtgttttggagtaagacattaaacatttaaattgttccgtagaaatagtgagaggggttgggggggtgtatgtttgtgtgtttgtatgccattccacattgtgttgttaacttcattttttgggggtgtgtttgtatgccttttcatattttgttgttaattgtagattagtgaatccatgtttgatgtgtacgtatgccatttcatattgtgaataacttttttaaaaaataaatcggtacttggagtgtaccaattttattgaatattgcaagagtaaaattaaaatgtaatattaaaaatttcttttattgcaataacctaccaatattgcaggtgagagatataggaaggcaaagttgcatgatcgcaacatacaacttccatcatatgccaatcgtgacgctctgtaaaatctccctcgttgattctcaatgaaaatatatatagaagacaaaagcctctactcattttgttcaagcatacatacatgcatgctcgatcagtgagacatcgtgatttgcgttggtgcctatgactggggattaggaggcattgggattaatattgcgatgttcaccggttgatcgagctgatcaagttgcagcgtcatgagagcattctgccttttgcttgaatgcagcttcaggccagagcctacttctgtcatcgatcgtgggtgccaacactagctatcttatctcaccatattgcaaattgcctcctaagaagtagtagagatcttaatattaaatctaaatcttttgtatgtgtgtttagtgaccattgtcgacaaatggataacatgctactgaccaagttggtgtaaccatttcaagcggtcatttctaaaaaaaaatgtaaaatgtggaaatctatacgaagttatgccctatattatattagactctcaatttagtattctttctaattttaaaaattttagacgataaaagaaaaactattgcccaaatggatgctcgtgaaagcatcaaggcaggaggccagagagagggctaggtatctggaggcgaaacaagtgaaaattaaggcagaggcagcatacataatgagacatatccggtgaaaatgagttaaatgttagaaactcataaaaatcatacctaaaagttttgtaaatttatgaaaaaattactacagataggtatagatatgaaatacattctcaccaaatctaaactccaaactcaacttcgtttagaatttgtcttttttgtttctcctaaacgaagttgagtttggagttgagtgattcacccgaaatttgtctcttttttttctcctaaacgaagttgagtttggaattgagatttggtgagaatgtatttcatatctacacctatctctagtaattttttttataaatttacataacttttagatatgattttcacgagtttccaacacttagcccaagataagaaacgggcggaggggaacgatgactgcatctaggagtagatcgagccgatcggagcgagcgcgagctgagttgtggtgtgttgagatcgctcttgaatgagccgagctgaggttgaggtacgatatggactcgattgtgtgggccagccatcggatggacaccttgtccacgcgtcgtgaatccgcgtcgggctgcacggtctgctgtttgcacccggtatgtacagaatttttttccgcggaagagcgttttcgcttgtcgagtcctccgaatcgaccgattgacctctcctccgaaatccgaatccgaagaggagtcgatcggtgtacttgcgatctctataaattaggcacatgctttgtccactgctatcgtacgtgtctggcctgcatgctgcaatggacgtcgacgacgacgacgcgaggccgacgaaaaggccgcgcgccgccgccgcgccgccggcgtggtcgcgatcatggtcggacctcccggtggagatcgccggcgagatcctcggccgagtcccgtccttcgccgaccgcgcccggttcagctccgcctgccgccagtggcgcctcgccgccgccgagctccacggcggcgccctccccccgccgctcccgtggctggtctcctgctacaagggcgccttcgactccctcccctacggcgaccgccactacctcgccctcgactcgccggcctgcctcgcctgcgacggcggctggctcctcttcgatcgccgcgccgccgccgccgtcgccggcggcggcggcggcggcggctacctcctcaagaaacccatctccaaagccgccatggagctcccgggctccttgtccggccctcccgccgccacggcggagatgaagatctgcaagctcgtcgtgatgtcacgcgacctcgtcgccgccattgtcagcaccagcggcggcggcggcggccgcgccgttgccctgtgccggccgggcacgtcgccgtcgtggtcggcgcatcacccgccgggaggagctgaccaccagctaggcgatctcagggacatcgccgtccacggcgggaagctctacgcgttgcacggccacggcaacctctgctcctacgacctcatcgccggcgacggcgagcccaaggtgtcgtcgtgcgttcaccacatagccggcgacgcgctgccgccgaacaagctaccggaggagcacgacgcggggcaccacctcgtcccgtcggccaccggcggcgagctgctgctggtccggcacctgtacagcaggttcctgggcaggcacttcaccgtgttcgtggcggacgtgggcggcgcgcggtggtcggaggcggcggcgtcgagcctgcgcgaccagctcatcttcgtcggcacgggctgctccagggcgctcacggcgtcgcactacggcggcgtgggcgccatgcgagggaaccgcgtcttctacacgaacgacgtcgaggcgtacagtagcacgcacagctatcttgtctacgacatgatcatgcggtcaaatggcccggtttttccaatatatgatgatgattatttacacgaggggaggaggagatacagatacgaggacacacgataccgctcctggttctttccttcttccgtgtaattcaattcagtaatgattgattaatttgattcatttgttgtaacttctacattaactatagttgagtgtattttcagttgtcataagaattactattagcatgttgaaagttgtcataacttgttaactatgagtttgtttggtttggaacgaatttctaccttaccaaaatcttggtagtgctaaaaccttgataaattttggcactactaattaggtagtattgaatttgaactattgtagcaaaatttggtagcaaaccaaatatacacttctactattgaagttatcaaaattttagtaaggcaataagttggtattagaccaaacaagtcctatatttttagttattataagaaatactccctccactttaaaaagaaattttcttgtccttaaaaaaaataccttgaggtacctaaattttataattaaattttttaataacttgagagagtatataaagatcaaattttatattaaaaattttaatacttataccccttattttaaaatatgctccctccgttttatattaaagggatcttgcttctcgtacactttgcgttattggtaggtgaaatcttgatcgccaccaacaaccatgcatgcattcacttgcattgcacgtggtgagctcggcgttcggcacgacgaattgacccattattgtacctgtctctgctgatcaatgaacaatgtcagtgaaatcatgtacataatttccctccttaaatttcacatgaaaaaaaattgaaaacatacgacagttacatttttttccccaaattttaatatacctaacatccagttgatatatttttgtagtgaagaaaaggtgacgaagttataacagcctcgatatatgtaagctgagaccatatagctaggtccatgctagcaggcatatgcaatgggtagctcgatctacttctgctctagctcgctcgctcttcatgctcattgctcaggctttctttatattccaaattttttcttcaaactttcaacttttctatcacattgatcttttctacacacataaatttttaattttttcgtcacattattttaatttcttcaaacttctaattttgacgtggaactaaacatagcctcagtgattggcgcctgcttaatgctaagttaggcctaggagacatcgggaactcaacttgcacatctgcgcagtacaaagcttaatttcactgtggcctagcctcgcggataatcctccaatccgcttcctttcaaacggccttacggtggatgtcccacccagcgtgcaacgaggtgtacatggaaattggaaaattttgtctctgcttcggctctctgctcgtgaaagcgaaagcttctgctctctgctcgtgttgaactctgcagcagcgcaagcatagcatcagtgcagtagtggtgcacatggtgatcgtctacacaagcgagttcctaatggatgcattcgttcgacatgtgtctgccgctgaatgaatgtgcataactgagactaataaatagtgagactgaagtcttttttcacgaacgcgtaaaataattatgtattaatttatttaaagaaagtgggggtttttttacacaacccaaccgaccagatggcaaatacctgtggcaaggaaacaaaatggattgctagtgtcaaaagaaaaacgatgctcctacatagagggggaaggtggcggaagagctccactattagagctccactaatcccccccctcccccggcgctgccgtcgtgtttctcctccagtgttgcaacttcaatctgggcccttgtgctaaagcgagatcaattgcggcgtgcagggttgtcccctctcttctccaggattcgtggtcctccgccgcctggtcgtcaactccaccgccaccgccgcttcctggacgtcaactctaccgctgccgggaacgatcgaacgctgcatctacccttgctcatcttttctctcttgattctacccatcccggttagatgtgttttggtaccgaacggtatcagtatcgaccgatacaacctgctagaccgtaaagacgcaaaaaaaaactagaaataagataaacgggaaaaaagcccactaactcctcccacttgcatccttgtatactggctctcagtatatacattaacagacatcacaagggtatatagctccatgccaacattcaggcatgttgaatgcaaggctatagctctgctctctgctctagcttgtcgatgcttgttgccctgcatcttggctcttgtgcttagtgagtggttagttagggattagtagtcatcgggaactcgacatgtacatgtaacccttcaaatactttcacttaggcctagtgttgcttagtcgcttgcactctgcttcctctaatttttccttcccgtgctcaaagttgaacttcaacaaggcagaaaaacattgtgcagagctggatcatgaagaatgaaagagaaacaggattagaacgcggcgtctggcgggtggatgcgcatcggcgtttgtctccttgtaatggctcgtttctttcctgattacaatctggtcgaccatattcggccaggccgagtaattcaactgcaactatccgaaggacgggaaattttatagtttttgagggagatataaaaaattttattgtaaattttcgtaccttctaacattgagaggtactgaattttacatttatcttcttaagagctgtaaaatcacttttctgggaaatatcacattgttatctgaggctttcttccatcattaaaagggtatatgtcaagtggtaaactcaattttgatagaacactgacagtgaatgaagagaaactcgtaaccattgatgacatcttattaagacaagaaaaggtgatgatgttacaatctcagtaagttgagaccatatctctctaagtgaaagttgaaacctaaagttcaatgacattgagccatgtatcgtaaaaatatgggccatcgaatataacaaatgatacaatacctgccgttggatcatagataagtctcggtaaaaaaaaaaaagatgaaagatcaagattcttcaagaagcttctaaaagatggctgagaaagaggacaagagaaccaagagatggcatcttcatccctaacaataaatacttcttaacctatgctcctaataaataaaatatattggagaaagtattactctaatggccaattctcacacctattggagtatgaacttagtacaagaatatacagcacagtgaatctttgttttggtttgacacaaaaaatatctttgaattaccaaaaattgtattggactacacttgaaatttttttaaaaaaaattagcacactttataatgtaaatgacttaaactttttttattttaagtatttggcacatcttccaaattcagcttgacatataaattaatctgtattaggctcattcggctagaggatgatgggctggactatagcacaaaacgccttaccatcaccccacacgttaaaaagattgaaaggccaacggtctaactctaaatttatgtcattccgaaaataaaatgtatatcgacactaaattgcaaaacagatattaattattcgttttaactggatagtcaaaataaaattattagcttatattttacatgtagatgtatatggacgggctatatagccagagcacgaacgaaatataagggtgcgataagagggccatgcagtggtgagtacgatgggaaggcagcagcaatgatgagcatgtgttaggagggatacaagtatagtgtgcgtgaaaaatgatgtgtgagttttgaaaaaaaaatagtgatatatgtgttcgtatttttcatgcatgtaattaactggaataaaaaatatgtttgtattatcactagactggctgttaatttcactctaccattgactttttgattttcattaactgtaattcgtcatttactttgttatcacaaatttcagctaattactaccaataaacacattttaaatagagaggttatagtcgcgcgaatgcgtgacataatatgctaggatatatatatatatatatatatatatgggccaatgctagcaggcaggcataccgcatctgcaagcgaccatgcaataaaagtatagttctactaattatgctctatctatcttgttcatgctcattatactgctcagtatctcgacgcctgtgtttagtgctaagttaggggttagaaggcatcgggaactcgacatgcaaatctatgttgtgcaatgcttcaactgtggcctagcctcgcgcattggcctgcactttgcttatttggatcagtagccttatcatcgtagcagatctccccactcagcatgcagagtttcagacttgagaagcgagacacacaattggatacttagttgaatcacgggcatggtctggatagagttccaagaccgcatccagcaactcttgatcatctacagctgagcttagcttacctgcataattgtgcaggatatgaaccgtttgtttgatctattctaagtagtttaattcttgtcgttgttctattgcaaaggcagttaaaataattggggcagatccaggataataaaccattggtctgtcacctccattactcagcctcgttcatacatgaacactacagtttatagcagagcaatgcattcccttccctacctccttgcgcacaacaagaatccatcaagcaatgcacaggctactgggatcggtgtgtattgcagtgaaagcgaatgacttgtgcttctccaatatcaaatgcgtttcactctgctcgtgtttaactctgcagcagcgcaagttagtgtcagtgcagtagtagtgcacatggtgatcactgatcagcttggcattctacttaattacctgcgctgaatgtctgtatgtaggcagctgatcgatgaataatgtgactgaaataaagtgtgtcgacccggaaaaaaaaataaagtgtgtcaaatctcccctccttaaatttcactggaaaagatgaacggggtagcaatgccataccaacaacagttaactctagctcctactagtacaaataaacaagacatcacaggggagtatacatttatttatagctccatgccaacaggcaagcatgtcgaatgcaaggctaagctctacttctgctcaaggctctagcttgttgatgctcattgctctgtattgtatcttagtgcttgagcttagttagagagtaattagagcttaggaggcgtcaggaactcgacatgcgcatctctggattgtgagtctttcacttaggcttagcgttgcacgatagcttgcattctgcttccattattcgcaatatcagcgctccaggatgagctccatagtggcatagaaacattgtggggagctggatcacgaggaagggaagtacgcagcgtccggcatgccgatgcctccgttgcacaatgagacatgggatttagatcaattgttaacttgttcttagtggtatcgttcttctaagcaatttgcaacacttcgatctcaattaacagaaaggaaggccggttcttcctcttgatgtttttatcctggccaaaatactcaaatttgcataaatcctgagctgtccattatccgatctctcttacacactagcatttcagtttacccaacggatccttacttctcatacactgggctggtggtatcagagttggtgggcgacggaccacgacgacgggggtagaggaggcgaaagcctagcccagtgtttcactggaccggcagcggctacgccttcaagcacggtaacaaaacacttggtcggcagcggctacgccttcaggcgcggtaaccctcttgggggcattgtcgaggtaccctcctccttcgacgaggatctctaggtgaaaaccatgtctagtctctttggacggacaacgacggcgtcttttgacgtcactaccttcgtgaaggcgttgtcttttttagaatatccgttatgtggtgttgttgtaagcccggcgacgacctgccttgcatagcggcggccggttcggtgttcggctctcttctttgtagcttgtgtttgtgcggttggcatgtggtgtcggggagtgtgctttggtgcacatccttcctcgacaacttgttgtcgatgaaaaaccttcttgtaacatttttttcctcctctatcttaataacattggatgacctccttcggtcatcccgacaaaaaaaaaagtcttaatttttggcaggacaaatattgatcgccatcaaggcaccaaaccatgcattcactttgatgcacagatgcatgtacacatcagagcaatacatccgttcctagctctccttatgtacaacgaaagtccatcaacatatagggagaaataacctgtagtcttttaggctttttcccttctccattttcttggcttatgcttggaatgactcatgaaaagttctaggcagaaggaaggatgtcgagggccacttccttcagtgatggcatctcttcttgttcatgcaagcagaagaaactgccacctatgtttctcagaaccttccaaggcccaggataacacctgccagacaacaaagtttcggcaaaatcacacgtttaatctccacagtttgctccataaaggttctgaatgcaatcatgtttttctcctgatgagataaacatactgcaacttataccaaactaaatttctgcaactacatcttggtatggtgagttgatggtaacaacaagctgaatatatttgtttcaaagcattacatatcaagaaacaatagccatgctggcgatggtgacaataataacaataaaggatagaacgcaacattcaagttgtcatgttaactagagcatcattcaaactgggtaacagacaaaatcaactagggttattggagtgtaagtaagttaattatcttgccaaacacagttaatcggatcctccaaaaagtatggcagctgaaggcatctaatttgggtgccatatcattggtacattgattcaagaatgattggccaacataaaactgtataatcagtcaatgaattaattaattatagctagaccaaaacttgctcatgcaaaagcatagacatgagtcagtggtgctaattttggagagcaacagaagaaggctggaatatgcaaacctgaaaagtgttcctcctttgagtcccttaaaattgtgaatataataaactgtctccagctttggaagaaatgttttggaaagttccgctagctttgggtagaagaaaggagggtagtctttgattggtcaaggaaatgaaccaacacaaatgatagctaactagaatttcacaagcatactattttcaaacatcatcagcgcagcttctcttttgttgaggaaagtcactagcactgcaaaatttacacatcatttgtgatgcaggaaaacaggtttgatttaaaaacaaatttaataacttgtttggcataagatcaactgtttggcatcatatatgcactagaattagcagtttagcacagaataattagcagttttgtcatcatatgaaatacaaactctaaattacaaacaaggatacacccacttcttattcgatctagttccccgttgaatattatcagttttcggtctgtgctaacaattgcttccttgtaaagctcttcaaccacaagcatttctggaaaacatcatcatcatattagtgaagtggtaaactcaacttcgatagagcaataataataaacagaaacacataccattgacattgaaatagggataagccacgaggaatatctcgtcttctggacgcacacggtctgacattttgacctttgttgtaaaaccaaaatcttcaaatagggatggttttgttagataatctagcttcagggaacatccttcaaaggcagattgtcttgcaaatgaaacttcatttgcctcagggaagaactgaaacatgtcagataataaaaatggaatcaagcaggacatttcaagtttaatttcagcacactggtttgtgcttcaatcactggtagaaaactgccagtgattatccatgtacaactttgtctttttgctgtttataaatgagagtcaggaatacatttacagattagcctgtagtactagttactagaaaatggtcagaacatacgattctggttcttgtagctttctcagcagggacaaagcgatcacagaattctcttataagaagcatgcttccagtcatctcaattccaccttcactgtcacctaaaagtaaaatagaatcttatatggtatcctttccacctgagtcctgaccaatatcttataacaaggtaatatacataaaggttagctatgtagaacctggtacagattgtagtcctgctgtagggaactcaatttcctgaaatacattgcatcacaatttcttgtgcaaaaaaaggaataaaaaaataagtcagacagtggacagattaaggctttaccaatagctgcttcccatccttaaaagctgactcagcagcttcttttgcctgaaatcactacatgtatagtgaattagtcattcgattattctactccctccatccctaaacaagtgcatagtttctggttattacagaaatacagtttccagcttcagtatattggatatcccagtacaaaattacacataaacccttcatatgttattttttggacatctatccacaacgatgacttcgcaactagttcagtagagtgcaaaaaatgagacatctaaatgcggtgcctttgattatacacctatggtgctccatcagaacaggtaacatgcacggaaaagttcagtcttgctgataagcaacccatcaagattctttttatgaggtgagatctcacaaaattttgaccaaaatgtacatgaaccacccatatttcagtaatatcatcacttaaaacaaacagctggcattgttaattcagtaatgctgccactgtctgaattttttaagtgggttaactggattatcttaattgagcagttgcaatagcgagctacatgcttatagttatatatactcaagtaaagagactaagataagcatgctttatgattatcaactatcagtgaacaagttttcacactctgacattaagtacctgcgctagaagttcagtgtaatcgcttgggaactctgccccagacacattgcgagtgccctgacctccattgacggcacaaacatggaacccagttcttaaattcctctttgttgtagtataaataccaccagtgtagttgcccttgcctttgctgattgctcgaagtacccaacctgggaccttgaaaaaaaaaatccaagacaatgcataagcagaaatgctgataataagtacaacattaagaacaaaagatgttgtagcttgtttgtgatagcatacctgtttattgggaaaggaagttttggataatggaggattggagatggagcaataactggttgccatggtcactgaacactggggatgggattggtgtgttggagagggagggagggagaaacaaagaaggctatgtggtaatgtagaaatgtttgagcagcaatctgtttgtggggccttactgtgtggtctccaattggagagagatgggggaaaatatcttgtctgttatgacagttctgtgcatatgctgccattgggtgataagatggagacgttttctctgctagttttgttttaaaaattttaagatggtggacaactatacagaggaaatctagtattttgcatatagcagcttaaaatcttggttgagaaatgagttgcctgaacagaagctgagtaaaaacaagcggtttaatgctccagtacttcaccttgcctttgcttctgtcagccatggacacagaggatacctaccaattggcaaaatgttgttttgagcttctcgatgttagccttgtaaggaatcctcagaatagaacggagtgaggtccagcataatgaatactttcagtaagcaatttccatctgggcatatcctggcctcgaccaaaaatcggtgtctgaactctgaagccatgaagatcgtcaaaaatagtagaaagatcacacagaaactttccgaatccattctgacgaccatagcaccaaagcactctgcctcttctacttcggcttatctgctcaagtctcaatccaagtatctgctaaagctcgacagaatttgacagcaatacagtacagcgtcgcacaccgaaaccgaagtcagaaagctccccccgctctgcagatatgcttcctcttggtttagctagaagatcattgtcagccacgattagccattccccgatggcatcatgtcaaactaaagagctccctggcctcggcgcccctcctgctcctcgcgggggctcgggccacgagcggaatccctcgtcggcattacgtcgaacaccacgcgggcgtcggcgggcgagcatccggttccagatgaagcccagagccatgctggttgcagacttgcaggcttgcgagctccacgcgaacgcgcggcggggactactccgctccgctagccgggcagagggtggtgatgccgcgatgcctgaggtctaccggaggatatcgccggcggcgtgctccgacggcggcggaggagaggagcggcggtggcgtctgcttcgggtagcgtgtttcgccacgtgtacgaatctcggaatgtttccaggcgcatccaacgacctagagtttcttaaacttactatggaaagataccacagaattcttgcatccaaacatactacctccgttttttaatagatgacgccgttgactttttctcacatatttgatcattcgtcttatttaaaaattttatacaaatgtataagatataaatcacacttaaagtactatgaatgataaaacaactcataacaaaataaattataattacataaattttttgaataagacgaatggtcaaatatgtgagaaaaagtcaacagcgtcatctattaaaaaacggagggagtattatatgagaggaagtttaatagtatagccaactgctggctctaaatcatctatagtcaacttaatagctaattcatacaatagttacttataaacatatactgcataattaatatctggtcccacatgtcatacacatgcaccttggaggaaccttaagtccgtgctacagctggctacaaatctgtaagccgttgcccttctctcttctcttttatctcttcgaaatgtgtttatagctggcttatagcctgctattgtacatgctctgaagtaagtatagtacatttcacatgcatcaatgggtactagatcttttatgcaaatgtaggtgtagaaatggaaaagaaaaacaataagtgttttgcaatagcaagcttaatcataatgattcaactataaaaacttcaacatcctcattgcaaataaatcacctgctacttgcatccaaaaccaggagatgaattaaatctagggaaaaaaatgaatttaacaatcaaaattatagtttaacgctaaaggatacatatcctcgaataggtgacgaagtaacaccaacaatcaaactaaatggtggttcttcctaacaaacatcaccaagaactctattaccgaacaaatagaattttccccatgactaatttatcagaaaaatcctgcaaaatccgctccttccaagagatttctaaaaaccctgaaacaaacttgtcgcaaaaaatcacatggctcctggcggtgcacctggatggggagctgggagagatgcattgcggaggaccgacatgagcaggtggttgtgcaaccggatgttctctctgccgattgtctgaataaccaccctatcgaacatcgacttctccatccttgaacccaagaacatcttcaagtatctaaagtatcgctcggatctctcatgcccaagccttgtctggatcaactgcttgatctccatggtgttgatgcgacttgggtagggagggattcttggtatggtgagcggtgtgttgctggtgctggtgtttgtattagattgtccttgagcattattgggactgcaaaacgttcagagtcaatgatgagcaaccatatttaggcatgtttagacagtaagtacaaggctatgcaaataagaggggcatgttcagtttgaaatgttcactttttagccaaaatgagcttaaaagtttgtaacaaccatgtaacttacatgaaactctctgtgatggactaggaccctccaatgaatggaggaaaattagagaattcctacaagaattgaactacttcatgtaaaagacccacaaaattcacacattataataaaggagtactgaatgtttgtttgagtaaaataattgtgaccaatgcacgttgattttctttttatacacatagaagattttacttttatttctcttggaaaaaaactatatctcatatctcatatggctttgatttcaaagatctccccgtctcttttcagattattcattggattatgtgctatatcttaaaaaaatacatcttctaaaaaaattttctactgtattattaaatcatttaattttagctattgttttttatttattaaaatattgaatttatctctttagttaaatagactattaataatatttctcttaataatatacatataaggatgtgttcgatatatttggttggaaactaatcccttggacatgttaaatggagtgcctcatataataattaattaagtactagtttaaaagatttgaaaataaattaacatgattttttaaaaaacaacttttctacaaaaaattgttataaaacatacttatttagtagttcggaaaacataagcgcgaaaaacaagaaggtgaagttgagaaagggaattataggagggcctatttagtttggtgtcattttaaatcataccactatttgataaaattgataaatatatagttgcatttagtttagtaatacataggaaattttggtacaccatatttgtctcatcctaccaaaatttagtaattctgtcaacttatcaaaaatttagtattatcaaattttggttaggttaattttagcagtaatctgaacatgcccgaagtcaactttagtaaactacttatagttggcagctttggcgccacgccagcaatttctgcctgtggagagctctggcccactcttcagtcttcggattctccactcttctctcctcccccgcgcccgcagatcggcgcgacggcgaccgcggcggcggcgcgcgatgagcctgaagcacccgcactctccggtgctggacggggacccgccgccgcaccgccgcccgcggggcctcgtctccaccccacccccacccgccgtcgcggccgacacctccccctccccctccccctcccccgcggcgcctccgcctcggcggcgcggcggcggcggagggggaggcgagagggagagggagagggagaaggagcggacgaagctgagggagcggcaccgccgggccatcaccagccgcatgctgtccgggctgcggcagcacggcaacttcccgctccccgcccgcgccgacatgaacgacgtcctcgccgccctcgcgcgcgccgcagggtggaccgtgcatcccgacggcaccaccttccgcgcctcgtcgcaacccctccaccctcccaccccccaatcggtccgtgcatcttcaccaatctcctgcttctccctccacttgtttattatcatttcaatttattcagttcagtttactttgccttcttacttaccagtgcatgtttactgttactgtatcggtagtttgcgtttatctcttagtgtacaatgatatgattggattttgtgagaaaaaactagtcatcttctaacacattgttgtttttaatgttatttgcagccagggatttttcatgttaattctgttgaaaccccatcttttactagtgttctcaacagctacgccatcgggacaccattagactcgcaggcttctatgctacaaacagatgatagtttatcgccatcatcgttggactctgttgtggtggcagaccaaagcataaaaaatgagaaatatgggaattcagattctgtcagctctctgaattgtttggaaaatcaccaggtaagaaaaacaatgtcatttgtttggcttagctagtttttgatattccaacttgtgtaatccctcacagattttcttttgcctactacaattcctaagatcaaaattgtttgaaacactttcaagttcattctgaaaaagaaaaggaaagggtgcccctacattgacttgaataatgggtaatatatatgtgatatatgaaaaaccaacttgtagataatagtatgaatgtagttgggaaaagtgatccttctaatttttttgccactacaaaacttgtatggaaggaattgaacctcctccattgcactcgactcataggtttgtaacttcacataaattggatccatgccattattaatttgccagtttagaaaaataccattataattcttataattgaaacgataccactacaactatcctcaaattgaaaccatgccatgttatacgcctttttttctactgtatttttgtatggaccaatatacccctatcttcttccttcctcctcctctcccttctgttcatcttctctctccatctcttcctccatcgatgcagccagtggagcttgaggtcgtcttgcctcctcctcttgcggcgctgctcgtgtgtggttccacggtggtccagctcatgggcggttccatggcagggtcggccgatggacacccagaagaggagcagcgagagaggagcggcgacggcagggtcggggcgtgcgccggtgccgccgctggggctgagccagtccccgcagccgttcactcttcctcctcccatgctgtttctgctgttattgccgccattggttccgtatggatccatgccgccgcgacgagcttgttgacgtagctcacagccagatctgctcgccgccacgcagcttgttgtcgttgccgggtcagctctccgccgcgccgagctgctgtaggaccatctgtctccgagactttgccgccgctgcgacgagctcgccgccgctgccggtagtagtggtcttgtgtaccagttagtcgctagaggagagggggatgcggacagggtagagcgatgagtgctgccaaatcctagcccctcgcctccatcgttgccggatccgtgccccctcgcttgcgtcgtcgtcggacccacgtcgcctgcccccttgcctggacgctgtcggatccatgcgcccgatctgccgaaaaccgccgccggagagaggagcgctagccgagtcctggagcaacgcccgacgctgacaagagggatgccaagctccgccaccggggagagctcctgctcaccaagagtgagagagagagagagcatgctcatgctgttctaccgaggaggataggaaggttgaagatgagggcatttacgtcaaatttatgtaaaatatgtatatcaatggcatcattaaaattacaaatgaacagcagtggcacagttccaattaactgaattataatggtaaattttcaaacaggcaaatttataatggcatgaatccaattaacccatgacctaaagaaatctaacaaattattttcattctgaactgtaaaattaattgctatctatagggggtagaaagttctacttctgtattgcagtagtgtttttattgtattatgtaacagttttttaatggatttatatcatgcaaatattggaagctagaatagactgaagacctctgcagaattgctgttcaaaacccacaaattcttaaaatttacacctcggcttttccttaaagatttctggtttattatatttttgttggatgatttccttatgttttccttctatttttgagttttaatagctgacgagagcatcagcagcgctggcaggtgattacaccagaactccatatataccagtctatgcttctctgcctgtaagttcctggcagacttcttgattgatatttgatatgctaatatgttatcctcaagttcttcatttgacacatgattcagattttataaatggcttgaacggagtgttcattttgttactaaacttctgaattttgtacttcggaaatttacatccttggctttttttagcttttatctattgtccctagatcttgtgcttaatttgtttcttttgacttgtttggtcatttagctttttttttccccaataaacatggtggtgtggctatggcatattgttggttggctacaaatgccatcaaacgcatgtttttataagaatacgaggaccatagtgtcatataacaaattctatgtaaccccaattaggggcagtcacacatcaccaatcaaccaaagttaatacagtaccaggtttcacaaatttatataaacctattaagttgatctaaacattacaatgcagtatatcttaggtaagcatgatgtttggataaaagaacatgtcacctttcccagttagcagtctatcatgaaaaacttctctgctttacgaaaatgaagtaacaacaaatgttctaataggatataatagaaatttgcaatattgcatgcccacaaactcaccgtgtactggaggcccgttgcaatctctccgtggctgagatgctgtcagtcttcgcaactgacgccctctggtcatcgccgccgtccttcatttgctgctgctgctgcttccctaaactctggccctctggctgtgtatctttacctctctgggaacgtgtcatgggcgccatggagcagaacactactgctgccttgtccagttgctgtagcccttccgtgtcgcctgcgctctgctcgtggcgccggctgatataagaggacgaggacatgtgtttgagcaggcactactttttatcttcattttagcactatattaatcacgtgacagctacgtgctttgctggaatggattgtatgccatgtaattaccataaaaaacaatttcctttttttgttgtttttcctttgatggatttgggtagggggaggtgcaagttgcacaaattatggtttcgtctttatgattttcttttttactggatttactcctggttgctattcctctaatgacctgatggatgtaaacctttaacttctatcatagcaacaaaattggcatacgatctatttagctgactaataactactatgccatgtttatatcttctttacccttgttaaaatcacattctcttatgatagagagaatgtttccatttctgtgatctatatgtcatatcatactatacttgagcagtgcttctgttgctgcagatgggcattatcaatagccattgccaattgattgatccagagggcatacgtgcagaactgatgcatctgaagtctttgaatgttgatggagttatcgttgactgttggtgggggatagtggaagcctggattcctcacaaatacgagtggtctggttacagggaccttttcggtatcattaaagagttcaagctaaaagttcaggttaggcatgttatcatggttgtcgacttcttggatacaaatattcagagacatttttgggatgttagtaatcacatatttgctacttatcatatttatttaatattgtgcacaatagccattacgtgaatgtgaattatagtatgttgtggacagtgatttctatagatattgaggcactaaatagaatgtctatgcagaagacatccataccagtcagaaactcagaattggatttttcattttcgaaatattatatgattaagttttgtgcataacttgccagcatcttgtaacagtgtgaaatattcaacttagatgagcttttcctttttaccatttttatcacaatttatcttagcgagtttccttcaataaacttctcaaggctgtattgtcattccatgggtctggggagactggatctggtggtgtgtctctcccaaagtgggtcatggaaattgcacaagagaaccaggatgtattttttactgatcgtgaaggtaggagaaatatggaatgtctttcctggggaattgacaaagagcgagtccttcgcgggagaactggcatcgaggtattgggtcatccttggtaaattttcttctctcttgcttaaacttacctttagcttctgtgtctattacaagatatagaaattgttagtttccttagatgagcactatttatttatgcctagtgttgtttttagtgcatttaattgtccgtccatctttatgcactgtgctaattgtagtatatattgcagatcataatgttagagtcttggtattgaaaacatagaacatgtatgctatcttctttaatattgtttcatattgcaccctgattgatgagaactagtattctgatacttaatgggattatatgcaggcgtattttgatttcatgaggagctttcatatggaattcagaaacctgaccgaagagggccttatttctgctatcgaaattggattgggtgtttctggagagctaaaatacccttcatgtccagaaagaatgggctggagatatcctggtattggtgagtttcaggtatttacttaaaattcaaacttgtatcaagatagggataaataaggcatttttcttcacagtcctttccactagattaatttaaatatgatagaattacaatcatgcactgtttttcatttaaatatgtagaatcatgagtactcaaaagcatgtcactgcttgttcatatttgtaggttatatactgcctgggcttttggattacaatacatatctgagttgtatgctacatctatgatgcataatgctagcttgcataaaattttcaacattgcggaattgcctaaaaatatactggatgcatttcttttcttttattgatttgcattgtcgacagtgttacgacaggtatatgcaaaagaaccttagacaagcagcattgtcacggggacatctgttttgggcccgtggacctgataatgcgggctattataattcaagacctcatgaaactggctttttttgtgacggaggtgactatgacagctactatggacgctttttccttaactggtattctggaatcctcatagatcatgtggaccaggtgctatcacttgctactcttgcatttgatggagtcgaaactgttgtgaaggtatgcactgttgttctgtaaagttttattttaacattgcaccggatcttctctaagttctttagagaacttctgcatatatcccatgttattttccttttgcctagctatttatcaatattacggtttgataaactgagcacaaaatgggtattcctcttaaactaggcaccaaaaaaatcaatatttcttgtcttatgcataaaaagaacttcaatcttagtatggattgtgctcttgtacccaaagcagcggaagattactcaaaaccttatacatagttgattgattgaaaatcattacctgcagcccagatctagacagtttggttgtaagtctatttgctactggataatatatcactctgttattaataataggaaattaaggtcctatgctctgatgaatctgaatttgaggatcatatgagcttgcaaaattatgttagcatgtgttaaccagatcatttacctgctagcacaaaacattcacataatggatgtagaatgtgctgcagtgagaagtccatggcagttccacatattttgcaacctttgcctgcctgtttgtctattccatgacaaaataatttctttcagattccatctatctattggtggtatagaactgcaagccatgctgcggaacttacggcaggattctacaaccctacaaatagagatggatactctccagtgttcagaatgctcaagaagcattccgtaattctaaagtttgtttgttatggaccagaatttacaattcaagagaataatgaagcatttgctgatccagaaggtttaacatggcaggtgagaagctcgagctaaaaatccttttcagatctgtctgcattttttttgtaccttttgctcccttgggttaattcggtacacatgaagcaggttatgaatgcagcatgggatcatggattatctataagtgtagagagtgctcttccatgtcttgatggtgagatgtactcacagatccttgacacagcgaagcctaggcatgatcctgaccgtcaccatgtctcgttctttgcataccgtcagctaccctcattccttttgcagagagacgtttgcttctcagagcttggcaactttgtcaagtgtatgcacggttagtattaccatgcttgtcacttctggatactcctgaatacatactttaccatgttttttttcctcttttgagaaaaactagctatcttaccggcaaaccgtccttcatataaccatgcggtctatccaagacttgatgtagtcttagcattctatttaatttgagctagattgttaattcttccatccgcattgtgaatgaagataaactgcgtgtagaaaaatgcaaactaattgcctttaacatagattgtttttgcatcttccatgatattaccccgcaaagggtatctctccgctcttcgtcccttcctgtggagatgctgaattcgtaacataaccgggtaaaaatgattttatttacaggggaggctacccagattgtggaaggttgaattccctagttgcattatatgcacataggttttgaaacaagattaaagaaaggagcttggtttggaccccagaaaccgtcgatgcccgcggcgaaatctgctgcgcgattgttgtaaagcttctgttgtgggttttggaggtggtaagtacggctcaaggcaggataataatagcttagcaactcttttttttttccgtggaatggtatgaatttaacatcagagaaaatgacgtgctgtacattgtatacaaccatatagaatagaaatattgtccttatttaggtcacaaatgttaatccctttctgggatgtaattttctgatggttctgtgtgaaatacccgcggaattttggaattggtctgttcaataggggcctgaactggacctagtttgaaacacaggtgttcctaacctccctccctcgttttcggcgtgcaggcttttcaaactgctaaacggtgtattttttataaaaaaaaattctatatgaaagttgctttaaaaaatcatattaatctattttttaaaaaaaaatagcaaatacttaattaatcatacaataataggtgctttgttttgcggggaggagggctcccgaacacagcattaacctagtattttagttttagcccattgaggcccaactgtagagcccagaccactcgcctgcctcagttcatggctcatctctaccaatttctggtgggccaaaggtaggccgtttatggtgagccaaatggaggcccacatttgcgcggagaaacgaaccgtcggcaaccacgcagttgggctcggcccgtctcagcgatcggttggtgggcccaaaatgcggcccagttttattcggtgggatcgtgggaaaagggcccgaaatcccgatgcggcccgcgtgtttggaatcggttcggaatttttcaaacaggtccctgatcttaggattgctataattggtgtttggtactaatgatcctcattttttttcagatggatccctgattaagatcgttgttagagtacgcaccattattgctcatcaatccggatcctctgcattggacgttctaatgcagaggttgacagtactgtgtattagaggagttagcacctatccgatcaagatcataaggtcccgatatcttactacagtaattgcactgtagtagtgcattaccatatttttgttactgtgatttttaccactatattgatggagaggatccgcatccctcataaatggaatcctcatccattactcgttatttattccataaaaaaaatcaacctgtaaaatcatatgataacaaatatatacaagactttgttcaaattcattgttttaggatataatatcacaaccatatgagttttttttaccgagagattacttcattagccacttatttcaaatatgacccttaattttacatatagatccctaattattatcaagattattgcagacaggtcgcccaccgaggttgatagtgtgagagacatggccccacttggctcgcgctcgccgccgatgagctcgccatggcgcgccgcatcagacctcggaggcggctcgcacgcgccgctccgtctcctcctaccaccacctcgtcgtcgtcgccctcctccgccgtctctccgcttccccccgccaaaatccaccgaatcccataggcggcagccgggactggacgatttgagccgaatgcgctcgaggtgacgccccccacacccttccccgatcccctctcctgctccatggttgcttcgaccagattcgagattaccttacccatgattagcgttgatgatttgctgctgcagttgtttcaaatggtgacgaaaaaaaaaaagatgatgagcacatgattggaatctcgtccgtggttcagctgatcagttccttccatatatttgggggaaatgtgtttttttatcgctgaaatgtggtaagaaatcaatcatgaactgctttatttatcttttttttttttgaaattatagctgcaatttgaacttgtgctcttttttgaaattatctcaggtgtttattgctcccttccctcacctgcaaataataaattggttgaaagagaagagttcagaattgcaaatggaattaggttgaaccgtcactttcctgtaatttaatttgtacggtgtacttatacattaagatgttgccaaaatgtgacaattgcgtagggaagatgttgacaagaacatggcggcttggctatacgaagatgctgactactttgttcatagtttagtcatccgcaacgtgaatcaggcctgcgaatctgagacttgtttaactcaaactcctccagattcgctgtattagaaccgttgaattgaatcaaaataatactatgtaccaaagcttattcttttttatgtcttttcagtgctaaactaggttgtagtggagtagtaggatgccattgaaatttagattattgggagagtataatgcccttttactcgtcatttgttttctgaacttctggtaccaatcctgatttgtgagggtaaaattggattaccaaacatctcctgggtttagatggttactgattgtgagcaactccattagaatttggtagcttcttatttcaaagtgaggagattgaatgattgattgcggtaacaacttcttgtttctcgccaggcgaggagccgatctgaaaggaatatgaagtagccaatgatgatctctatgagtatatcctttcttcagattaagtatgtataatgccattgaaatgcttagcatgacacttgagattaagtactctacaggctacagcattgaagcgattagcatataccacttcttcagatcaagcatacaccattgaaatgcttagcatgtcacttgggactcggatacaacatgggaatgcttagcttgccacttcttcagattaagtacacaccattgaaattcttagcatgtcacttcacataaccataagaaacatgaaaaccggagtacatacacaatcatagcaagaaacatgaaaatactggagtacatgtaactttgcacgggtccgaaaaggcagcagaaacacatgcagcagagatgactgggctgcacctcctgcacagctgcactgccagaacggacacactatccatcactgcgccgggacagaagaacagcacgcaatctctcaagataatttcccagagagacgcaccccccacacccaacccaaccttgcagaagattcccaattccaccagagaagttgcagctcccctctctctgcatgaatgaatgaatgaatgaattggagagcagcagcagcagcagcagcagggccaaaggagaatgggaccattgcctgaccaacaccagcagcagcagcagctcaggcttttcatgtgctggagcctgcctggaacagcacaagcgacagcagctaccatcaaccagctccatcacaggagcccaccatgtttttgatctgccacacaaatcactcaaagatcaaagtaccctgcatcctccccagtattccaatccagctgatctgtgtgtgatcttgtacactggtactatcccccagaataattcaactgtaaaccacacagttggcacatgaaatagtagatgcgaaatcgacggcttgccgatcccaataccatgtgacaataacatattcttctttatgtttggacaaaagaaaaacactatatatgtagtactgctcaaccatgttagtatcatcatacagtgatggaactagaatagtttaccacctccatgtttgatcatggtacaggtacggagctaaaatattttactgccaccatgttagaacatgattagaaacaaaatactacagtatatattgtacaaccaccacaccaacttgaccttattgcatgcactaaatactggaattttatcaggctctgctcatccattcaaatctatctccggggtggtggtcagatatttatattcttcgacagcttttcagaacatgttctcctgaaggctgtcactggcttttagcagaatattctaaccactaaaaatttacacctcactgatcagggcatccagctcaaaatgtagggaatccacttttcatggaacaagttcaaatgtccagctagtgccaatcggctactttgtctcttccttatctatctctgatggaaaaagaatcttgatctcgcagcatatattcccacaacaggttacaggttttctttttttttctttttataaacaaaaggaacccaattccaactttggttatgagtcaccgaatgtgatatgcgtcaaatcataggaacggtgaatgcgatgcttcttggagactttgaatatttgtacagtgagaaaagtgtcttgcctgtgaaaatgatatgattgataaaaagaagtccagcatcttaccaaaattatggatgaattatgcataaatagcactctgcactgttactataaatcctgaagcaatacttgaaaccaggaatttttacttccataacttccattttaagcagtataaagaggagcatgcgaattgttagacaacaaataaagctgaatagaaaccattgttagtttatggtgaaagctggatctatcaagatacccacaaaactagaccaatcaatggcctgacatttgaactaagactaggtcttgtttaatttatcaatgatttgtactgtgtttactatttcaggcagcgcagccagcatcaatccagaggaaaagcacatccctacaaatagatacatatgcaaatatactagtactagcatggatgcaaaaccgttgagcatcaaagaagcccattggttcaaagttgtacactgtgaaggaatttaaaattatctccagaacaagattaatgcattttggcccggcaaaacagatcgatgcttttttttcaaaaggaaagccagctgctttttgatgtagtaaatctatcttcccgccgttgaatcaatccatgaattaaatacttcgacaggccattaaagaaaagagttaaacctgtaaacttaagaaagtaagtttgaaagtttacctcaaaacaatttacaattacaacataaattgaattagtcattttcataacatcgataaactagagacaagtagttttattgcactattaattaaattactcagctatatagcacaataattcacttacctaggtcagtagataaactagataagtcccaaagttgtttgaaacactaagtcttttttcgcatcactaattatctccggtctattagctttatcctcggaattagatcttaaaatacgagaaaggcaaacttgcaactagtaacctgtttgtttgaccatggctaaggtctatattagcgataagcatatgcctctgttaggccaaaagggcatgtagaaacttgtagccacacacagcctctaacaaatagcatgcatttagaatcaaagttcttaatttccacaactgaacagagcaagggcaaggccacaccttattggtggcactaccagaattagcatatgccatgaagaccactatgcagactacagcagatgtgctaaattaagcatatacaggattcagcatgaactcatggtcacagatcattataccaaaatgaattcaccataatttcaaccttcatcttaattagcaaccatgatagacccgtactagcagtggtagattcagattaacaacatccatatcaataaatgatacccacagttcaatcaaagcatagatcgcaaataaacctcatctacccaaaaagacaatgagattcagatctttttcccgctaattctaggtggcctcccctgaaaccatactcctgatactgatacgagtaccaaactcaggatagccaccaaaaattaggggaaattccaacttgataacgccgacacgaatcatagatagaataagtaatcgagaattaggcaccagatctagatctgaaaaaaaaattaaatctaatacaaacgcgtacgccccacacctacgaacacgaacacgaggaggatcagcaattcgatccgattcatcgctaaccccgtcccgataccgacccagaaacgaaggagagacaataaaaacaaccaagcagcgcagcatcggcggcggatcggcggaaggagggcgctacgccggctccgattcacttggtgcaaggcgggatccggccccggcagcggcggcggcgggtcccgatctgcaccaagcgagcccgaggcggcggcgccatgagacgagacgagacgcgcggtgtctctctcgagagggagacgaggtggtggaggagacgtggctgctacggcgaccgcgtcttcctcgcggtggcggtggcggtggaggtggagatgaggaggagatggggattttatagcaggggggggggggggaggttgggagcgtggttagggattgatgcgtgagggagggaggcgatgaggaggtgggcccccactagaaaaaaaaagaggacgtgtttagttccttcgcattttttttaaaaacatactaacacatttaaaatattaaacgtagactaataataaaataaattacagattctgccaacaaactgtgagaaaaatttattaagcctaattaatccgttattagcaaatgtttactatagcatcacattgtcaaatcatagcgcaattaggctcaaaagattcgtctcgcaatttacatgcaaactgtgcaactggtttttttcgtccacatttaatgctctatgtatgtgttcaaatatttgatgtgacattttttgctaaaaaatttttggatctaagggtgtgtttagttcacgccaaaattggaagtttagttgaaattggaacgatgtgacggaaaagttggaagtttatgtgcgtaggaaagttttgatgtgatagaaaagttgaaaatttgaagaaaaagttgagaactaaaccaggcctaaacacaccactgtgtgttgtgtgcgcccgcggcggcagcgtcttttctaccgcaccgtcttgttgtggtagaatactggtttttagctcttactctatcaagtttaataaatactagtggagtataaaataaattgaattttcaaattcttagaaacattattcgggttttatcggttttcttacatcaaactagggaataagaccacaacaccctgtcacccttcctcgttccttcactctttgcctcatcatcaccatagtgattttttttgtcggtgttctttcctctctcttttttcttacttttccaaggctttgtactttctcccacactcccgtttcgtttcaaaatatatacatgatgatgtgtatcttgatagtacgaattcctattatttagacttgtagcattagggtatatctcatctagtattatgtggttgtattttaggatgaaaaaacaaattttgcttcaagtcttttcaattacttattttatctttttatattttatttatatatatttgttttacaattgtcaggtactccctccgtttcaggtccccatcgtttggcttatttcctaataagctaaaacggcttattaggaaataaaaatgaatttgtaggtgaaacttttataaatgtgttattggtgacttaaaagccaatgttgtaaaagaaaccacgttgaaaatatctcaaaattaagtttaaaaattcaaattttggctttttctttggcttattaggtcatccgatggaagcctaatgtgattgtgagaaatgttagaatgacttacattgtaaaatggaggaagtagtaaagaagaagatgatctaacataggtccgtcagtagcatgttgttcattactcgaataaggtgatggtgatgtgtccatgagaagatatgctcgaataaaaatgggctaacggcgtcatagcaaagaatattggaatggtcgtatggcgattgtcataatcacatcagttagggctccttttaaacacatatggaaaaaaagaataattataaaaaaatggaaaaaggatgtcaggccatacgaaatcatgcatgaattgaaaacacacatgaatttatcctattggtggtccggatgttccagaagaaatccacatcaattttagagaaaaaaaaatatcattgaagtaaagttaaggggagagggagatggagagatgttgtcttgaaattctctaagttaaaaaggagtataaggtttgaactcagtctcaaaattctcaaaaaaaatgaaggaatggaaggattttttttcaagtaaatccaagtaggaaataatcctatagaatttgaatcctttaaataacctataaaaatccctcgtttcaaaggagcccttaagtttagtgagaaacgatgaaggcactctgctagttttctagccgtcctcatatctggtgaaaaccttgtggcgactggtcttgctcttctatgatgagatgttggagcttgcttaaattggagtatgtatcatggagtaattcatatgatcgaagtacgagctgttcgatagaacaatcttgctatgctagtgaaatgtgacccgggtagctatttctaattatcccatcctttatgagtgtgttttggttagaatttagtcctgacctcagctaggatagctgcgcaagtttgattactttttaaaaccgtcaaattaggtaatttgaactttgaagaaagaggaagactacagtgattgatgccaaagggcgaggcaacatggagtagtacacaattgggtgagattgccagtgattttcaacttatactaggaaagaaactgataatgtttaaggctcatttacacatacaacataagaattctataggaatttcacatgaattagttgaatttctaagaaaaccctccaaaactcctttgatgtaaagaaggccttgtactttttaagtacatcagcaagcccataccatttacatcagcaagcccttaccgtttgttcctttgaagtctattattgtgtctggcctaacttgaaaaggatttttgtactgcaaagtatgattttgaaggctaataggacttctagttctagaagccgaataggactcgcatgccaatgaaatgtctagtggcaaattcctctgttttatagcgagtagtctagcgtcgaattctgaaccaacaatcctctagtagttagtactaccttaaaataattcctcggcatgaaattcatccaaaaaaacaaatatctctattttttcactctattcgaagaatcgtcgtgtcgttaaaaaaaagtaggacgtgttcaagaaaagtcaaaaacccaaaatgtttatggaagaaaaagagaaaaccaaaagaaagtattctagatttggtgcatggaaaaatcatactagtaatctagatgcagggaatagcattgtgtttgtggagagaaatgtttgtgaggtagaaggggcagcattgaggagaatcttgttcacatgggagatacaggaattccttgtgggcacctcaccttgagagattggaccaaagaataaagatggagaggaaagtgggatgcttacgcctaccagcccttgctttctgccatctgtggactcatctgcctctctcacatgaatggagcaaaagaaaatgtcatagattacacatggtttcctttggtttggtctttggacacatgtaacctaaatattttattgtcagaaaaaataagtgagcacttttgattctttgtgtgattcgtggcaataatttcttggatgtattgtaagcttggatgtgttcgctgccaccgcaaacagggaacatctccttttttttttcattcattcttttttattattagagttgtattgcaaaaaatagatgccgagaatatgtttttcctctaatgattttttttcaaaaaagtggatgtttcatttcattagtaagtacctttgtagataataaatactatgtgtgtcaaaaaaaagtttttacttttatatatgaatctaaacaaatgtatgttcataatcgtatctaaaggtaaacttcaatcctgtttctaaaattcgaaccaaattactgtaagtactaactactaaaagtattagatggcacttgaaaatactggtggtataattctatgtgatgaagggttaacttcacttcatacgtatatgtccactttcttttgctttgccctcaattttccatgtgagtttcttttttttttaagaaaaaaggtgcagtccagcttagatggatcgatctacagaacagtgtgcatgtgattgtagttgagtccctctttcatacatgtgagtgattttattatctgatgaaaaaaaaatcatgtgagtatgactacctttgtatcgagtaatttaagcataaaaacggccgttctaatcacaaaagggcaaaccagaaaaaaagtgccatggctagacatttcggatagcccatattctggcccttcctgagaatgcttggagaggcagagaaagcaacagctaaacaggcctgaaactttattgggccaataacatccccaaggtccatgttctgccgcgaattctagcccatgcaggataagaaaatactatcccctcttgtcaataatatttgactgtgtacattttccaatttctacttttttttatttttcagatgcatgctttctgaacagctaaacactgtgtttttcctttaaacaaattatataataaaattgttttaaaaaattatattaatctatttttaagtttctttagccaatacttaattaatcatatattaatccattgttttgttttgagtgtcgggaggaaattttgctagcacatcctaacgaacacagccatgtttaaagcactgtactcacaacatcaaatattatattttctcggttctattaagatacataactacttgtatcttgccaatggtacgtgatgtccaactacagaggctgtagagtgcagactagtagatcacttgaggcgatagagaagaactacttcaaatcatcagtcgaatatgaaaatggagtagtattcgtgcaaagcacaaaagcaaaccatgattttgagtagaataaacaacatgtaagtaagggcattcccaacctaatgactatgatggtgtccatagcattaaataagttgccacctaggacaaaaaataatgtggcaagtgaataaacgaggaaagagaagaaaatcatgtcttgcatgagacatggtttctacacaacatctaaaacatcatgtgagataagtagcattaaattgaagtatggaatagtggtgtttgcattaaatagcattaaattgaagtatggaatagtggtgtttgcattgaaagagtagtgtactagtttcttgatgatgtgaagtttatggttgggattgccctaatgaatccaccaaacaagtcatgatttcgagtagaataaacaacatgtaagtaataaatcacctcaactagtaccaatctccccaaaaaaaatcaaaagtcaaacacacatataattaggtgaacagcgatgttacaaattcgatcaaggattacagcgcactagacaggagtaatccaaaatccacctcaattctacacagatctctctctctctcttttcaaaaggataaattctacacagatcttcttaattactgctctaaactacaagcgacatttcaatgtctccgcaagagaaaatcattaacaccaagaatcaagcaacaatctagctagcttgttctcttctcatggcgatggggatgagacgagcagtctggcggcggcgagctcgcgggcgaggtcgtggacgcggcactggtactcccgcgcgagctccaccgcctccacctccgcctcgcccagctgcacgcacagccgctcctcggcctcctccgccgtctccgcgcgccgccgcgccgccgccacctccgcccgcagcgccgccacctccctctccagctccgcgttccgccgccgcagctcctccgcctcatccttcgcccctcccttcttccctccggcggcggcgattccgacgaacattgccggcgccatgggcagcttagctagcttagctcgagctggcaagatcgaattcgcgccgcagctaatcaaatcaaatcaaagcttgttcttcgattggttgatctggaagaggggaggcggtccgtggtcgtatttaaggacgggttcagggacgggaaggcgtccaggttcaatgaacctgggggtgtgaggacgggagaggcgacgcatcagcagtggccccaccacccatcgtgtcctgctggtgacttgtgaggtgaagaaactgtgaagacacggatggggtgaggtcacggtgatcgtgtggacgacgtggaattttttttttcttctctggggatttgaatggtttggagctttggactcggcaactcgccggtgctttgcttccaagcaattcaaaaacagcgacaagcagtggtgggttcacaaagcggacgaaaaccggtcggttttcgcggtttttcgatatagctcgaaattaattttagattggaatttcgaaggcaaaacggtaaatttggtcgaaattcaatcaaaatttatcgaaaaccggttgaaatttatcgaaaaccatgatactgatggggctcgaaatttagtggtcaagcggtaatgtaaaccctataaggcacaaccgcacaaggaaaatgaagggaagtacgattgtatctggatggaagccaatgttgaaagttcgaagtaactttcaatcgtagggaaaaacgatatctgaacgtttatatatttcggaatggaagagtaataggggtagactttatcttatgaggaaagaaaattattggtaaagaaaaaaagctgtaagacctattcggtttagaagaaacttattccgtgaatgaacacttttcttgacatcaggatcattgacgctaatctttctacatctcgactcctagggaagcgagggtattggtggtagcattggtggcaccgagacattagacctcgacgccttctaaataaatttgtttaggggtcaatttataaaataagttttttttaaaaaaaactaaatgtaaaaaataactagtaagaatatatgtccacaccaaggaccgtatttttttcacctgatccaaagacatttgttttttctttaaacaaaaactaaatgtttcaaacttgcaattaaagtggtgttaaaactaaaatgaatttcacaaaactacgtatacttaaatcaaactatcgcaaaaccacaaatttaaggacgtgtatcacaatactacatatttagcatcaaacttttcacaaaactacatattcaatgtatcgtatcacaaaaataaagatttagttatgaagttattaaagaactatagaatttagagtttatatccatagcactattatgtatataagctgtagttttgagataaaattgttgttaaatttatagttttgtgataggacaccttacatctatagtttcgtgatagtttcgtgataaatttggcactaaatctgcacttttttatatgcatccttataaacatgtattttttttatcaatgtagttttgtgaaatttaataacaagaaccaaaacaagacccatgtacggcccaacttgtgcccccggcctgcattctttctccattcgtagcgtaggccgtgacggcgtgtcgtccgcgtgtgcgcgcgatatctcttccaacttccaaaggcgcacgccgcgccacggcgagccactcgctccgcccaccaccaccacccgccgccgccgccgcaaggctcgccggcgatcatgctctccctcctcctcccgcccgcgcggccgcgcgccgccgtctcccccgacgtcaccgcctcggcgccgcgccgcccggccgtcatcctcccagttgcgcgcgcgccctcttcatctcttctctcccttcccgttcccgctcgtgggttcgtgtttcttccatccgtgacgaggcgcgtgtcgtagtggcgcaggggctcgggaacaacacggcggactacgcgcggctcgcggcggcgctgcgggacgaccacggggtgccggccgtcgccgtcgcgcgggtgtcgaggcccgactggctccgcaacgccgccggcctcgtcgaccccagctactggcgatgcaacctccgcccgcgccccgtgcttgactggtaaacgcgtactcaggcttctctgcgtgtagatttatgctttgaggcatttcatcgaacaccttgcctacttgcttgtttgcttgctatttcaggtacctgaaaagagtcgatgaagctgtatctgaggcgagagaactatctcctagtatgtctcccacaggcttattactcgatgcattggtgatttactgtctactgattagtgccccaagaactgatgcattgatgaactgtttctactcaattaaattgccatggcccatgagaaggagcataatagtggggtttaccatctagagttcggttgctagggactaattttgctgtttatattttgtttcaaattgccccctttgctttcttggagaagaaaatatcccctttggctatgttgctcgaagaatcatcatgttgaaaataatggaataaaaatataaatcttcaaaatgataacattcatcataaatctgtttgcaacttgcagatgaaggcatatcattgatagggcattcagctgggggctggctggcgcgtgtgtacatggaagaatttgatgcttcagacataagtttactgctcacacttggcactcctcacttgtatggtttcctacctgattgtttgacacttaattaatacctgattaattcttgttacagtttgacaattcttgtagtaaacatctagtactcttatggtcttaccttatagatgtgaaattatgttgtattaatacacagaacttgttgctgtacttgtgtgttactccgtatcccataagcttgctgctatcacttcataataacattttgaatatcaaaagcaggttagaatatccaaatcatacgtttctttgatgtgatcttcttttgtcttttccttagaccacctccaaaaggtactcctggggtaattgaccaaactagaggactactgacctatgttgagaagaattgtgccccagcagtttacactccagaactaaaatatgtgtgcattgctggaaggtaaatttcttcaagcttgggtttcaggttctgtttagttgcttccgtatgtacctttacagtctttactatagaagttttttgagttttgcatttcattttatctcctagaccaatcaatactactgatacatttcattatggatgtgtggcaacacaagtagggtaatgccgcagatattgctcatacttcactgctagctggctaaaattctgcctgaagtttagtattaacatatttttggctattttgattaaacaattgttctaaataaactaatgaactgggtattagcgaccagcaaaatcagtacctgataacaaaaaaagaaaaatcataccgtgtcagtttgtctccacaggtacattcaaggtgctcctttaactgggaacaccatcgctactacagatgatattctcgctgtggatactccatcagatatagctgaagcagtcatggtcagtaccaacgacaaatctactcaatcaggcccaaccttgagagcccgcttcattggacaaggctacaagcaggttctgaatgtgaaactgtgaaacattcctccttcctctgctttctgaatgtgagcatgaaaacaacacccaaattctcaaccaggtctgtggccgtgctgatgtgtggggagacggcgtcgttcccgaggtgtcggcgcatctagaaggcgcactgaacataagcttcgacggcgtgtaccactctcctgtaggttctgacgatgagcagaggccgtggtatggttcaccggcaatcctcaagcagtgggtacatcatctcctcagttgaacggttgatggctttgatgcagagaagctgacgatctgaaagtttgtagacagaaatgtattgcatgccgccaggtgagggttaggccaggggaaaactacacatttttcagtgaattagagggtagccaatgccattctatacacaacagtacaacacacatgcgatttttcttctcccaaagaatttgtaacagtataaatattgctcaatgtgcagaggtaattcatcacatacatgattgcaggttgtaatagctacacatacagtatgatctataacaaacttcattccaaagaggaataccaactcagatcattgagaatgaatattcacgtctcaacctagctggctctttgttccaaaacctgtacatgcaaataaccatccagttttccttttgaggatcaaatggccattgaattctgaagaaagcaataccacgaatgtgacaattaacatgcctgatcaatgaacacaagagcgcctcaaccaaaccagcatgcatacatacatatatgtagtatatgcctggtacaagatgccaatggcagattaaaaattgaaccacataaaacgcctgggatcacagtagtaggacgcaataaaatattgggagtgccttttttttttacatgcatcactgggaaccccggcctagatgttcaacgaagtcttttaagtcttaacacagccacatgacctaaaacctagtggaaccttggggcctaacatggatcacaaaagaagcatcccaacacaagtccgagcagtaagcactaatacttgctccatatgactggtttagttagctttaatgaaatgaggggacagcagcttggcaatctccatcatcccgaccttgtccttcccggcgaataagcttttaagcttatcgtcacagttaatctcccttttgtttgctgggttctgcaaaacatcaagcacataatctcatttcaggaacaaactgcttgcagtgaaatctacggcacatgaagagttcagtttagtacagcaaatgattgtgacacaagtgtaatcaaattaatttatataccatggtaaactagaaaggcagctaaagtagcatatctaaaacacggctaacactgctgcaggtgcagagcagacattcaagaacatgagttcaatcatgcctataacaatgtacagtaagttaataacagatgatcaaagaataactataatgcacgtcacactatatataaccacacaacagtgatcagcatacattctggacgccgtgctccacatcgctctaacagtcaagttacaacttcagtacaataaaactaatccaaatctgccaaataaaatgcaccgctgtcaaagtagattactgctcagcaaccttagcacatgtaaaatgctagaaaagaactttattgggtgcaattttgtttttattcccttattgacacccccccaaatagggcagcctttccaatgtccaaccacattaactagattatggcaacacatcaaatatttatttctgaaatagaacccagtagcttacatacagtgctgccgaaaatacatcaaagccttgcgaaaaaacagagaaactgactagaaactttactgaagtttcatataccacttaatagatccaatagatggcacgtgcaaatccttttacagtagcacaaatttcacaaatgaaattataaccaatcccaccaaaatggggcaaaacagtatctaaccaccacgaagctgtaaccaaatccgcggaaatgggattcccctctcctaaatcaatactacttgaaccaaaccccacgaaatcgatacttgaaccaaatccgccgagatgggattccccctcccaaaacaatactcgaaccaaaatgggggcaacagtatgcaatagatattccttcgctagcgcaagcgagacttgaaccccatggctcccaaaccctaatccaacaaaatacaaatcgcaacgcacagctagtagatcccacaacgagcgctgagaacaacgagagccgcggctgctgcaaaatgaacatgtgaacagtgacggggaagaggcagtagggctgtcgggggcgctcacctggaggccgttggccttgatgtggttccagatgagcttgacggcgccagcacgggacatctcgggggcgccgccggcgaacctgctgagggcgtcggagaccggcacgggctgcatgatccctcgcttctccttcgcctgcgccgcctccgtcttggtcaccttcgcccccgccgccgacgccgacgcggaagccgacgcgggcctcttgccccccgccgccgccatgaggaacctgcacccgcggaaaaccctagccgccgccgccatgggaggggaggagccgccgcttcaaattcgcgcttcgaggaggaggcgaggcgaggcgagggttttggggtttgggggttgtttgggttgcaactccactgagggagcattttgtatttggaaaattttgggggccaaccgattttttcatctaggtcctttgtgtttatttttcgttacaaatatgtccttcattgtcccgctgcgcagtggggccagtggcttttgttgtgcatccagatattccaggggtatatttataatttcgccaactactaatgcgaaaccaaccaagcagggtgagacatattacccataaaaaaaagagcatctgttttttttatggcctctttgtggcaacttaaaatgtggatcccatgctggaaatttaactatttgtcactcttgtgatatagcaattaacgatctgccactcactatctataacatgcggaccctcatgtgtctattaacgatctgccactcactatctataacacgtggaccctcatgtgtctatgacatgttggcctagtggcaaatcgttaagcaccactcgtaagagtggcaaatagttaaaagccccttacaaggacacagggattttataggattttttttgtaggaactagtttaattctcgcgaaaattctctaatccaaaggagggctctggtttgtcattccatgtgtaaactacgttttatctaagaaagaactaaaagtcttgtaacaaaatactgagagactagtaattatcaggaagagtgtgatgtcatatccatatggagaggaagaaaaaaaattgtgacatatattcaactgaatcagattctttgtcgtagcaaaatcacaatgtttgggacggcattatcattattttgattggtacagtttgacaacaataacacatttggactgagcatcacacgtactcaactttctctattgtcaccaactgaatgctcaaaattttgttagcttcttcatcttctgttcttcaatgtttaacagtctttcttttctttcatgagctactcgaagatgggtagatcaagaggcttattctttgacccatcttgagtgtctcttgaagatgatgagagagagagagcagagaaggcttttgtatcagattctttatccatgtccaggaagaaccgatgcctatcaagcaggagcagacagatccatgagcatcagagcctaaacaagatgcatgaaaacatgatatggtatgtaggaaaaggcactaaccatctagagtctgatgtcaattctgggtgaaaagcagtagcgaggatgttcccttgccttacagcaacaattacccgatctttcgagtacacttcttcctgccaaagtattgtattgaacatcagtgcacagaagataaacagaactttcaattagactagattcttcgcacaacacatcaatcggcagaactttcaattcgactagattcctcccacaacacattaatcatcaatatacatttgaactagacacggcagggaaatcagtaaaaacgtaaaacagtcaaactgacagggtatggtcagaaaaacacatctagtgcagcatccagaaaaggagaaatatcacagtacaaatcagaaaggaagtgagcatgtatatgcacttgcaatctaaggaaatgtccttaataaccaggagatgaatttagtttgagaatttgtccaaatacaatatgttcagtaattctcttctcatgtgtcattcaattgaaatgatcaagaattatcatgttcgagaatgatgatactagaagagccgatgggggagggcatatgaggacagtaggtgtaaatgtccacatcaattgacagagtttatcttggaattgttttccctaatagttatgatcagacaccataattactacagattcaaggagaacagatagtgaaagggccacacaaacatgatactagctaatgctgcctgaacaacaatgaacatggcatgaacagaaataactgttcatcacgcccatccataaatcctgtctagtttcaacaacaaaattccacttttactgaaagatagcatatgccatgatcatttgcagaagagtgttggaattttcaacaggggtaaaaggcaaacctcaacaccctctccagacgctattgtaatactgggtctatccgatggaacaggacaatccgccagtacttcaacatttgaacctacatccaagatagcaggtgctcgtataaatacgccacggcatgtatcgctccctccttccttctctgcaagcattggcactgaaagttccgtttcaaagctttgaagctgcaagagagtgtattcatctcaaaaataaaataaaattgaagagacaatagaaatgatagtgaaaactgctccggccatcaaacagagaacacgatcctcaaagttacctggctcccaaaaaagttccggtggacagtacaatctagtcctccaataagctcctgacctccggatttttggcctgcaaataactttcatcaattgattccaaagaaagaaagattaaaccaattgctgtggctcacatacctactgccttgttagctaggaagatgagtccagcacaagttccccagacaggccttcctgtaccaacaaattctcgaagtgcaggaaactgcatggtagatgaaataaatcgttgcaacattgtgcaacattaaaataaggtaataaaaaactatgagttataaaaaaggttaatatataattgtattcatgcagtacatgaagactcaatctccacgaagtagaaaataatcaagtacgacgggtgtgaatctggttcttatgaaaaggggaatgtactcgtcatctcatctacatgtgaaactaattgtacacttatatggatgtatactaaataatagtatgtgactagtcacagtttcacaatactcagggatggcggatacggacgaaggaatttaccttaccagcagcaggtagcaagcactggtctacttccaccagcaaagctgtcaagtctacagctcatcattccttatatataaaatgttggacaaagacattcgcagtttctagttatggccttgtaagcgaggctaaaaaacaacgggaatctatatctgcaacaagttgctctgatggagccatgggctactaatatcccataacctcatctgtttttctctagattagttattctgttctgaaagcttaaaagggatggatatgaaccataaattcgtataataggattaacaatagttctcgaacgtgcagccctttcagaattgtatactcactagtagtcagtaatcaacacaaacacataggaagaagagaagtctaatttgccttccatatattactttggttgatctaccaccaaccctcctccgtagtagacagtaacaaaagaaatgcacatatttggactagttttgaccaatgcaagggagcaaatcaatatttcatttacatggattattgtagtgtttcttcagtctgatcaaaactgggctagttgttcggaatgcaaaacaccgggtcacttttgagaactttcaacaattgcgacagtttattagtacacatatccctttcctctgttttgaggagaatctaaccaagaaggaaattatcactagtgcccaatttataatcctctcactgaacatcgatcgtggagattcatgcatcgcatcaattccaataataaacagatacaaatgatttgctaaaacgaaagaacagcaaccaaaagaagaatggggggagttaccaggttgtggtagttggcgagtttggccatggtggtgctctcgccgccggggatgatgagcgagtcgagcccctgcagctgctccggcttccgcacctccacccccctcaccccgatcctcctcagcgctgcacccccccgcatccgcatcaatcaacaaccaacaaaccaaaccaaaccaaaattcccaaaaaagaagaaaaaaaacagaagcagtgggcgcatacataccggccaagtgctcgttgaaggagccctgcagcgcgaggacgccgacgaccgccattgctgctgctgctgctgctgctcccctcctcttctctcgctcgcgttgggatgtgtggctttggctttgaattggggggtgggaagaagtggacgggagaagcacgttgccgtggcggcggccgccacacgcacgcgcctccacctccacctccacggagataggctaccgctgctgccacgagggaaaaaaaaaacagttactggcggtcggtgctgcgcgatcctgaccgtccgatcgtagcagcaggagcaatctcgagcgttggttgttactgccgtgtgtgaagagtggtgatacggaccaaccgaaggctttaccacttctttgggccgccaggtcgtacttgagaattatgggccatggaaatggaggcccacataccacattatcggatatactaaattattacagtatactccgtcaaaaaaacccatctaaaattaaaatgggacataatttattgtattcagattcgttgtactagattatgtttcgtcctacttttagataaggtctttttggaacggagggagtagataatctacctatcatttttctttgataatctactacgagaatgttgtaaaaaatgcacgaatatgcacgtcaagcataatgagatacttccttcgtttcacattgtaagtcattctaacattttccacattcatattgatgttaatgaatttagatagatatgtatgtctagattcattaacatcaatatattagaaatactagaataccttacattgtgaaacggagtgagtatataatactgtgacatttaatttacaaagcacactgtaacaaaaaggaaagcaccagtaggattaattaattataattaattaattactactactgtaattaatagcagggtcaaaagggcttcattgagcttaagccgatcgatcttagcattcacgcatgagagttcagttcagttcacagctcggtatgccggacctcgtcgtcgtcgtctttgtcgtcggggtggtagtcgtccggcgacatgccgccgcaggggctggtcctgaggcagtcggcggcggggctgacgcggccgtcgtcgaagcccatggcgcagttgcagacggtctgcacctcgccgccgccgtcctcgcggcgcaggtcgatgtcgctgagcacgatgccgacgcaaggcacggcgtcgctgcacgccagcctgatcgcctccgcgcgcctcgccgtcccggtgatgttccggaacaccacgccgctcacccgcacgttcgacgtccggttccggcacggccgcgtcgcgtcgcagtagaactggtcgatgacgatggggtggtcgacgccgtcgacgcgcacgccggcgaaccgcacgttccggacgtagccggcgccgccctgccacgtcttgatgcggacgccgttctgggcgcgcgcgacgcgggcgccgtcgagggacacgccgtcgacggcggcgaacgcgccgccctggccgaggctgccgatgctgatgccgtggccggggccgcagtcgatgtcccgcatgcggacggcgaagctgccgttggagatggagatgcagtcgtcgccggtggcgatgcggcaggactggatggtgacggcggtggagtcggcgacgtggatgccgtcggtgttcgggctgtcctccggcgagtcgacgcggacgctggcgaggcgcacgtcgcgggagcgcgacaccgtcaggtgcatctgctgcgcgttctgcaggcgcaggttccgcacgctcacccccctgcacgagtcgatggtcaaagcctgcacgtacatatgctccccggtcaaccgttaataaaaaatgcttgtgtactatttcctccgtttcacaatgtaagtcactctagcattttccatatttatattgatgttataaatatggaaaatgctagagtgacttacattatgaaacaaagggagtattttcaggggctgttcagattgatggcattttaaaccataccattttttttgtaaagttatcaaaaaatgtctacgtttagtttgttgccaaatttgataaatacataagaaaatcctgttaaaattttaacaatattgctatcttgccaaaatttgataaggtttattttaactataatctgaacagacccccagtttatattataagggtttgtttatatttatgccatttcaaaccataccattttttttatagagttgtcaaatatatgcatacatttagtttcttaccaaggtttagtaaatagataagaaatcctaccaaaaattttagctacaatctgaacaagccctaggttgttttgattttttttaaatggatttgttagaaaacttttgcaagttttttccctaaaactttcaaatttgtaaccatcggatcacctcgagatttgtgcatgaaggaaaaaaaattgctagaaaaaattcacacatgtcacgcataagatcctagtgcttgctaaccaaaccatagttaaatgtaagttttatataagttatatcgtagttaaagtgtagttataattaaactgcaattaaaaaacttgcgatagtttttttagtactccatttttaaattagtatattatgtttaattaagtttatattacaacatagacattaaatatattttgattttattcgtgttgaaaatattgtaatattttttatgaactttgtaaaaggttaactggaaaaaaaaatcaaaacaacttaaagtataaaacgaggtggagtaataacattgtgattaattaagtgattaatcctgcttaccgtaggtgctcctttgcatggctgcgagatgaaagggagagtaactgacggtcagtaacaatccagtgatcagtgagctaagctagagataattagtgaatgtttaattaccttggagcggtcaatcttgcaggagttggcccaccatttggagccggagccgtcgatgagaccgccgccctggatgcgggcgccggcgagaccggagaagaggagccacagccgggggctcgccggatcccactccgacggctcatctggcgccacgatagtgccctggatctgcacaaaatcgaatcatcgatcactgcactcctggtggtgtttgagatatttttttaagaagggatctgcatccaaccgatatatgcaacatttttaaaattagaaacttaacctatcgaacatgtaacttagctttcaaataacctaatatatacaacattttctaaattagaaacttagccctctagtacgtttgagatatattaagatgaaaataaagttagaaggcgcaaaatgagataatattctcttgattaatcgagttttaattatcacaaatttgaaagcctgatatatttaatattttaaagcagtttatatatttttttttacgaaatataccgtttaaaaatttgaaaaacgtgctaatgaaatccgatgtaaaatctacatcttaatccgatgaacttgcagtgtacatgatggattcacctggatgatcatcctgttcttgcagggcccgatgaacctggcagcgccgaccttgtagcggcggccgccggggaccaagaacaccgcgttgttcagcgagcatgccttcttccaagcattcaagaacgcctacaacaccaatatttgataattacatgcattgttcagaaaacttaacaagatagaatgtctggttaattcagaagaaatcgacggaatatgcaactggattcatcaatagatcatgtcgttagcaccgcacaagtgtacatggctactacttgcaatgtgttgagttaagtgaagcaatgtggctaagctagatcttgcgtttcttcttggctatctgaatctctcaacgagattttcacgccttcattaagaaagacgaggatacatttttgcaatctttaaggtttggaggatgatttggttaagctaagcaactgcatgctcaggtcagatgcaagggggaatctacaatctagtggcatcgctatcgaatcttcctttttctcagtctcgacaaagaaaaatatatcatgtggttcgcgtcatcatcagttgatcacatataaagtgtggcttcctggatttgtaaggtccaggtccctgcttttcttcccaacatccaagtggttgccctttttatcctcaaagtaattaaagatattaattgctccatctctgatagtacatttaatattttttttctgactgactctggtgctgtttgtttagaacagtgatcttttcgactaatactaatatggaacataatatatactctgacacttaggtcctatttagtttcatggactattgtttagctctcaccttttagtgttaaattaaccctcaaagatccaaacagataggctaattttgagctaatatgaattagccccgctcaaaacattagcccctccaaggggtgctaatggggctacttttgtgtggggactataaaaaaaacagctctctctctccttctctctcctctctttctactatctctctccaccttttagccttgaattaatccatggatccaaacatgtcatcctaagctaatgtttaacctaccaattcatgactaaacattagctcttaaaattagccctgtgctaatctttcaaacaaggccttaggccaataaaggaagcaatgtgaacttttttttgtttttttgtcatgcgtcaaatttgattaaccacgcgcactgaactttttagagtaaaaaacatcccaaaaacaaaggtgcaatctatctacaggggaaaaaacgtatgctttttgtgaagaaacctcgtgcaatgcgccaatgcaagcacacaccatctaatctgcatggatggatgaacaatggctagcacaatggagaaaagagaagatggtggctgttcgaattcgtgcacacacctccgtgtcgtcggagcagccgtcccccgccgcgccgaagctgtcgacgttcaccacgttcctccccgccggcggccggcacttggccgcccacgccatcacctgctccgcctcctcctcttcttcatcttcatcttcatcatcatcgtcgtcgtcgtcccaattcaggtaatcttccttagcatctgctccgcctcttccgttccaaagcttcaagaattgctcatgatcatggtcatggtcacctccggcgccgccgtcatcgccgccgccgccgctcgccgtcttcgccatggccatgatcaccatcaacgctactagcaccaagaacagcattgttcttggccttcttcttcttcctcctactgcctccattgtttcacttcacacaataataacagaaacagtgtagtatgctctccttggcttgggatacaatacgaggtgtagcaaataattttataggggaaacaagaagaagaagaaactgaagaagcaggagcaggagatggaggtgtggtgttctatgctctttttgtttttgtttttttttgggtggacttgaagtgcaagtgaataatggcgatgtgtgcgacagggcaaggtgtagtttatgctttactcatccatataccctttttcccttggcatttttttcaatcgatgcatcatttcttcttgtccttttggtagctatgtaatgtaagtacaaattaagatgatgatggtgattagataatgctttggcttgaatgaacaatttagacagaggctgactctacaaacgttcttgtttaagacgtgtaaaggcagcagctttggttgagagatttcatgtcaacttcccagttgcaaactcttcatgtttgttgcatgtggttatcatttgttatggttctacctacgtagtatcattattattttccaagaacgggaaaaagattagaggtccctttacgctagctttctgtaaatgttgatggcttaattacgtctgattctaaccaaggtataagctgcactgcacgaatgccatcagcagttcatgattaccaatcgatgattcaaccccatcttccaacttcaattggatcataggcagcattaatcctcactaggcatcgtttggaacacaggaaattttcttacgatttccacaagaatcaaagaaaaaaatcctcctttttccgcagttttcgcatcatcattctccatagcattgagatgtggcaagccacgttcgatgttcatgtgccattgctccaggtgccagcaatcatgaaccttacctgaacggcatgcatgatgcgtgcaacagtattcagtactatctgggtgctgattggggtgtaacttcagatgcactcatcctttccgtttgcacagaagcccctgctttgcctgcccactcctccttaacattgcattgcgtgtgctgttggctgttgcacatgctcctcacattatttctgtttcagcaactgcaatgcaaccccattagcatatcatctttgatcccttttgcttccggaaactaaaggggaaaaagaaaatactcattcctcagtgcaaccaggaaacatggttatcattgtaattgccactccaacgttggcaggatgataaccttttttctgatatggatgtgacatgtaacagcttctaaaactatatatatggttatcaagagactctggaggaccatagcttccatagtcccaatcaacaaatctacacaccatgtaagaatgacaactggaagggggggaggggcagagagatttagctttgtatatacggcttcagtgtaccactgtctaagctgatgattataaggctgttgctagctatgacatgttgatctcaacgctgcaactcttggggaagcggcagacagggcacacgtcagcatttttctcgcaatcagcacacaagcagaggtgtcgacacggcatcaccagcaccgctgcctccttcattctgcacaacctgcatgctcccagcccaccatcagccatgctgttgatgccgaggaggcctgactggaagaaaaccccaggcacagcattgacattctgactggaagctgtgttgtccacttcgctgtcgccagagccttccctggtgagattgctgctatgggctaccatctgcatgagcttgcttttcatgctgttagcgacagactggttgtgcagtgctaccgactgccatgactggacttccaatgcaacctgcctgatctgttcgttcagttccttgctcttcctgttcatggcctccacctcgagttctttctccttcagcttctttcctactcctcgttcaagggatgcaagaaattcaaccatctgcctctgctttacatctttcatgcacttaaccaattgttccacctgtgggaaaagagacacatgatgagtgtaaaaaacttcacaattcttgtagtttcacttggcacacagcagtaaggggagagcagataataatgtgttgcattggaaaaaaaaaacctataaaactttaatatgtgaattccaggctaagttactttacagttgatagcaactgatgactgatgcaattgccacttgagcctaacatatacagatcactccacataataaaaatattaaattcttgtgatcacactttatacagtattgttggatatttacagactatgaggaacttgacgacatgggaaaaaccaaggttgatgcattcggaatatatttggcaatgaggtggccttgagattgaatgtttccatggagagaatatagtcaaacagcaaaactaccaaatcacatttggataaatctgagccccagactattccaaaattactgaatggcatagagtttccactactgagtaaacatttttccataaacaagcactaacaaacatctcaaatttggtcaatgaataaagtaagcattgaatacctgaagtccgaaataacagttgaactctttgttttctttgtctaattcagccatcacttcatcaacaaaggatgccatgataggcaatgatgacatgttaccactgccagatgtgattgaagtgtgctcattgttctcataggacagtcttagcccagttgatacagcacttggattaccaatacgtgctaaccgatcaagattttcaacaggaaagtagttcagggacatctgaagattgagttgcttttcatgaccaacatcgttgtttgtatttctttcttgattcatagcagagaggtggttgtttgcaatgtagttataataaccagtacttcctaccgcaggaactgcatagatgattaaatacatataaattagtttattttgagcgtaacagctgaaagataaaaaataggtgacatggcaagaatacagcagtacaccacaggccaaactactacaataggaactacagatgcctccgtgtataacggaaaaaactagagagcaaggacacaaagtgataaagcaaaactgccagtcccacctatcaacgaaacgtgtaaagagaaaaaaaagatgcaacaagagaattattttcactgtcaaatgagacttaaccatcatccctgttggaccaaatgtggttcctctaggcaccgcacacaccatcataggatgctgcacaaaagtaatcaaatccaaacacaacctaatactacctccatcgctaaatatattacattggttagttcaaaaatgaactaataaccaacgtcatataaaaggaacagagggagtagtttggtatttacattatggtggatgatctctacttatcctttaggatgctttagaattcatgagacactagttggagggtgagagcatgaaagcacctctccacaatttaacctactgggtagtgaattgggacaagatgacacggtgagggttaattatcgctgcaaatcttaatgtgctaatatcctacagtgagaatctgcaagcaacatcttaagggcacatacaagtataacacagtttaacatgtcaacaagctagatcaataaatctcacattagagccatcatttttcttttatcctaatacaagacaaggaaatgaacgtgcagattccatctggcacattattgagtagagaaccaaaatatctacccagcaatgctggcttagtgctcaacaactcaagcagtgaattcaattgcactaaatctgaaccacatatgcttaaagacacacaagcgattgcctccgtgaagctaaccaactagatcatcctaccaaagcgcaccaagcaaatgcaagacagtaatcagcgctcgcatcaacagattcatctcacctgcggcgctcccgaagagctgcagctgcagcggcgaggccttggcatcaaacacgaactggctctccttgggaatggaggcgtaggggaaggaaccaccccagtggccactcccgaacatctccccgtccatcctgctcctctcctgccaacaacacgcagaacaaaacacagcacaaatcacgcgaatcccctccaaaataatccgtgccaggaagaacaaggacccgacggattacccccgagacgacggcgacgcgatctctcctcgatcagcgacgaacccgatccgatcctgcgaaaccgtaacctcgtcaatgcgatgggggaaaccagagacaggggtcaaaccacgcggcgcggctgcgggagaatcgcggaagggaagctgaccggagactccgccgactcgacgcgccgccgccgccgccgccgcagaaaccgccggcggtttagggttggggaatccgcgagaggagcggcggcgttgggaaatccgcgatttattggtattttttttccttttttttatttttatttcaccctttcgctttgctctctgcttggttggtttaaaaagaaagaaagaaaccgcaagtgaagaaaaggaagaaggtgtgccagagtgtgaggagacggatgggcgggccttgattgttggctcggcccatttagtttcggtccatctgtgtgtcactacggcctgttttaggttcaaggtgggcccatgcatcagccaccaaatcagcccaggaaaatatacgtgtggcccatgaactaaaccaaacaagtagtcatcatactacttctcctaggcagggttacaatctcgattagttagcgaattttgagccccatcaacacattttgaaccatttctacaatctcgattaatttcgaaaattccagccgctcggaattcgttgagattgtgaactctgcttttatgtaattactttatttagaattacacagtacaacgcaaacactcacaacgcatttgcactcacccttataaacacacgcacgcaaaccctacccctatgagcatattcgaagattgggcctcgctgtcgacgggtacgtcgcctaccaccgaaagcaacaccgttaaatcttggaaaatttgctcccataaggagtcaaacccaggacctcaggtgctactgaggctcttataacctctaggctgcagggcctttcgcctatgtaaccaattttgttcctctggaaaaaaaagcaaagcaatcttcttatgctaattaagggcctgtttggggagtgtaagattatgagaagcagatggttggtagccagcttctgagaatctggaaaagttagatttcccaacttatggcttctattttattttctagattctacaactacagtttcttagaatctagaccaaaagctgaactgtttaggagaatttctaattctaggagaagctgctgcagttagaaactccccccaacaagccataatcacaggtctccatctctttaagtaggtgtaaggagacgtaatctacatatagtgtgtgtgcgtgttcgttttcatataaatcgcgaaaaaaaattcgccgggccggttttgccggccaaactttgtattaagaagaagaaaaattcaaagtcggtataggaaaaagaaaaaatgacaaaaaaaataaccatagattaataaacctccatgcatttacttacaagaattacttagacatggcttgttagtgacgcctctgaagcctgatcaaaagtgtacttgtattaagctggtatattagcacattggtacgtattattctacctttgggggtaggattaaaaaaggtgccctccactgcactgcagctgcatcttgggcaatggaagaaagtaactttggcaaaagatcactgcaagcctgcgatgctgccgtgttgtttgcttgctgtgtgtgacatgtgccgcaagcagcaaaagaatggacattttggtggccactgctgctgacactcatgaaaaaaaaaagatcagtgagagagagaagaagaggaagaaaattacctgcatttacagagagagaaaaaaaagagatcagcttttgaacacacaaggaacaatccaaatgattcgcttaactgtccttggagatgagcttgatgaggggggccccaaatgagtttagtgtttactactatttggttaatcaggtcaggattgtgttcttctttggggctagtaattaagtagtgtaggatttgatgattctcatggcccatgtagaacttttccatgtctgctttatgtcccatgaagtttgacctcggtttgtgtattgttctgcttgctagtactactagcttcaaaatcttggagaaatttcactgtttgggattcagcgcctagtctgaattctcctcaaacatacttgagtatcttggagatcaatctggcctacttagcataatagcattctcattttgaagtcgaaccatctctctgaaaatctctgaagatgtaactggctaactgcaagtctgcaatctagtcatatctgaacatgaagcagcagcaattaacaaactgctcatagaaaatgacctgcataacaattaacacaaactagttagtacaaacactagcacacaaagagctagctgatgatctgatcatgttattttaatccgggcccaaggaccagctttgctgaaaattcttggacagcacgcagtgcaggagtaattaaactgcatgcaatgcaatgtaatggcgatgcttttcccttgtcctgaagaaaaaggcaacgtagaaatgaaatcgcaagtgttgtagagtgctccccacatcgatcgatctgctctgattacgagagattgctagatgggctcaaacctcaaattgccacatctgtgtcctacttcactttgcctactactcctgcaacactgcaactagcactccactccactacactacactacactaggagtggtactgtagtacaacattccaagcaaatcgaaatgcagagattgtaggagaaaggattcttgccctgatcgatgcaagttcagaaaatgtagtgctccatgcagaattattttgtcagatcagtcaaaagatgtgcaaattcggctatgcatgagtagttcagaagaatgccaatctcacgagataagtaagcagcatactaatcactgatcagccaagataagtgaggagaatgactgaaacagctttcctttgcagtagcagcaatctgcatgaatattgcaaattcaagacttgatgccttcctttgctgatcagacaaggagaacggccaagaaacgttgtttggactacgcccatggcagattggcagatggaaaatttatgcatctgcaaatcctgcaatttctgcatacactgtaaatgtaattcacgagcttctgatgaattgatgcctgcattccatttcatccagcttggcatatgcaggactgcgtggttcagagatcttgcattgcacagaacccgggaaggctgcatcatcgcgtctatagctaatactagaaatcaaggaacggagtgcagatagaagcaagcagaaacggacagagaaaacgcatgcacagccaaagcgtattcctcttggtctgctgctacgaccactgcttggtctgctgctagtgcaaagctcttctgcaccgtctcccacgcgaattccttcctctctcaccctccctttggtcctctccatgcatctccatgccctgcaaccatttgtctctacctcgtcgaatctctcggacccagcagccactcaccactcactgcagtgaaacgcactgctatctgcttctcttcctctcctgcatgcgtgcttgcagctacacttgagaaactggtgagtgagctcgaaattctgacaagtatatagtgagaagatagttggggagaatcttaaaaaataggtttgttcgttcctaacttctatttcattttatgtattctataactacatgttctcaagatctggggaagaatttactccctctgttccaaaataactcctagtatatataatgaatctgagtggagagttatctagattcattgtattaggataatcacacctaggttgaactttttttggacggagggagtatatcatttagggtctgtttagttcccaaacaaaatttttcacgttctcacatcgaatgtttggacacatacatggagtattagatgtagacaaaaaaaatcaaatgcacagttcgccaggaaattgcgagacgaatcttttaaacctaatcgcgccatgatttgaccatgtggtgctacagtaaacatttgctaatgatagattaattaggcttaataaatttgtctcgcagtttcttgacggaatatgtaatttgttttattattagactatgtttaatactttaaatgcgtgtccgtatatccgatgtgatatacaggggcaaaaaattttaccaattaaataaacccttagttcagctaaagattttgagaagttgtagctatcataaacaccccgaaaccgggttttcattattgcatatgctgcttgtttgcttccattgggagaagagaaggcttcccatttcgcaagtgaagtggagcactcatgctagagtacaatgtgctacagtgccagtcagcttcctcctttcttgggcttcgccatcgccatgcttgagatagcgaggctgatgcttcaagaaaaatttgcatcctgggagtttgcgtcgcaatctttcatgcgtgccggcaaatcgcgaggccaaatcatgcccctttttaccgcacaaatgtagagttgcttgtgatcttgtctttaccaagggatagatatgacttgtactaaggtaggttttggcccatgataatgccagttttgtgtgtgcaaaccacagtgtcaaaactcaaaaaggttgctacctgcttgatgtgatgagtgcttgggatcaagttacagtatagtgtgatcagctacaggatcgatctagaaagatgagatgtgggaatagtaatttatactgtttctttcactgtcatttcatatgtttaaactgcatccaaattgttctctccttgtcagctgattcgattcctcatcagtgaaatgaccacaatatcctcccccgacatctcgtatgctgattaattcccagaattaacaccactaattgatccaggaactgcatggcatgccaaggtaattattaaattaaacaagctgatcagctattcagcatctgcatgaaaaagtgtttcttgcaaagatatatgcagtacaaaagagagggcatagatacttttaaggatggaataagctaaagcaaacgacccaagtaagattattcgatcgatcaactagctaacgctcttacagtttctttcaactgatgtgtcactcttgctgcacatggtaaagtagctgatcagttgcacactctgtctcactaactttagggattcttccagatcacctctcttcattctactgatcatcagttcatcacctctgcatgcaaggaaggaccagcagaagcatatgtacacttttgatcttgctagcttaattgctacttaccttattaattactagttccttaatcatcatctcttttcctaccaaacctgtactgctccatccagctagttcaagtgcagcttcatccattattactactgttacttacctgatgatcccctgttgatgcatgtgctagctctgaagaactctgaaacacattaacaacacaataatatgacaagcatcatcttttcattgcccacacacatacacaatcacacatgcatgaatgcttgaatccatagaccatggggccccaaagaagaggtttgccttcttcttctaccagatcttgaggtcgaccattggcatcacaattattcaatggttcacgggggtgacaaccctggtgtcccggggacccatgtctggctgactgcaactacagtctttacactgtatttttcttggagacattctttggagtgcagaaatttcaaaaaggaaaaaaactttacagtaatttggcagctaaattctctatggtcataaatatgtgacgttttggacaagattcagtcacattaattaataagtttataaaatctaataaggttatgataatacttttcgaggcgaatctgcacacatcattttttaagctaagcatttgaaaatttactgataatcagaattttaaaagtttgattgatggagtatttcagagaacactaaaatctggtttttcaaaaggccgttagtagtaaaaagctaatagggtaattaagccaccatacaaaacatccctttgaaaagggtaacagtacgagatctattatattcagactgatattcagacatggtccaagcagccatttggtgccacctaggcgtcgcccacatgtgttctcttgggatggcacaataggacatccatccacacatcaaatccattatttggcctggccagcatcatcaactcagctatctaccaagtgtacgcactatagcctatacaaacatacatactccaacataatggtgaggctgagccatccatcaataaaatcgagatgcagatcgatctatctatgtgtatatggatcaacatttgcatggatttgtagtagcaatcacagtatcacactcattcagtctgtctgtcagtcacactcactcacatgcgttgtactggtggtttgtgatttgtgaatagtaatgtaacagtgctagctaactattggtggctatatgtaagcatgcagagcagtgcattgcagcagccatgcatgcagcaggcagggtgtctagatcagagatgaggccatttttctctctgaatttgttggatgattggtgagattgatagctgatgcctgatggggctctctctgcattgcatcctagctgcctgatgggagcttgctagctatgcatcgcgcgcatgcagatttaacaaaacgagcaattttacgattcttaacgaggtaccacttttttactgtaaattcggtaccttatagtatctaggtacctcatagtaattttacactaaattcttgatacctcatgctacctccttaaagataatagaatttctcttaacaaaatcaattggttttcgtgaaaatcattttcgataatcgttggtggtctgtttatgaaaatcagtcgatttcagctggttttcgtgattgaaagtcatcggtttctatcggtttttgatcgatttaggtaaaccggtgaggagcggtttttaatttcaaaaaagaaaaaaaaaagaaaaacagtgcgtgtgcttaccgctggatctgatttttgattgatcagacggttcagatttgttacgtggactcgctagcagtgacgcggtccatgctacattgactgtcggttggttatcggtcggtcgatcgatgtgtttgtggatagtgtttacatgcttgctgtcattactcgctatgtttctatgttatttagtttttatcctaagtcaaactcctttagcatccactgagtttataaaaaaatacactaacattaacaaataaatgaaatatttgaagaatttcatgtaattgttatttattttgctgtgactttatttattgtcgattaaatattcttttaagtacgacttctatattttatgttttaaaaaaattaataaaacgaatggtcaaatgtttataaaaattaatgacactacatattagaaaatagagataatattaaggaaattattgtattttttccactccatgatcctacgactaaatgctttgaaagaggtaaaacagttatctagttatactagcttattacatgaatatactacgtggcttgttttagtactccttgcacttgggagggcagatcgtatctcttatattaaagggagaaattaaatatactcatacgtaacaaagtacacaggttaatctgatacggttaatttgtacaggaatctaaatatacggggtacggtgtaatatcgatgtactgctagtgataaatacaacacataattaaccaaatcaccctgcatatatttatcgacattgttggacctagctaatatgatgtgcttatgatgctatcatggcatcattagagttagcacggaagcttccatagtatgtcacggttatcagttttgtcggctatctgatttctatatttaaattgtccatttgtccttgtatatcattagttcatcgtatcagtcataatcatacatacatacatatatatatacatatatatatatatacatatatatatatatacatatatatatatatatatataaatataaaaactattctatacccccctccctcccatggctcaaacccacctcccaccttagtcaaaggtaagtcaaagcaccctcacgtcagtcaaaactcggtcaaactgcctaccaactcccccaccacccacctcttctcagctctcgtcttgcggaacagtgcagtaacgcgacagccatcgtgcagtaacgctgtgtcttacgtgcagtaacaacattcaaatttagttgaaatatagtcatgacggatctacttttgataagcacttttttctaacatcatggtgcaaatggttttaaaaaatcatatatcacatgagagatattgtaatttgaagcttgggtttttttgaatcttaactctccacaagtagtaacactataacattactacttgttactattatctgttatgcgttactacaatcctatcgcgacgttactgtaagtgtgtagtaaagaccataagttttgtagtaacaatgcgtcttactgcaatttatgaatagtgttactgcataaacatatggtaacatttccactttgtgcggtaacaagtatatttagcaggtgagacttttaacccatatttttcttttaatttctggtttactacagtttcaccatgatgttactgccaaaggtgcagtaacgttctatatgttctacagtaacaaagtgttttactgcagttcttggatagtgttactgcataaacatgcggtgatgtgtaactgtcaggtggtaacgtgtaccttccgtacagtaatacttttacttttgtgcagtaacaagtatatggttagcatctgagacttttaacatatatatttttgtttcaattcctggtttattgtaattcaccacaatattactgtcaaaagtgcagtaacgtcatatacatgcaataacactatattggagggaggagaccgattttcttaagaagagggatgaataatggtttctttaggagaggagtacgtagatgcattttgaagtttaaaccttcacatgcagtaacactatagtatcattgtaaaaacagttttaaaaaataatacatatcttgtgatatattgcttttcaaaaattggcattttgaactttaatcctccacatgcagtaacagaatgtgtaccttgcagtaacaagggcatatacatgcagtaacatggttttaccaaatgtataaaattattcaaaatgctcctacatcaatcagacatcgctcaaagccacctacaaactttacctatagcctacgtattcgatcttcatctcgtcaaaatgacaaagtaaaactacaattgttgtgcagtaacatagctacttgaaagtggtaacatgcacctatcatgtagtaacacttctacttttgtgtagtaacaagtatatggttagcatgtgaggctttaacccagcaatactagtcacttgaatgtaataacaacctatatattttgtagtaaccggacgcgttactatatttcgtgatggcgttactatgaaaagggtagtggtaacgagcgagagtaaatactaaagtttaggaattgttagttcgatgaacgataattattaacgtggtggtgacccctactcatgaaaattaaatgatggcatctcatcttacaatagcaatatataattctgatgataatatttctgtagccagtcgtgtagtaaaagatttgtgatagtgcagtaagatggtttgaagtgtatactaacaaccatccgagtatcactactagatgttttgtgccaaatactataaggatttagcacgtatgagaagataaaagtttactaagaaaactttattataactaagaaatagcctactggttagtgccatgtggtaatttgagttgaaggtcttgagttctattcccattgaatgcaaaattttcttttatttttttctctctcaaaaaagggagaggtggagggggataaggagaaaaaatgggagaggaggagcgattaggggaggagggcggcgcgctcgggcgctcggggagaaaaaaagggagaggaggagtggggagcgatcaggaggagggcggcacgctgctcgagcgagaaggtggggtgggaggtggggaatcgggaggaagtggggaggtcaatgggtgtgtttggttgtaagccacactttgctatagtttgccacgcctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttaggcaaggtgtggcaacttttgttggcaagtaatggtaaagtgtggctgggaaccaaacagccccaatatcttcagatcgaggcaaaatgaacataggctgtgtctagttggatccaaagtttggattttggttgaaattgaagatgatgtgactgaaaagttatgtgtgtataacaggttgatgtgatggaaaaatattaaagtttggatccaaactttgatctaaacacagccataggagtactacagagtggaactgggagcatcctggccgtacacgtgggggccttgattggccattgattcgaagaaagaaagcacatagtccaatgcaaattgcaacaccatgcagcaagaagaagcagccaagcagcacactgcatctgcatggtctccttctcgtcctccgatgcgagttgttaggacagcgacttcgagagcgacgctgtctcttgttgagttgctgtctctctccctctctcttctcttcttgcagctgcagatagaagaagaagaagaagaagaagaaacagtggccattggtgaaacgaatgtagaatgcgagtgaaatttcgaatggttttcaagaacttaagtttggctaacatttattgaaatttggttggggatcgggatccggcacttttaataggaaaagtgaaccctgcatacaccttatcttgaggtcatggatgagagaggtgagattgagaagctaccaatgctcacctcccaattccatggcatgcaggcaaaggaattctgaaaactgaaagccatgccatgtcgtagtaaatgcatatttatgtttttttggagctgatcgatcttgtgatctttattagccacccacacatattgaataaactgaaacatcttcttgcagcaacaaatacagctctgtttatctttgggtccagtactgtactctctggatgccctgctagattcgattatggatctgactgaccttccaacagcgacagtaggagtagttattacatccggtatgctgacagtacattttactatctcacaacacatcagttaggatgtgtttagttcacgcgaaaattaaaaaatttgttaaaattgaaacgatgtgacggaaaagttgtaagtttgcgcgtgtaggaaagttttgatgtgatgaaaaagttaaaagtttgaagaaaaagtttggaactaaactcggccttagtttaactaccttaatttggtacctatggtttgctgtaatcgatacttcatgtactaatcaagtataattaaggcagtgtaccatgtgttcatgaagtggcaagctgtaaaaataagtatgctgactgagcagagctgctgctgctgctttgccttttgcctttctcttttttctctccctttgttttcccagattttgctttgccctttatctgtggagagtgatggctgacctgatgtgtgctcctttagctagctagggtccttcagtccttgcataaaattagttaggattttggaagagagaaaaaaagtatgattgattatcacttaatccctgggatttatcttttttctggttgaattgtttgtttccagcaggttgaggttcccctgtcttggctgttcagtgttgaaattctggttccactgtttttggcctgtcctgcttgtccattcttaccaaaattgttttcttttaacatgttaccaaaatgatcaattttagatgacattttggtttgagcaattttggcataacaaagtagtacaagtttggtatacgaaacatttcctttttctcagtaagcatttgctagtttattatctctctttcagttgtactactacataatcatcatcaaagctactatagcacattgggattcatcagaaagatatcatcagctggggagaatctccactagtcgtaattaataaacaagatattgccctacaaggattaccttgtggagctcatcataatcatcatgcatgagacagtactacgtggccctaattgagaaccccccatctgtttggcaatctcatcacacaatcaattgcataataataaacaaatcaacgaacaaacagtaatccccagaaaaagaagtcgcacatgagaatcatcatgcctccaaaatttcttctcctccatacatccagatacttcttctcttcccaactattagcatgtttatttgcagcatcaattcaaacatttctagctttgacagttaatagcaacaaaaccgtaaatattaatgacttgataacaattttaatagatttaccatgaaacaaactatcataatatgcaactctttctacttagaataatttatcgttataaatattattgaccaaaataacatatcaaagacaacttctaaggtaagcgaatattagggaatgacctaatatcaaatgattagaaggggtgatgcttcgaacccaggtcgtctagcccaccaccttgtgaagctagcgggaagaccctgtacgtttttcacaacttctaaggtctaaaatactttatacttgtattggtggactgagagatagtatctctcatggtaaggatatagctgagcatcaatgttcagaaaagtgcaagaggacaagccattcattgtgcaatcacgctcgtcgtcttgcccaactgctctatgctctctatccccaggtcccctgtcaaattctaaaacagtcatccgatctcgccaaaacgccatcattatacctacctaatgctaattctagcttgcatcacgtaagagctttgccaattatataagataaactagtagaagaaagtttgtcaaatgctagctaggatcatgtgcatgggcctcctctgatctgcatggtcggtctcctttagcaattagcactagcttggctaaggttttagcaggttgatgttgtggagaggagaataataagtggtgcccttgtgatcttatctggtttttcagcatattccaaatcctggccggcaagcttgctggttctgataaatgtccgagaaactactttatttgcccccttagggtgtgtttaatataggccgagcttagatctaaacttttttttctaacttacaacttttcaatcacatcaaaacttttctacacacaaactttcaacttttccgttacatcgttccaattttaatcaaatttttaattttagcgtgaactaaacacacccataatgatggataaatctgcactttctgatcttctaaacagtatgattttcattaaaaaaaacttttatgtaaattacctagaaaatggagttttctaggtaattatttatgataaaatggagtaaatgaaattaaactcgaaaaaatatatatatattcccaaatttattagtaaatgatttttttatgatgaccaaaatggggttaaggaaatattgtgaagtaaatattgcatctgtaaccaaaacattccttgtggtacaagatgcatttttttgggttgagtagcccagttttccaggtaagtactacagtactagtagaatataaaaagaagaacagagccaatactttttctgtcatcttcttcagtttcttcagacagctgttgagattgctggagtcaccactcaccagtcaccacaatttgggtgtgaacagatttgaaaagccaaactgtttcttcatgagcttggaactgaaggacaaaaaaaaactaataaagcaaactgttccaggagtgcttaaaactgaagaaaattttttttcacccaattcttttgtcggtcggtggtggtggctactggttatagcacattaagcaccgtcgcctcagatttttcgacgaactttaaactggatttgacgcgacaaaaagcagccttggattggttccatgcaagtgctcttgcagcacctagcaatagcaagccaaagcaagccatcagagatgagcccatgaccatgaccctggtcaatccaaaaggaaagacactgagcattgcagtagtaccaattgtacacacctcatgtccatctccatccatggccatggccccctccacaagccaagccttcaccttttaccccccccccccccctcccttcacaaactacacggccacgcctctctttctcatggcaacaacggcgtccaagacggactccgagtctccgatccctcaccgtaacgacaggtgccgttgaggcgcactgatatgcgagaccattggtaccattgaggcacatatgtggactacttctttatttaccacgaacacgtttcccacgttgttaaatactacctcggttttaggttacaagactttttaacattgtccatattcatatagatattaataaatctagtcatatatgtgtatatatttattaacatttatatgaatgtgggtaatgctataaagtcttataatacgaaacggagggagtagtatgtttcgtgtaaaaactttttattaaaaagtttctttcataaaaataaaataactctaacttttaagtttatatatgtcagtgacatttctttccatgaagtttgaaaatctcagccttacctcacaaacaaacgtagcacaaagaccgacacaaaacctctgtcataacaatcagtgccgttgatacatgtttacctcgcttcacaagccacacctctatctcactgtaacaactaagcaatttacagcgacgtccagaacggactcggaacctccgttgtaacggcaggcaccattgagacactgacatgtgagatcatattattgtgatattttattttagtagaatatattattgacagaaataggagatttgtcccatcttatttttttaagcttttttctgttcacttttggatattttggttgtgtgcctacggataaaggacggagatgtaatccatttcctttatatgaaaaaaaaccgtgtcatcgaatcgattcaccgacatgtgggcccatttgggcaattgggcacctaccgttacggcagaggatactcgtccgacccacagagtgagggattaaggaagaagaagaggttgattgagatgttggtaaagaaaaacagtaaacaattgggtatgtgtgtccccatttggggagatgaaggtgaatgagctttggatgagatacatggacacatatatatagatatgtatatatatacagatttccctccaaagtagggtgaagcaaagcatctcattccctcaccccccctaccccagttcttctccttcttcttcttcttgttacctttaatcctctccccttctcttctctgttgcgtgcaagcatctctcctcgtcttcctcctcagattgcttgcttgcttgcttgcatcctcctcacattcaccacgaggtttctgctgctggtttgtctgatgtgtgagatagaaagagagtgtgagattgaggacgaattgaagcctagcttgtgacgcaaagttggcatcttttggtttggagaggcccactgtttcttccacttctcgccttgctcgcattccttccttgcctccatccccatctccatgccatccgtgtgaagcctcgcgccgtttggttggttgcaagaacgccacccgcgttggttgttgccttcgcttctttggttgctgccgtctacaagaagcctctctctggcctgtgctgcattggcctcgatcggtggtcgaacacatgttccacggctcgccggcggcggtggcggcgtcggcggcggtggcggagatgaggttcacgacgggggggtcgtcgacgcggtcgtgggagccgacggtgacggcggacacgtcggacctgcactactggatgcagtggcgcgccgcggtgtgcgcgctgtccgtgctcgcgtgcatggccgtcgcggcgtgcctcgtgtggcgccacgagggccccggcgccgaacgccgccccggcggcgcgtccggcggcggcggcgggagcaaggagcggcggcggccgggggtgctgtacgacgacgaggcgtggcggccatgcctccgggacatccacccggcgtggctgctcggctacaggctcatctccttcttcgtcctcctcagcttgctcatcgtcattgtcatctccgatggtggcaccatcttctactactacactcagtaagccactccatttcattttctcagctactactttttttttacctcttcattaattatctgttcctttcccccaaaaaaaacatgtcattttaacttggaactttggaagatggtgttcttgatgcaaagtttaacttcctccttatctgttttcccccatataacttggatggtgttcaggatgcaaagtttggtgataagattttttttaaaagaaaaaaaaaagcaaggaaatgagattgattaaaattttcattgtgtgctcaagtgcttcaactaggaggaatgtactgtggtcaagaagtttggcatttgttcccctttggtgtaatttagatttttcagggaataaagggtgcttttccatgaagcaattggttttctgaacatgcatataaagaattaatgaaaactgtcaggcagaattcctggcattttctgttaaaaatactatgcacaattgatggctaaaaacggtttgcctgttagcttagacagcaagcgacgcgcctcaccattttggttctattgttcatggtcatgggtagtaccaagatttgtactagcacatctctgaaactgtttttatatgtgacacattacctcaatttaataattacaaaggacctcacatgttatttggagcgcatttaaaaatgcagtcttttgtgcagtatggaatacagtgtcataactgttcatactcagtttattaactaccagtctaccagctagaagtactgaaattcggcattactacctgtatggtcagtagtttttattaatgtttttgattaatggaatggacaacactaggaatacccactccaacttagctacctggtcttacatgacttcctgttccattaaacatttctcacatcaagttaatcaaatactgccttttgataatatattataatatatgacctttttgttgcaaaattctggtgtttatcatatttctcaataaacaaactagtgtatctggttgcaagaatcaaattatcgttacatggatccgctagttgttggtgtttgtcaccctgctcccagaagtagcatttgtcaccagccttcctcctctaataagtggttgttgaactgtcgataatgcaggtggaccttcattctggtgacgatttacttcggggtaggtcccttaatccctcctttttcacaacaaaatagtttgtctctgcactgaattcatgaatctaatgattcatgtcgatttatctttacatcgaacacatctgaagaaaagtttgttttgtggaattgttcagctcggcacggcgttgtccatctatggatgcagcaagcttgctgatgagaatgttgtcactgaaagaacagacatggagctcggctcgtacgtcgcccatggagctggtactaaacccaatttgaatggggaagatgacacaggagagattgctggattctggggttacctgctccagatcatctaccaggtaaagagggattccatgcagccaaagaacttagaataaccatccacttgagcgcctttttttttcttatttgttattgaagagagttatcttatctgcactgacatttgcgtccatggagagggggtctgatctcattaggcttttcatacgcaattattgcactaacaactaaagtacgtttgtggtgtgctctgatgaattggattccgtttctaaagatcagatgtgcccacatactagcatctttgtccggtcacatttcaagggctctcacgtagccgccctacatgagccatcttgacatcttgttggtcctatctaaatattcagataatctctgcaaatctcacatttccttgtacctcaagggctgaatcagctttaaaccgctttgcgaaatgtagggctgactctttttagtagtggcatcaagaataaagacaacatgtttcctttgtgttgatttgcaaggcctaactgtacccaaacggtgactgaataccttcctaggctgaaataggacagaatggaactattgttctgctttgtgataagaattactagatagttctatggatggtagtttactagcgccatgtttagttccaaagttattcttcaaactttcaactttttcatcgcatcaaaactttcctacacacacaaacttccaacttttccgtcacatcatttcaatttcaaccaaacttccaattttggtgtgaactaaacacaacctagatctgtgttgggttactgtgtacactttgccaacaaaattttgtaatatatctcaccttttttagagaaaagaatgggtatattcattaattcataatcgttgtgaatatccttttaaggatttatgctcttattatcaaactttacagaaaactgagtaatttatgtaagttttacagtttactagcaatttttactgaaccagtatctgaccttttatctgccatgacagacaaatgcaggcgcagtgatgcttacagattgtgtgttttggttcatcatcttcccattccttacagtcaaagattacaatctaaattttgtaagtattacatgcttcaggccttccctacctgccatctcatactttgaccaatacagtgctaaaaattcagttactatgtttcgacagttgttgataggaatgcactcggtaaatgccgttttcttgcttggtgaagctgccctgaatagcttggtaagttgataactacttatctcgatcagtcaagtaattttatgaatgaatgaatggttaatttgacaattacccactgaattcaacatatctgcagagcttcccttggttccgggtcgcatatttctttctctggactgctctctatgtcatttttcaatggattctccatgcatcaactccactttggtaactttttttttctaactcccattctctcctaactactaaaaccatgactaagagtagtacttgcatctttctgttactgatcactacatttcatatctatttgtcaggtggccatacccatttctcgatgtttcagctaatttatctcctttgtggtaattccattacctccctacaatgatacttcctcccatatgtcttctcttgcaaagattacaaactgaaatcatcatgaatatcacaactcaaatcatcagattttcaatgaatcttttcatctacacaggtacttcgccgtcgcgatcatgcaattaccatgctacgcggtattcagactggtgatcaaactgaaacaccacctgctcacaaggtggtttccgggttcagtcgtaagaggctcatctacaccataagccaggccgtcatgcatcatcttcctccgccattgccaacagtttatacagaaagggcaatggtgaagatcacaagaaaagaataatggcagcctggtggtgatggactgatggtggcatcgatcaccgactccatttccattcctcctttgcgagattctcttattgcagcaggtgcaactctccgagcgaaaaaagaaaacaggagaggcacatgcgttttacaccaccgtatagtagttctgatagatgtaaattgaagcttacaggttcagatatgagattcagagagtttttctttttctttttggatgtaatggaaactgaaatgaacagagagaaaaaaaagagtgtggtggggttatgtatagcttgactcattgactgattggtcaaatggaggagatatttgttaacattttttttattttgtagagctgattaattaatggtcatttgtatatgtgattaatgctaatgagtaatgaatggatgcaagtgtgtgaatgaggttgttaaaatcgagcaaaatggtacacttatgcaggaagaaatatgcatgaggtgaagggaggaagttgagtacctgacagtgagaaaaaagttggtttgaatttgccatctctattgattacaccacaagatcgttaggtgttgttcgtgaaaaagcatcaacacaaagcatggatggcactagtgttttaaatagcggactaaaaacatttagctgttagtcttctcaaactactataacgggctaaataaagttatagcggctaaattatacatgagagtaattagctagacttttttaaaatagctatagccaaagatttaaaaccttagatggcacctcgactagataggtaaggtcgccggagagaggagctccggccgccgtcggcaataattctgatcgaagcaaacttgaaagaaatcttgtgtaatttcagagagagttcggcccgttccgatacctcaccttcccaaaccgatttatgggccgcaattctttactgggccgaggctggtgaggcccacgccaagggtatttcacgataatctaattctaaaattaagttttaaaattctagctttgattatggctgataagccaaaatccaaacgtctgatgctcaatattatcgatgctgtagctcgataatccgtggcaataatccactcggtaatataaatcaaacggggataaactttatcggattggcatgcatattgacatttttcagtgcgaagattccttgaacagagcttaaatatgtatataacccatgcgaagattcctcgaagcagttcagacttcagatatatctgaacttgcgtagtgtttactcctccagatatgtcaatctaggtagaaatagatcaatggaatggaattttgggaaatttgtggcatcgaagcaatgcttcatatggaactgaacaaatcagtagctcagtgtttccaggctaatatctgggggaaaacttatccaataattcatgcttccaacggcacatcaattccaagcattcaagtctccaactctttatatatatctcaggtttccatcacattcaagaattacaactacaaagagttcacatcagttagttagtttgttcttgtttctgacgaagaaaaaggccatcagttgtaagttgattccaaatgtttctgcagaagattcaatccatcattaaactaacaaatgtttctgttctttgcaggaagaagacgacgaagaagaatcgcatcaatggaggtgaagaaggtggccatggttgctgtctgctgcatgttcatactgctgtttccaggccagcagcagcaggtggctgccatgtccaggatctgcagatgctaccacgaatgcttgcccaactgcggcctgcgcaattctcgctccttctgcaaggtgttctgcggcagctgctgcgtcttcaatccagttcacaattgcactagcaccgatgcggcggccgcggcgccagcgatcgccggagacgactgcagaatgatctgcctgaactccttctgcggcgaggcagctacaggctactgtaagatgcccattttctgcaattaattttgcatgtcatcttttctttcttcattttggacttccctttgctacgcttcccaagtttctaaacggtgcgtctcgtgaaaaaaggatctatataaaattattttagactttagagtagttctcgaaagcaatatttttaacattggagtagttaattcattcgtttgcccttggatttcagctatcgcatctttagcttcctgaatccattacaagcctgcatatttgattgattagttaggagtatttgaaacaatacgctgaattttccatctgtttgattgtttgtcctttgtgtttgcattgcagtactaatgttggtttgtttcgcagcggggcgaaacgatgctgatgctgcagcttgtctcgatggctgcagcaaaggatgaactggttcggaggaagtttgacatgttgtgacgatgatcagtatctgctgcgattcttgaattgactgttagagaatggtcgacaacaactaaatataattaactatgataataagaacaataataatgtatgatggaatctcgatcgtgtgccaccttctctggattcgatacggaattacgtttgctgtaacctgcttgctactgatcattatataacgttagttgtttggttacagtgttcaaatattctcgtattctctgcgagcaatgcaatcttgtttacgaactgaaggatggtgtttagatcatactggatttatgaattttatggtttttgagagttaccgaaacgtaccaatggtttagtgcaaaattttacatgaaaaaattctcaagataagttgaagatatactagattatgtactatttcgcaattttgaatacctaaactctgagcgtactaatttgctaatccgtgccttaacgattaaagataatccaagaaataccattaacaagtgtccaaatcccataaataccatcgataagtgtgagttccaagaaatgttatcgtacaaatgactttatcccaaaaataccattgttgttagggtttcatccattttgcgccgttaagttctataggataaacagtgtatttaacggcgtaaaatggatggaaccctaacggtgatggtatttttgggacaaagtcgttaataataatagagttagctctggcagataaaaccgttgatacgatgagagcaactcaccagtcaccatcctcttgcctttggtgtcgtacaggaagctcgggcagccgttcatggcgacgagcagcacaccggcgtcgtccaggacggccttaccatagccgtggggcttcacctcgccggagtagtaatgtcccggcggcagctccacccggaggaggcgcacccagttctcacctccggcggcggcggcgatccagacgtccatgtacggctcggtcgacttcatcgccgtcaccgcgagcgcgccgtgcatgtcgaacatggggccctcgtcggcgtggctcaccggcggcggcggcgccacccgccggaacgtctccgacaccgtgtcgaacgccgacatctggccgcggtcgtcggtctggcggcgaccccagtacacggtgtcgccgaccgtcacgccgaccttgacgcagaagtgggagcacacccggcgttggtggtccgggacggggccgagccgccgtggctcgctggcgccggagccggtggagaggatgtagttgtcgccgttgcggtagcacaggacgcggtgctcgccggaggggcggtggaagtagaaggcggacgggcggaggcgtttccaccggcggcagatcgaccagctgccgcgtcgccgggttgcagatgagcacgccgccgtcgccgccgccgcccgtgttccgctcgaacagcaagaggccgtcgcaggagccgcggaggctgacgcgcatgtcgcgccgcagcaatatccggcgacccgcgtcgtcgccgtcgcagaaggctgggatcacggaggtgatcaccgtgaacacgtagctgtagggcgacgacgacgagtcaacggcgagccccgtgtaaccgagcagctgcagcggccggcggcgggagtgggcggcgacgaagtaggcggtggtggtgatgcggcgccaactccggcagacggcgcggcaccggagcacggccttcgccggcagccgcaggaggatctccgcccccacgtcgtcgcccatcgcggcgcactaatcttgacgctggtcaggtcaggtctctaccacgtctctagttaataagaactagtgggctgggcttcttttattacgtggactggccttcttttgttcactgggctggacttgttgcatcttgtggtatgggcttcttttgttatgtgtcctgggcttcttttattatgtggattgggcttcttttgttttatgggctggacttgtttcatcttgtggtatgggcttcttttattatgtgggctgggcttcttttgttaaagcgcggccttcgcgacaaacgggggaatcgcctcgcgaccgaaatggccgccaccgccgccgccgccgccggagttgccgttgccggcgaccgcgcgcgccggcggcagtggaggtacacgtgggagagcctagcgcacctcccgctcctacgcctctacctcttccgcccggagctctccgccgccgcggccgccgaccacctccgcgccgacctccgcctcgacgactcgctcctcctcctctccttctcgctcgccggggaaccagtcgccctcagggtccccgtcccgagggtgctcgtcgacccctccgcccctcccgagtgccgcgacgcgggggaccatgtcgaggtccgcctcgcgctcgtcctccccgtcgaccaccccgtcgtcgccgccgccttcctaccgccccccggcgaggagccgcccgcgcctctctccctccgcgatggtgagctactcgtgtgttttactgtcctgtgaagttattaggtagtagggtttatgagctttctcgttgattcctggccaataattcgatccccgctagtcactccaaatcgtcgtatgcctctgggattttagtactaatgaaaacctaagtcgatttgcaatttaaaatgctagtaaaatgttactgtattatcttaatgtaatctcccctgtttatattataattatgaatttgtgattcattttcttggatgaacagatataaagaatctgtcttctggagatgttcacttgtactgcaaagcatgctcagcaagattgacaaaacagccactaaggtagagcataacagactttgagttgtgacttatagttgttttgcactttaccatgtctaatggtctgtttatgcaccgcgcatatatttctttaccaatgaaaagatacatgcaaatttcaacttgcttacttcttaaatcatatgtttgatgctctggggttcacatttagtagcaatgaaaccaccgcatgacatcttctttatcaagttaaacaatttgtcattgttcatgtcctcctatgcaacctattctgttcacatgttttgtgcaaataacttcaaacatgtcttggactttcatatcatcgcccttggttttaagttgggggaatcttccttggggggatggcctgtctgcttgatcatagaggtttacgaaagtatgataaaatgttctgacctctacagaagcagtaattttagggtattcaacttgtgtcctgactgagggatagtattgaaaagtgggaataggaaagaatttgtcccttggttgtttattggttctcttctggttctcagttcgaagagatataattcagtcgttagatgctggttttctgaattcctatagtggcatttattctataatcagtttgctgttatctgattatctccaagaaacccactaaagcagtatgtccctcagtggtatggaattcttattgcaagcaagcatgttatgctaaggttttggtcacttgcaagctagagtttaagcttttgatcgtgtttcgcaattagatcatagactatacttaaagaactagggaaaacctatgtgccaaagttcatatggtggagttctttttttatattatctttggtgattagtaaaatatacatgcatatgttcaggaacatcgaggaaatgccatcgttaaactgggaagatgtggctgacaattggtttggtggatgttgcacctcatttggaggtgcaagcgaaaagctagtatcacagtatatcaatgcatatgggcgtctagagggaacaagtctactaaatgctacctccattagcatagaaaaggattatcttgagaaggatttagcatctgggttagttagttcagtgcccagtaacgattgtgatgctctgcaggaagatatatgtgatgttcacataggagaagatcataccacggggaacatggaatttaatagttcagaagagaaagcatatcatgaaaagcagattggttgtaatcatgtgcaatgttctgttgttcctgaagagggtccttgtgtcagtaatagtgaaaaagatggagacactctttggactgatcaatctggcatcattaaagtgaaccccgaggagtctaaaaatgactcttgtgttgatgacatagagaaacctaccaaagagaccgatttgttgtctgtagatccatgcaattgctgttgtgacggtggaaacagcagaaaatctgaagacaatccttcgaacgtgccctctgggaacctggaaatgcaggctaaattggacacccaaagagattacaaattaacaaaaagtatatctcttggttgtagcttcattgtgaaagcatctaaccttgtaaatgatgttgaatggcttgaacttctatgtgctcattgctcatcacctattgggtcatacccttcacaacattcacatgctccagcagatggccgtgtacgactatttaaatgctatgcatcgtcagaccttcatgttgggggacctcatgatgtgttcaggtcagtatcttcacttctcattgaatattttgtacgcctctcaaaggtaaaaagggaagggaaaccagttcagtatagctaggcagctaaagtctatggtccttgctagtaaactgatttcatcactgatcataaacatccattatctttatgcagggggcatacattagaaagactttttgttaatttgttgcttgaagttgcagaagatgaaatatcttttcgtacattagtcagagatctgaaaaccaaaaggcccatccttcaaatagtcctccttagttcaaaagcgtggctgttttctggctactgctatgaaaatgatatggatggttcacatggggcagcacatctgcagccctctgttaagatcttgtattctaattgcagtaatgctttggaagaagacttaaggtacgtgatctgcttacacagctaatctagacttgttatgcttttcttctgccttttatccatattaaaagtgttttgggtgtttgtctttcttgtgctaaatttgtaaagatatattgaagtttgcattcttacatacaaagtggaacaaaaaaaactctgaaaaataattgaagggatacacaacccctggccatattttctgaggtaatgcttttgttgatgggaactatgctgatggcacactgtcatactttgtctaaaacaaatttcaatatcaattttagtcagcttcattggcaacttgtacttgggtaagtctgtctgatgtgtgcaaaagagtatgcattgtttatttgctgccaccattttgattttctgcgttttccattatgcaggacagtagaggagtggtcatccaaatatagggctgaagagttgtacatgatgaggcgtcaaatagatgagcttattctaagcctcaactcagctagggataattttccactttcttgctcttccctccagggaatgtacctctcatccctagagcgttgacttgaaaatgagataagctcggatcatgtcctcatgccctaatacctgtgcatacacagttttaatattctttcagtgaactcattgaccatctcataagtaaactgcaatacattgggcttgtcttttgccgtcaaaagacagagtggcatcgaaatggagtaatggaacagagcaatggtggatccagctaccagtgaattctggctcattatgctttcggtagtaggttgttttattcaaccatctggttatctacttcatacagtatttgacatctcgctgtatctctgaagaattaggtgatcctgcttgcagtctgtatcctggtatacgtttagattttctcccttaatggagctaattttgattcttccaattgcatttatggagtgatctctaaatggtgcattatatttgttcagctctgatagtctggtgggaacaaagcattctgatagtcgttctccttatattaacttatggacaatactgcaatagtggtagagcctgaacacattcatctgataatactggaccaactaattggcacacactatgaatagcttggactatatactccaataatatagctacaggaaatagttgttgaatctttcattggtactccctctgtcccaaaaaaacctaacctaggacttagatgggacataatctaatacaacgaatctggacaagctagtacaacgaatctggacagacagcttgtccagatccgttgtactagattatgtcccatctaagtcctaggttgggttcttttgggacggagggagtacaagtgtacaacccatggttccctatgaacttcggtaggagtactaatgtactatcctagcctgctgtagcacaccaaacatcaacagccttagattcatttacccatgatgatccacgtaatacatgtcaggttctttagttgaaagaaccattccttagtctacatttggctctaagatccacataaaaacaatactttcgtttaattatacttaccaactattctgcacaaatagtgcagcttttgttatcatacatcaatcagatatctttctgtaattctgctacacttcaaacaccttttcttgatgcatttcatcatagtattcatcaatgaggtgactgtgcgtgtgaacctgcatttttgtaccacatgtgttctgcaattcactctcatggatctgaacatgtgtactagagatacggccatgttgtgtccacgtcactgtgcacatgtttacatagtagacctctttccaaaaccatgaaagtgccatggaaaaggctcatgattttatcaagtgttgttacacaaatggtgaagcacaacagccaacagggccatgcatggaatggtgaacattggccctagtctactggttgaaagacttgtcatgttctcactcttgcattacatagctttgaattgctttgttgatgaagcatgtcctctaaacaatgtaggatgcaaaggtatatgactacccatcagcacatggacttaatagtcttaattagacctgataggtgcatgccaaattattacatggaatgcagtgatcaaagttagcttgtgcataaatgcaaaaggaagagacaacaacttgtagtactatctggtgatagagcaaagctatacatattaatggggattgagcctgatatgatttttctaatgcccatcaaaactgtccaggtcatgcatatatttcaacaaagatttttcttccttccatatgcacttgtctttttcattcatcatcttatggctaagttgcaatgatcgagataaaatgcattttaatttggtcctctaggaaatcaagcacaacactcacctctccctgtctctctcatttatcccatatccaatccaataattgaatcaccattttattagatcaatcaggacaaacattggagtcttgttacatcaattaatttacatatacactaacagtaactcttcttgtttgtctagctgaagacttcaagggaagacaccatgggccaatagattaaatacatctatgcctataatggcagacataataaagtggagctagtctctctaatcatctccagtactcttaactggagctttcatcatgtggacacatacccaaccccagggctataattcagatggatcaaccaatgcaagccttatctttctctggcaaagaggatctgtacctgagatcctagcattaaaacccacagtttgtttttaccttaaaaagctgtttgagtactactttccttaggactttattcggccttttactcttttctatgtgcattacaattcttggaaataaaacaaaacctcttgaatcttgatcctataagacagtaacagttcaacaataattgacagcagcaattagtgatcatgcttgtagatgatttccacaagatgaatcaatttctttatccatcatcacacatcttaaactgattaagaatcatatgaaacaaaagggcacatctagtctagtaatgtatctttagtaaaaagacatagttaacagcagtgatgtatattttttttactttctttttagggttgtaataacaaacaccttttcactgtgcagggtcaaaccagtagaagcgggaagacagacattgcaaggccggtgcctttgagcaatgtaggggcccatgcatagagggatccaagggagaaaaggtatagtagatagcactgaggcctagtgggagccgttacactagtatccaaatgtttatacagtaatagtatattgccaagttaacagttcagtccagtccaactgggttggatgatcatatatactacatactgtgtgtgtgcctcctgcatccatctagcagcagttgtatctgaatttttaatgtttaaaggattagaacattccatggaacattgggatacctacactgaccagaagctactagcacttcaaaggtagtagtagttgtaaaaaaaagaaaaatcagtgagaagttgatagtgtgcatgcatgtattgttaaccactgcactttgactcttttttctttcagtgttttggagtgtctgatttgtgtttgcatgtaggatttgatttatacaacttggatggattaatcctgtaatatgatggacttacaaattttgtttgagatagccaacactaagcattattgtcctctaaaaaaagcactactgtcctcttttattaggtttttcaagtacaagaattggatgacatttttgtgtatcatgtacgggaattggcaactttgctaaagttcttgtgtaaaatataaatagtacctccaattgggatcatacttagtatatttttcttctcgaagctcgagaaagtaaatcactttaggaacaaccgattatatcaaatgtacaagtgacttgcatgttttcggggatttaattaattagatttgtgctaagaagtcagattttcaaattttggcgggttagagctttgctatattgaatcatgggctgtcctgagtacatatgttagcattttgcagcaattttatttatttaaaacacaacaagatatgtgaatccccccatgatttccattgagaattgctacataatcaaataatcccgaaaacattttgcgaagttttgtttatttagatcccaggttgagggttagcgtgtgtgtttaagacatcttcatcgtcaccagcaatagttaaaaaaagcatgaaggaaatctgatgccaatactctggaatctcatcaatacttatggcttaattacacattgtagttggaaaaatatcttgtgtaaatattgaaaaagaaatctacaaaatccaaaaattaaaaaatgattggtggatgatgtatgcatggccatgcaaacattcacaatcaccaagctcaagtgcacttgaaaattttgccatttgctaaagaacttggaaatatccaaactctatccaaatgccatacagaaagagagatgaaagaaaaaaaaacgcgggaaatcactgagcacacacaatttaagagatcgagagagcaaattacaaatgcctcttgattaattcttgaagaaatgatcaatcaaaagggatggaatcatatggaaatcactcacactatcatgtgctacaaagagaaacttttttttacagctgcactgatctctcactcactcacccatgcatgcacacaccattaattgcactgatcttcagagctagacttggatcaaattacacttaaaattcaagacgaatttatctctctatgaaattaattactactaatttgcctttgcaactcggttggcaaagacggcctccaaatccgccggcacgcggaagaactccagcgagtcgccgccgtcgtcgtcgcagcagttgcaccgccggccgccgccggcgacgatcgccaccgccgccgtcctcggcttcttgggcgccggcgggcacgtcgccgcctccgccggtaatctgcactcctcccctctcggcgtcgtcacctcctcctcctcctcctcctcgtcgccgagctgtggccggctgaccttgaccggcttcagcgacaccgtgatctcgccgccgccgccgccgccgccgccgccgccggcgagcacccacacggcggcctgctccttcttcttgcagctctccggttgggcttcgacatggagatgcagcctcttcttcacttcttggatccccatggatgcgatgaattacagcagctaagctgctacttcttctgctgcttaattaacagcagctagtgtagctgatgaattactgaattaagctttggtgttaagcaaagcaggtgaagaaactggcaatggaggctttcagtcaggtgagagatgaacagctaagctaggaagtgcagtgagagtgacagtgtagagagcaacagaagaaagggagctaattaaataggtgagcctttacaacttttttttttgagttgtcctcttttgtcaaaggcaaggggtggctaactgtgcagtactgggtttgagatggaaagctggtagtattaagataggctttgtacttgtgtattaggctcctaattattgaagctgcatgcatactgatacttgtcagagatttcagtagttgttgaggcccatgtcttcatgggcttcaaggcccagtagcaaataagcttgtagtagttattggtgatatatatcactaattgcactttgggcaggcccaaagtaatacatctcaattgctaactccactgtttttggcaatttggcagaaacactgataccctttttgaaaaaaaggataggaattcctatatgagtcatttagattgtaggattgcttcaaaggaaaatcaaaagataggaaaaattcctcccctttttgtaggttaaacctcattgtttcaaaaacctttgagatttccaaggcttcttctctcaaaattcctatggttttcctgtgatatatccaaacatatgtattaaataattctttctgttttctttcctatgggattttacatgtgatggtattcaaatcctacgtttttcctattcctattctaaaaatcctaagttccaaagagtccttgatgtgcaacactctgtttgtgaccatcctgaaaccgcatgaattctgaagagcctgaacctgccttgatgtctttctccctagccctagcctcttctgcagctttctgttgttaacagacaggcaattgccaactgcagaatcttaattctgtctactaattagctgcaaagacaatagtgctcatttgatttctttagtcctgaactcctgattctttgctgatgattcaagccaaagcaagccaaaccaaaccatcatgcaagtgtagtacttcttgttcttgctcctcttgtgttcgattggactaattggatggacaccttgatgatccagctgcatgagagtgagtgatgacatgggctcccagctggatagctgcacattctggtgagtgtgtctgtctgtgtacctaccgtttaatttgggcttttggcaaattggcaaatataatacagataatcccagatcataatccatctcttaatctagaaccccaatgatgattattattttgcttagaagggatagagagagagagaaaaaaaattaggcacctaattgtagtaggggcggttggtggggcccacatgacgtcagcgccatatgcgtagggacagctcaaccacgaggagacgatgagaagactgacaggcaggcagacacgaccgcgagcctcactttcagagttttcagaagtttcagagttttcagtacaaggtttgatcgatactgcctgcctgccttcctgcatgcaatgtatgtatggctaccaaactgcttagtgctaatcttgtcaacttgaaacagaattatgatgagattgaagtcatacagagatgatgagtactcaactaatcttgtctgtttatctgcatatctggtgagaaaaattctttctttagatgtatctggtcagctatttgttgtctactgttactctgttagtctgattgcaagtgactagtgtggtctggaatggatagaggagtgcagatactgggggcccacatgtcagtgacacagcacaagagtggggcccaggaaaatgtcctcacttcgctggattcacctgcctcttgaagcaacctttcttctttcttttgctctgtgatcatggtaaaaaaaaagaaaagaaaaaaaaagaggggaaaaaaagctgtctttgatgtgcccacatgagcactagccagcctgcaatgcagaagcttttgcttccaaaaagccttcttttctcccctttctccatcctacctagatgccgtgtttggtagcaagttcttcgtagtagcttgtctgatctgtaaaatgtagtaagcagctaatcttcagtatctgtctgagattggtaggagcagtatattcagttcagtacacctgtgttgcaggtgaaaggtcttggttggtttgaagccaattttttctctttcaatgtttggtagtgctaaaacattggcaagtattgatagtactaacttttgtagtctagaatttcaacaagtatggctaaaaatttgtggcaatccaaacattcatttgaaacatgcagtgatgatgaaagctaagacaattcctttttttagggaggtgtttgaaacagattattcacgagatttgttacagtggatttgtctacttgattacaacgataaattaaatattttaagaaataaactcaacaaatactacctccgttttttaatagattacaccgttgactttcgggtacatgttcgatcattcgtcttactaaaaaaattatgaaattatcattagttatgttagttgttttatcctaaaattattttaagcatgatttatatttcatgcatttgcataaataattttaataagacgaatagttaaacatgtgtttaaaagtaaacggtgtcatctattaaaaaacgaaacgaagggagtagtttacaacaagtcatctaagaaacatagtaaaacaaactattttaagaataacatgtttttaaaagcgtgtaacaaataatccacggcagagcatgttctattctgattcctgagtcaaacaaggctggaaagcacaacagtaagtggacctatattgcaatccaatcaaccaacctaccctacactctgaaaggccatagatccaactatccaatccggacacatgttgtggaattttgatctttgaattgctcacacatacttggaaatgcagaagtgaaacaaaaggcacagtgagagttatactatatttagataattcaagttttattaaaactcagtcaattacaccaagataatataatcgaactgaacccgcccaacctctgcacgagatacacacaaccaacgagttatactacatatatgaacaccaaccttcttgaccatataatcagtctccaatataaccgttaattttgactgaaagaaatatatttggagacccaataaaattatgatattatgaaagaaaaccgatagagtaacaaaatgcgaggaaaaatatctatcataagccaacaaagcaatagctatacgtacgtagctggatcagtcagtctctagtgcaaacaaatacgtagttggatgcgtatacggtacaaacatttgcgagccaaattgatctctccctagctacgaaacaaaagcacagctcgtacaactgcagctgccttaattgtcgatctggccaaactaatcatggcagaaacaggtagaggcatcagctgatcaaacactggccatccatggaacaagatgctttctatctccctccacatatatattagtgcaattttagtgctaattatttgtaaatgctgcctttagtgtgtatattttccttgtcttatgtgtcattatcaaatattcccagccaaactcaaattgctcagctgatggatggatggatggattgagaaggaaaaaaggaaaaacaaaaaatctttaggtggttatgattttggcggcacaacatgacaagatggcttttgcacggccggtgcctccctaagtgctgttgcatgtttgtttccaatcacaaggtcagatatattctatactcttgttcctttcatccaatattttccttttttttttctctcaagaaaaacactagctcctttctttctttctggacctaacatttcctcatttttcttttctgttttgcatgatcagaatttttgttttcacaaatgcaaaaaagcttatggagatggtgctgtgctagttaattagcagcaacacattgacatgtacatagacggtgggagtgggaccacagggtgacggctatatatattccagggagcaaaagaaaacagtgccaggaaacaaaacatcaacctctgaacaatatttccagccaatgatatgggctgcgtacgatgctgactcatctctgatagaggctgatgataagtatttccaagcatccatgacatcatcttcgcatggctatctccattgatttctctctttcggcgcagtgataatgatggaataatacatgacataaacaccacctgcctctggttttcagaaaatcatctggtttagtctctgaaagcagcactgcaggtgacggccggtggatttcttaactttgacaggattaactttggattgtttgatcagtagctggagtgctggatccagcatggcactttggatttgccaacttggtattttccttctccaaagtagttgatcatgtggaattcttttgctgcagatcactgtcatcagcagccacttgactgattgaatattcagggggcatgcacctcctttatctgtacctgtggctctgcagtcttcagaaactaggccctctatgagcaatgtcagcaggtgtcaaggctaccatacttctggatgtttaaacagtgagctcatggtgaagtatatgaggtttacaaactgttggtgatcctatacctgacaaaaaatcgcaacagacacttcaatttggcgttcagcagcacaggtccaggaagaaaaaatgacacctgaaccaacatattatattgtggtgcttgtttacctggacttaacacaaaaccattatatcagaggagaagttactttcatcgtgttgctcctttcactcgattagattcagcaaaccttttgatgtcctgaagaaacattgactgcatccatactattatccacttggcattacaagtgcattatgaggtaagatggacagtaccttttgtgacaccttccccattgtatagatcgtcgaatgtgccggaagatgccatggcagcctaactggtatgagatgacctgcacctgtagggaatattgaacaatcatgttatgttatatgtaaagccaagcaacaaaagaaaaggcagataatagtatttttacactgaaaattaaacttttcttccgagctacactcaaggaaaaaagaatgaaagatagggatccaaggatgatacttgagagcaattatcgatgcaataatttcacacagaaaaggttctgtgggtccagcaatgcaagaatgctagacacactggtccagccaccactaccatgtgcctcatgtaccagttggcattttggcacctaatgctaagtttccatgttcactgatcaaccatttcagcgataaattctaccacttaatctagattatggctaagcaaagcgctaaccgccaatcaagagcagtgtcagtctgccattgctttcctaaccgctgctcagcaatagaaaatatatcgacagaagaaaggctggtataaagaccgccatcttttcaagcacccacaagactttctagggaagaagcctctctttctttctttcgttctttcttttgttttcactttcttttcttcttcccatcctgatcttcttcccgtcctgatctggagcaatggcgacggaagaagaagcaagggaagcaacagatggccaggtaaccaatggcttctcgtagtctctgagttttgtgcagaacttgcttgtttctgtttccatgcatgcatactttctgcatatgcaaaactacgtagagagctccagtgttgcagaaatcacctgaatggtgatgagctctctatgtatcagctaacagactttggccagtttgcaaggtaaatcatcagtgtttcttacttgttgctccatgatcttcttgagcatatatgtatcatgcccagttcgcaaggaaaatcatcaccgtgacttcttgttccatgatctcttcatgttaatctccttcatagtatctatgggatgttctttgcttttgaagggttctatggatgctcttcatgtagtatgccagcactgagttcatttgtgttcctaaacaatcttaaaaagcaaagcatgggcttaaacgatgcaataggttagcgcacagtaattagtaatcaagtttcgctttggtttatagcaaacagaattaagacgccgatcttttcaaacttaaccatttcttgattttgttacataaaagttagattcgtttaaagggatcctatttttcaatatgtagcctattgagcaagtataacaattgtacactcttatccttttattttcgaaaaaaaaatcactagcagtactcttttacccaacttggttattccttcattaatttcgtgaagaaaaaaagaaaacagtgtcattcaaaagtaaacttctatagttctactttacctgtatagagaaagcaatacattaacagtcagaaacagtacaaaatggtaaaaaaatgttaatcagaaattggcagttacagtgagcatgaacagtcgagtgtgtcaatgtaagacaaaggcatgatgtgagcaaagtatacttgaagcatgcctaagcatatagttgcagaactaatcaagtagtacttaaatatatgcacttcacactcctgcaatcttgattcattctagaattaatcaaggctcctaagaggctaagataggcacaacgttttccagttaggatgtccacattccagattcagaagcaaaactcttcaattaggtgtgccacctggcttagcatgtggcattgccatattatttaataagtcagactgttctttgttgactagttggtgtactagaaccatgaaatagatactcttactgtcttgcatgcagtctgactgaaccagcatgtgccatcaatgtcattcattggtaaaaacatagttgccatgtggaaatcctttctgtcatgctggacagtggacactttatatgtagggtttgtaatgctgtattatcattatgttcttggatgtccctttgtacggattataactgaaactgaacaatgttaatagatagttgaatatgtggatgcacatttcagtttatatgcgggtagtcattatcaattcctaacttgtgaataaacaatgtacatgtcataatgacaacccactgtcacatgaagtgtatcagttttatatgttcgattaacctatacatttcccaggaagttcaagtggaagctgcgactgatttgcaagcacaacttgacagcaagctttcttctattaaagagatcaagggcgaggcacaaaccatgggttcaactgaaggaatattgaagattccagaggacgaagttttagtagaagcaccctctgaaaccaaaattccttcagaacatagtttaaatggcacggcgtcttctttgaatggtcatgtgaataaagaagagaatatttcaaatgagcagccccatgaaattaatcaggaaagtcaagagcaggtagaaacttcatctgatggaacaagtacttacccgagcaataaaagcaatgaagaagagatgactgattctcttagccatggagagagtgcatcagaagataccaccattctcaaatgtgagaatgcagaggccaaggatcatggccaacaagatgttgaaggtcatgtaacgaatgacaccatggtgcaggaagaaatttgtaaaactgatgatgctattgagcaaacagttgatgctcaagatctggattcatcaaaagaaagcaaggaagcacaacctgcaatcatgacagatattcctgccgatgaggttctagctgaagcgccggctggaatccagtctcctctggagcctaatgtgggtgactctgacaccgttccaggaaacaaagaaacagatgatccggctaaagaagatgatactgcttatcttgaccacaaagagagctttccagaagataaagttattgcagaacatgcagatgaagaagtcaaagcagaagatcaacagagtaagcaagccgatgacatggatgcagaggtgttacaggaagagatacctgaaagcaaagaatctgatttgcctgaaactgaacaagccgaggaggcgtcagttgatgatcaagaagctctgaatcaacaaccagctttagaaaccaatgatagtttgtctgtaaaagctgaagaaacttgccatcagagcaatgtggccacttgtggggagaaaactccagaagatgatgcgactacaagagagccaactgttgataccaaagaagagcaaaaccagggatcagtagaagaaatgaaagatgctgaagcagttgatactgaagaaacagtgcaacaaagcagtgttgcttttgatgaggcaattcaagatcatgcagcaactacaaatcccagttctgatatacagagcattgaaccagaagaaaccaagggccctagtgatgtcaaagccgaagaagtttccagtcagagcaatgtggcttttgctgaagatgcagttcaagataaggtaataccaagtgagccaccagaagatatacgaccagtgaagaagttggaacaagaagaaactaaggaagctgatgaagcttccaacgaaacgaactctgctatcttcagcgacttaaatcaagaagatagtatcgtggcaagtaaacaacttgagacagaactagcagaagaggctgctgcctttagtaacttagatcaagaaggtggtatagcagacagtgaatcacaagtggcagacctagaagaggcaaaggaaattgaagccactgaaactgaagaaatcacccaccaaccccctgctgctgtttccacagaactgccaaaagaagataattcaacaagaagtgagccacataatgatgatattcagcattcgctggaacaagattcaattgaagtgaaggatactgaagctgctgagattcaagagatctcccaagaaagaactattgctacttctaaggaggatgctgtggaagatgatggtacagcagaaggaccaacctgtgtttctcaagaagtacaagatgtagaatcagaagaagtcaaggacaccgaacctgataatgttgtagaagcatccgatgtggtaactgtcgatgacgaaggacaagaaaacaatgtgctgacaagtgagaatattgcggaattgcaactgcagggtcttgaatcagaagaaatcaagagccctgaacctattgaaacagaggcaggtttccatacaagccatgctgctccctctaatgatccagttgaagtgaatacaacagcatgtgagacacaggacacggagtcagcagaagaaataaaggaaaccgaaggcactaaaactgaatcaattccccaggaaagcaacatttctgtttctgaggaatctaatccagaagatagtataacagcaagtgaaacaatttccaacactcaagaactaactattgcaggatcaatagaggccagtgaggacaacatagatacaaaaactggagaaatcactgatcaaagtaatgaggtttttgctggggaggcagctcaaggagataacatacctgaaagtgtgtcaactgctgatacacaatcaatgcaggagctggaatcagaagaaatgaagaaacctgaacttgttgatttgagtggaacatttcatcaaaaggatgatgccatctctcagaagcaaaaccaagaagataatccaaccacatgtgagacgaatgagattggatcaaccgaagtgagcagtgttgaagcctctgaagatcaagcaattgcccaccaaagtaatattactcaatgtgaggagcaagcaacagaagaaagtattacagaaagtgaaccacaaatcttagaaattgaatcagtccaggatatggaagacactgaagctactgaacctgaactcgtttcagagcaaaacattgtttctacttctgaggagtctgttccagaagaaaatgctacaacagaagaacctgcttttcatgacagagaaatacaaaatgatggagcagaattaacagagcaacatgatagtgtgaaggccgaagaattacccaaccaaagcagtggggctattgttgaggagacagctcaagaagccgatttagtagcaggtgagccaatcgatgatgtgcaagaaaaggatcttgaaccagaagaaataagtaacactgtagatggtgaaacaggagaagcttcccatcaaacacatgctgctgttgaagataattggacaggtgaggtagagagcagtgttgaagcctctgaagatcaagcaattgcccaccaaagtaatattactcaatgtgaggagcaagcaacagaggaaagtctaacagaaagtgaaccacaaattttggaaatggaatcagtccaggatattaaagacactgaagctactgaatctgaaaccattttccagaaaaacattgttcctacttccgaggagtctgtcccagaagaaaatgctacagcaaaagaacctgcttttgatgacagagaaatacaaaatgatggagcagaattaacaaaggaacatgatggtgtgaaggacgaagaaatacctgatcaaagcagtggggctattgttgaggagacagctcaagaagccaatttactagcaagtgagccaactgatgatgtgcaagtaaaggagcttgaaccagaagaaataagtaacactgtggatggtgaaacagaagaagcttcctgtcaaacacacgaggtagagatgacagaatcatcagaacagatgaaggacactgaacctcctgtacctgaaccagaatcatcagaagagatgagggacactgcaccaactgtacctgaaccaacactccaagatagcagagttgctagtgtagaggaaatagaaacacacaataatgcaacaattgaacaaaatgttggttaccagcaacttcaggaacaagaatcagttgaattcaaggaaactgaagttcttgaacctcaaggagtcatcccctctcataatgtttctagctctgaggagttcaatccacaagagactgtaacaaaagaagaaccaggttctgacactcaagcagaggaatcaccagtcgtaattgaagatactgaagatgtaaataacagtgctgctctttctgagaagatagctcctgaagagcatgtactagcaactgagacaactgttgatacaccaccagttcaggagacagaactagaagagagacaaaatattgaatctgttgaagcagaagataatatagcagcaagtggccttccaggagaagagatagacactgaagccatagagattgaatcagtccctcatgagagcaccaccacaagcgtaaaggaactcaatgaagatgtgaaaagcaatgttgctcttgctgaggaggcagcttcagaagaacatatactagagactgaagtaactgttgataaatcatcagcgcaggagccagaactagaggaaatcaagaacacggagccagctgaacaagaacataatataacagaaactggcctgccagaagaagagatgaaggacaatgaagccatggaaactgaaacagtccctcatgatagcaatattgaaagcatcaaggaactcagagaagatgatatcataacagcaagtgcactggatgtttatactcaacaaatcccagagcaagaatcagttgaagacatgaagtgcactgacaccacagaacatccaggagaaaccccagaaagcattgtgtctacttctgacgagcttactaaaacaggagagatcacaacagtaaaggaggcgacttttgacactcaacaagcgcagagtttcacagatcaagaaaccgatctcagtagttcctccaatcctgaagaggcagtgcaagaaagtgacttagtcaaaagtgagcaggaaactgatgttcagcaagagcaagaactggactccacagaagaaaccaaaggcactgaagattaccagcaaaatggagtttctacctgtgaggagtcagtgactgaggttgagccaaacgttgatgatcagcatgtgcaggagaataaatcagcggtagaagtaaaagaaaatgaagatacagaaactgaagaaatatccaagcaaattaattttaccacttctgagaatggagctcaagaaagcagtgaacaagaagccgaccaacctttttatgtccaacccgtacagcagcttgaattaaccacagatagcaaggacaatcaactcgtagaggcagaagaaacatccagccaaagcaacattgtcacccctgaagatccaactgcagaagatagagttgcatatgaaattgacccatctgttgatattgatcaagggcatgaactagaattagtggaagaagtcaaggatactgatgccattgaagctgaagaaacctcccatgcaggccaagcagtttcttcagcggagaaattttcagaaagcaatctatcagctgttgagttgactcatggtattcagcaagtgcattacttggagactatggaagaaatgaagggcactgaaggcacttgtgatgaagaaatctgctatgaacagacagctacttcagaggatccatctccaacagataatggaaaatcactacaagattatcatgtagaatcaaatgaagaaaatttgggtaatggaatcggcgatgtaatttcagtgcatgaaaagatagaagataatatacatgagtcagcagaactgaaggtatgttcaaattaagtatcaaccaatgctttttctcatccatctaaaatgtttacaatacataaaatagtaatgcatattttaggcagtgctaactgctaaattttataaggactgacttctgaagtaaatgatcactaatgatggtttccatgattcactttagacattaaaatgaacaaacttggtatatctaactttgccacaatgctgtgtatagtagtacattattggtttgttggttgagtatattgtcagacaagatgtataccaaacaataccaagttttaaactactggttacaaactgtttagttaaatcaatatggaaagtttgagaaaacacagaggttgtacattagagttcaaaagctgcaaaatagactgcagggtgaacagaggatgcataaatatttcttgccacgttgagtgaaaattgcactatatgatcaaagttatgaactgcaaattaaattgtaaaagagtgttatatttgagtgctataattgtacaaaccccagtagtctttttcttttaactcggacttaagggggccgctgcacccaagagagttctatcattctgaattccgaaatatgcatctagttctttgaattttaggacttgcaggacaactcactagtgtatttcatacaggatgaaacatctgaattgggtgaaaaaactcagatcagtgcgaacagaattgaggaaaatgatgatcacatttctactgaagatacagaagagacttccaacaatacaaatctagtcaaagaagggccaaatgaacatggttcaagccagacatcaaatgttcaagataataagcaacttcatgatgttggacttcaaacacaagttcgtgaaagatcagtggatattgggcaacaagatgaggacatgaagaacgttaacttggatcaacagcagaaggaagatgaagaaattgagaagcagaaggaagatgaagaaattgagaagcaaaaggaagaactccagacagatgaacagaaacatgatgacaagagggttgatttcatcatagacacacaagtggagtccattgatgcatttcaggtgaatatctctgatactaactaatttcatgttctattttcatcaaaatctcttgtaaccagaagcacggtgaaagtaagttaccatccaatgaaattttgcaggctgaacaaacagattccgtggttactgaaatgctcaatgatgaagtaactcaacatgaacccgaggattccatcccaagaactacagatgcgatggttgaaaacattacggaaataaaagaagagactgaagaagagaatggaccaaatagtggtggcaccttagaggtttctgccaaaaactataatgaagatgtgcatgagaatacagaaaaggatgcagtggtagaaaaaacttcaagtagtgaacatgatgaaatagctggtgaaattagaaatgaagaggtcagtacagaatttccattgatgcaatgtgacaaatttagacatattctagttcaactaactgaaaattgttaattttccaaattagaaatgtaaataaaatggtaaaaaagtttttcattatacaggtaacttatgtcactgtgagtatgatgggtgagtaacattgattagcaagcaactaagaattctttttagcactatcatctcattcttttgatttcttttggcaatacaaactttgaagcattactgattacttctcttagcatagaggattgttatggactaacttttgaagtagaagtacctttaagaaatatgtaaatacagaatgacttatgctgcgattagatttcatatgactaaatctatgctgaacaacatggtttggtgaaagtgtttcattgcctatactgaacaacattgttatcttttgctcaacttgcaggttgaaccttgtttggcatcatctctggagagagatcttcaagttgattcagacctttcaaatgaccagatgctagagaatgtaagatttgttgtagtgaatattacccaatatacataatttcataaacattgaaaataatgttagccaccattttttttctttcgaagaatgaacgaaaaacagtgatcttgagtgaaaagaaatggaaaatggaaaggatataaagttatacaaaataacaaaaagtgaagagagatgaacttgagttttgctactttataatattatttccttcgcagtatatgcatgtgcatttaagtggcagatttatctatgagcttggccatggacccttcttagttcttaacacaaaagacctgcaagccttttgagtgccagctcttctctaagtgaacatttcccagtttctatcaacaattgcatgcctctcaagattaactcatttctgaatatggcatcccaaaagcatagtagctgttatcattcatttactttaatgctatcacataattatcagagtaatgagctgtcctatctgttgtacagaatcctatagctgttccacagaatgatgaatacatgtacagagcggaggaaggatacacaaacaaagtcaacgttgacatgcatgccattcaagaatcagataaagtgattgaagatgcagaagaaaaacaaggaatgcaaaatgaagacaatgttgttcaccatgatgaatctctggtcacaactcaaaaggaagaggcatcccaagtgcatactgatgaacaatacagtgcagacactaaaatggatgataccgcaatttcttatgcagaaatgacacatgaaaatacaagtacagagcccagagaagttgaagatacaaaggaaaagaaaggattcaatgactttccagaatttgttgtagaaacatccaaacaggatgatgttgaccaagactttagcattcatcaccaggtaccaatacacttaacaagttatactcatatgcattcgtgtgatcaaattttattgcagaatcttcttgcagtaaaactaacatctttccatcattcaggttgaagatgaaaagtcggcagaaacagagaacaatagcgcagaatctgaagctgtgcaaccaaaacttgatataacgattgctgagacaaataatgacaataatttgtctacaatcaatcccttgcctgagcatgaaacagaaaatgcctcagatataaatcaaaacagacaatatcaggaagcaaccaatgaagatgctatcgacaacattgaaactggtcgtgtcgagaaaatggagacaagctatactgcaacaactgaagtggtcacactcaatgaagatatctgcgataaggtcagaagtcaaaactcattatatatgttatttaagattaatgtttagtccttctaagctattttttactattccatttaggctagtggagctgatggagtaccacctgatggaagtcttaagacatctgaggacaaccttgatgtttcatctgtagttacagaatcagagggagaaaatattaacaaggagacggaagatcacaagcttgctcttcctgtgcatcctacacaggatgaaaacacaactgagcagggatttggtttggaagatacagaaaaagagtccatgtcaccagagaaggcactgcctgctgaaccagaggagcaagaagagaatcaagtaaccaaagaacaagatgaagaagacaggcatgatgcagaacttggtgatgcacatgaagaagatcacaaagaagctgaacaagattatttgcctgtctctagtttcctgatgaacctaatattgggaaaagacaatgatgatccaaagaaagattcagaaaccgaggttgaaaaggagcaagaagaaacaacgaaggatggaagttgtttgatcgcttctcaacaagaagaaaatttggtggcatttcctatagaaaaatcggtggatgaaaaactcacctttgaacaagaaaaagaaaaggtagaaggctctgaagaaacaaaagaaccagtaaaagaacagagttatgatgtcgagatggacgtccaaaaatcattggaaactgatgaagagctcaaaaggaacacttgtgatttggaagcaccagtataccaagataatgcccaggatgaaatttctagcaaactgatatcagccaaggcagctgatccgatcaaaaaaatggaagctagagactttgaattggatgaagagtcatttgatacagtttgtcaggaaaacgtggaagcagcaacagaaattgaagacggaagcttgaatagggaccaagatgacataacaagcccaaaggcttcacaagaggatgctttggaggaagtaggaacagaacttccgcatgagtctttacatgaaaatagacatggtgcaaaggatgagcaaacactctccttgatagaacccgatacaggcaacgctgaaaaattgcctaacgaggctgacagtgttcaaagccctccttgcacagaacaagaagagtccattgaatcttcctatgttgaagtgagaagtactactgagggtcaagtggagagtgaagtaatagaaacgaatgaggaggaccagcatacgaccgcaggtggacatactgaagaacagatagaaaatttacatgatgataagtcgaaagaaacatgttctgaagaaatatctgatgagcaggcacctgaaataactgaaccagttagccacactgatcgaaattttgcttatgaaaaggaaattcctgcaagttcgacatgcatggacaagaaagagagtatgatctcaaacaatgaagtcagcaactttgaaaaagcccttgagacacactcagatagtccaaatttgcatgttaaccaagataagaaagatgaaacagctgataaccaaactgtggtggaccataacaccgtgttagacaagcttgaagattctaatcggcaggaggagcaggaaactgctgcacagaagttaccaaaagaaactgaaggaaaccaggaatttatggcaataacagagcctgtgatcaaagaagagaatgtacatgaaacagttgaaggtaacactcaagcagtgaagataaaatctaatgaagagaaagaactttttgattcacaggttcaggaacgtggtctcaatgtggtttcacccaaagcaacttctgaggccgacgaaaaatttgtggagataacaaagccagaattcagcacagatgaagaacatagtccaaaggcggatgaatcaaataagccagacgagaatacttgtgatgagaaaacaaaggctgaagaggaaactaataatatcactgatgaagcaacagtgaaaatagaagaacgaggagcagaacagaaggtatcacataaaaaacataacattttgtctggtgttggatcaaaggtgaagcatcaactagcaaaagtgaagaaagccatcataggtaaacctgggcacacaaagtctgaatcaccaaaatcataaaattgattcaccttagagcatgtaattcttgtacaatatgtatttttgtaaggaatttatgtgaggtgtaggatattgcaatgggtttagtgaaccatctgtaattttgtatgaacgattcattcaaaggttgtgttcttaaggacgcttgtaaatataggcaggcagtgtgtagttcaagtttccataaactttgtaattgtttcaccaacttggtgtgaggtgaacaacatgtacatggcatattgtttttgttacttcctcattgatatgcatgtgttgttttgtggtaatcatgcaacatattctacacttcttcatgaaaccatgtgatgttatgtggtgttttgctctgaatctagctagtgctaaaacatagtaggatgaggttttacatgtgaatgaatacaaagaaatcacagttcagactccttagagaaagaagcaactactcatgttgctgacctacgccttcatttggataagcaaaatgaatgctggacagaccttcgctacagaaaaagtacttggcctctacagttagcattctactactacgagtagtagaaaaatgctgaagagaggaaaaaaagaagatattgtagaacctaacctgatgtgaggcgataaaccttaatttttcccattgccagctcaacattccacccacccaccatgacaatcccaaacgcaggaagcaactttggattggcactgcatctgcattgcatacagaaaacccatccatcgcggattctgcaggatccacggaccacggtcctccacgcacaatgctctccatccccgtcgcgggcgcacacccagcggcatgaaatgtgagagcgggcggcggagaactatcgtcgagcaggtggcgggcatgccgtggaggagacacacggacctgctaccgcaacggcgcttttggcacggggcagtgctggcggccgcccgccgtcactcgttcttcaccccggggtagcccccggtttcacattgcgctcgtcccctcctctcccgagcttggcgaaggcggcggcggcggcgcagccatgagagcgggaacagccgggaaggcgaaccaatcgcaatttccccattaaccttgttcgccatttacggcgacgcggcgtatggccccgtcaccgtcaggcgtagtatgccgctacggacaagagtgttttgcacataaattcaaatttcgttttcatattataggatgcattttgatttgcggagtgttcaaaaattagatttggtcaataattcttgtacaattgatatttaggctgcgtttagatccagggtgaaattttttgccgtgtcatatcggatatacggatagacatttgaaatattaaacatagtctaataataaaacaaattataaaatctgcctgtaaactgcgagacaaatttattaagtctaattaatccgtcattagtaaatatgtactgtagcaccacattgttaaatcatagagcaattaggctcaaaagattcgtctcgcaatttacatgcaatatgtgtaaattagttattttttcgtttatatttaatactccatatatgtatccaaacatttgatgtgacgtggtgaaaaattttgttaggggatctaaacaaggccttagtagggtataataactacaaaaccaacataacaaaagttaaatcctcacatttttcataatatatacttgcattttgcatgcactaacgtttgaaatttgttcgattttcttttagctaggccagaaactgaccttggtgaattggtacctactccctccgtcaccaaaaaacgaatagacatatcctagtacaacgaatttggacagggatatgttacaattagttgtacaagatatgccacatccagtactaggttggttttttatgggatgaagggagtagagaggaaaatggaagcacgggtgatccatttgaggccaaaactcgacttaaattttgaatttgaaaataaaaagacatgtgaaaagggagcttgtacattagcttcaagtacatgcacatttttctagaaaaaaagatgtaaggagagcaggggttcaaaactgaaaatgcggtagcaacaggtgcatcctctcgaaagctcttgcacaaccaaacttcaaacaaacagtacaagtaattccaaacgagcacccatattcagacttcggagtaacccattacaacgagaattgcagattttgtttcacgaacaaaatcaagataactcatcccttgtgtcttgatgcaggtattcggtcacacatctcatgaacagaatttgcatatggtacacgcagccagattctctcagaacatggctaaagaaagattgattaatcaagtattccccatcgctaacattttcagtttttcagactttcagttaatttattgacaaggccttgcaagtgactattcacgtcagggatgttctccatgttagctgagcaacttgaaagcactcgtgctcgtgtatgagtcgatgagagtattccaccacgacaccagaaaccaaaattgtacagccagcacacttgcgagctaggacactttgtgcgagatttttatgtaattcatgagcctgctcagggctttaccgctgtcaatggcttctcttgccctgtcaagtgcggacttgatatcctcagctccagtgcagcctaagaggtggtcaaccatggcagcatttaggactattctgtcataggctggtcctttctccccactcagcgctgccaaacccaactccaagtttttcaggacctgattcagtccggagatacagtaagtaaacattataactatgctaaaaatataatatcctactaacatgtcagggtgatacacgttaatacaagggtaatttggaacattttacaaagcattaacagacttgtatggatgactgccagcctctattggaagttgacggcatatagaaatatgaaactaaggtagaacaaccgcaggcatgggcaaaatggcttactgatctatcagttcgtggagtctcagtggattcaaaaccaagttcctgagcattcacaatgacactgaagccctctctagaaatgcctgaaagatgattgagacaagctcaggctgaaattatttcataaccatgttattgggcatttcaaaacaagcaatccagattagtcattcacaaaacctctttttttttaaaaaaaatatgaatcaacttccaagatgtataaatcttaaatttttgaaaacactgaacataccccatcatcaccaacaaacacatatgatcactatgaagaggaatatttataatcaataaaaagcgaaatatctttaccatcagtctcggagaaatctgtgctgtttggtatccggaaccctgagcaatggttcactggaagtccttttgatgcatgagcagatctttctttggttgtcatagaaagcgcaccctcctcaccctacacgcgcaccataaatttgagaaatgaccatgtttaattattggatttgcattccgagaataatagagaagggaaagaagctgtttgttcaaaagttcaggagaatgacctatctgtcagaaacggaactcaaaatgttaatagcgcaaggcggccaatttctacatatgtggtcttagcaacaagtgcacaaataaacccataggctgggttatatggggcaagacatctaaacagtaacataaagcttaaacccgccatataacacattaacacaagataatacctttacaactagtccagcatgaacagttctcctcctcatgagcataagcaatggatcttcatagcccacatgataaaatccagcaaccattgattctcttcctcgcgcctggtggaaaatttgaagacaaataagccaatcaaccagtagtatttatttaagtgagcagaacttgtgacatttacaacagaaacataattgaacaaggaaggacatataataataatgcattcatctcaaatttacaacaaattaacaaggattcccaaatagtaggtgatacagaacagttatatttttacattcaatgaatgtagaattacaagaaatatctccagtcttcttgacttgtagtcaaagagttttttatgcatacattatgttgaggaaacactctgaaaatgtaagctactaaactgccaaacattttactaagaaatgaagacagtaggttgtactaaatatttaaattagtagtttatcaaagatctgccagcagtgaaatgtgaccaattttatgttctacagtggtataatatgcacaaatgatctacaatgtatatataaacataaaggatgctacaaaagttataatagttgtacccattatggtgctcttatgatactgtcttccttacaataaaggactacaggtggatgagaagagttactcactctcacaaattgctgaactttctcagaggtagctagcggtggccgtttcttaatatgctccctaagcccaataatcgaatatctggaagaatagtgagtaaaaagaacacattttcatacattacaactttcaataaattgttttttaaatgaagacaaatattataaagcggcaacatttaaactgaaagcataagtttcctgcagttccaaaaaaaagtaaaggcagtgattccattttgaaaattttactgctaaacttcatggctgtgtatggacttaagtcagatattatgatcagttttcttcagaaaatcaggctgaggtgccattcctgattatctgaatgtctacaggaatactatatcaacaagacttggtcactgaagcacataattaccaagaaaatgtcaaaacttacaatggtgggcaagcttcttggagacccaaatatgcaaagccggtattctcatcctgaaagcaaccaaaacagttgatataattagatgcagtcagaggagagtgcacaaaaagggttgcaggaaaattaggcagaagttcatgcacacctccagtagtgttttggcctgtaatgtggacaaatgtgtgtttgcacccatgaatttaagcatctgaccttctgttatgcctccctgaaaatcttgatcattaagtaatacagagggttttcaaaattaagtgataggtaagtccatctcctaaccaaaacttccatagcattaaagaaaaacactagtgtatgatgattgttgatgggtatgcttttgtactgaccttgggtggcatccactcaacaccatggaggagacaagcctcaccatagcaggctctaacagctgcaacaaacagagtactcctgaaaaagcgtgtatttccatcatagggctcaccatagtgtgtcaatgatttgacatcagcaactggagttggacctgatataatgtggtgttaatgacactataatttttttatattcaatttgagaaagagaaactgacttgatgttacctaattcatcatcaaaggctagacaatatcctttgagctcgcgatcagtctccctattcatccgctgtccaataagaaatgctgccagcagtgcttcattaaccatagttgaatttgcactggctaattcaactggtagaacatcctttagtacaccctgaacttcctcataacccaaatggccaccagcaagaacttctctcaaagcactgacaagtctcatctctgcagtgctttgaccaacataccgaggtccagttaaaccatttgctcccatgattgttccttccggatctgctataaatttcacctcggggggaagaacattgacaagccgtggccaaaataagctcatggcacgacgctcaccctcactccattgggtggcttctggaaaggaattagctcttattgtcatgccagcgaagaatgcacccagttgtgcactggatactggctcatctttgagttctcccattcctacacaagagattataagtaacatatatcataagattgttatggaaggcaaagagtcaatgaaaataaaccaatcacaaatcagacctactgtaaacttgtcactcaaatacaaccttacaagcaaattgtaaaaatcagtatccaaagtcaataaatgtcccaccgaaagtttagtattacactccggagtacaattgagcataaatcgcgagctaatgtttcacaaaaaagtgctaaactctagaaagctccatttcaagcaaaattttgcattcctagataaaaggagatgagatgttactgcaatcatcataatgtggatcaaaactaaccgcagtctacatattagtgtcataggactcgagttctaaattccagtagtgacagtgaaagcagcagaatttcaatttcctgccgcacagacggtggctgcaacgcaggatccgatcgatgctagaaatcaccaaagctgaagcggcgagagtgcgaggccacccgccggcaaggatggcggtgacttgactcactcaccggagcggaggatggtgtcgaggacgcgcatggcctgctcctccccgagcgggcgcgtctgctcgggccccgtgcacacccgcgcctgcgcctccagcaccgtcgcgttcggccgcggcatccccggcggccggtacgagtccgacaccgccgggttccgcctcaccccctcctccagcaccgccacccccgcctcctccatccacgacgcctccgcccccgcccccgccgccaccaccgccaccccgcgccgccatctcccgcgcccgccgaaactcaccgccgagccaaccacccgccccctccccggcgagccccgaccaccgctcgcccccgcgctcgggagcggcctgagcagcatcgagttcatggcggagcccaaggtcaatgcagccgccgagccggaggaacacgacgactatattttttttacattttagtcctttccgaaaaacttatttataaataagggctctatggcttattcggtatgattgcaaataaaataatttataaataatatatatatatatatatatagtaaatttgttttgtgctccatggtgtccgggcaccattgttgaaattgagtatatacccaatttaaatgagtatgaatctttttcagttacttaggtattaacattaaccactttactaactagttcaaagcaagtttgaactgaatttgaacttgtttttgttagattttgattctaggtatatagcatctatacatataattagttaggtatgtaatcatggattgtgaaataaagttaaatttgagttgttttgttgataggtataggtatgaatcgaattattataactagatatatactcacaatttgaaaattttgagtgattttgtgcattagataccatggtgcccgggcaccatggtgccccatatgagtgtcatatatatatatatatatatatatatatatatatatataaacaaaggttgaaaaataaacctcgaaaaaaaacactctaaatttaatattaaaataaaaattttggtcagtaaatataagcataaatgaaaatgcgagagaataagttttaaaaagaacaaaaaagtaaaaaaaatacaagatcgaaccggatgggcccattggtcaggattgcttggagattcgtgcggggacgcgcggggtgatcgggggatcggacggcggggagagggggaggagccctcacaaagcgcggcgccgcctccatttcttcgtctcctctccacccatccccatctctctctctctctcgctctcgctctcgccgcggagcttggaggtttgggtgagatcggagcagcgaagcggaggcagccgcagccatggcgttggccgctcgcctcgtctcccgctcccggcaggttcgcatctcccttccccgtccccgtccccgtccccccgcgcgcgcacgcgcgccccgccgcggaaaccctagttttgaggtagatctgatccggcggcggcgccgacgattggttcggttttgcgtgggatctgtggttggttgcgttgaggggttttttttgttgggatcgattgcaaatttgcaatggtgggggttggatgcggtggctgggggtgggtggcgtttttttagtgcgcaagtgagtccggtgcatttcgtgttactgttgattggagcgaatgggatgatgcgatatccttcagattagaagggggaatgctcctctgtgaggggacaaacaagggaacggtttggttgttaacatcccggatcctctcaccacagttgcaatttcccaattcagcatcctcccacatataacatttcatgattcggtactggtcaacaagctatggaaagcttggcgtggacactgctcaagcacattccaggctattatttgttagtatgttttctttgagcagtatatgtcttgttgatgtgtggtcattggtttattggtgaaatttatatggtgacaatgtagtcagccagctaacattagaataggttggctgaagaagttattagtactccctccgtttcacaatgtaagtcattctagcatttcccacattcatattgatgttaatgaatctagacatatatatatatatctatctagattcattaacatcaatatgaatgtgggaaatgctagaatgacttagggcccctttgaatcaaaggatttatgtaggaatttcataggattcaaatcctataggaaattttcctatttggccctttgattcaaaggattgaagctttccaaatcctatgaaattcctatggaatgacacattgcatgtagattttggaggaaatttagcaagagctccaacctcttggaaaatttcctttgagtctatctctctcatctgattcctgcgtttttcctgcgctccaatcaaacgaccattcctgtgtttttcctgtgttttgcaatcctctgttttacacttcaattcctgtcagaatcctatgtttttcctattcctccattttttctaccctgcgattcaaaggggcccttacattgtgaaacggaggaagtatatgttatgtaataaggacgtccatgttggtaaagttgtcagtacaaagctatatggaatgttttgttttagaaatctctagcttctctactttttttataactttgtttatgttaattgtcattggttaatgtctctggcttctggcagctatactctgctcaagctgccttggcaaatggaggtgccactcaagtccgcttgtatgccaaggaggcagatcgtactcccgtcaatggtgatggtaagcctcttaaattttaagtgcatttaacaatttattttgtgcaaattctgtaggaatttcaaatgcttttaatcctaactgcaaaactcctttccataagaccattgtgttgagctgtagaaaaaaatgctttctgtactttacctttgtccatcgcagtatcacaagtaatgttatgtgtttttatgtcattcaaaaaatgtttttcaatgcaaaactgaagagattacatatgttcatgagttggagtttgtttgattaaactctgctgtgtagttctgattacttctgtatttaagttgcacaatttactttgtattataattttggtggtctgattttttttttgtatgtatgaagacctattgaagggcatattttttgaggtaaagaagaaatttgagactgcccttggtgtacttaagaaggaaaagatcactattgatccagatgatcctgcagcagtttctcgttatgcccaagtcatgaagactgtaagacaaaagtaagatcacttataatctgtcacatgtattcatggtccttagtttattactttcctttgatttgtcattgtttttgtgtttattttacacatatttgtggtgattgtttctattctctagcgtaaagttcttttattaaataaatcagattttttgcggtttacgaaaccttgaattcattaagcactattgtatatttcagtatctatgtagaaataactcccatttgatattacttattacctactactgtttgccggtttgccctagtacaatttttcatcttccccattgatgtaggatgccccatcgaaaataaaaaaatattttacttgtacattaatgcatccatcctatgcagcaaaacatactctggcatatatatatatatatatatatatatatatatatatatatatatatatatatatatatatatatatatatatatatatatatatatacttctatcgagataggcttccactttattgctttcattttgtaacacttattctggatgttattgatctatttactcagttatggttccattgtgtaaatgcagggcagatcttctatccgactctgagaggattaaatataccatcgacacctttacaaagggcatccctgatgcacggacttacttgaatactcttcaggagatcaggataaagtacatctattatcattttcacaattttcatcttatgtttttctcagccccaaaatacccttgtaaagaattaaatcaatgtgatatttgcctacataacaattttattgcactatttgcttgtctgaatattcttctgttcacttaatgttacataggagtggccttatagatgatatgggtgctgaggctatgatgatggaagcccttgagaaagttgagaaggagattaagaagccacttctgaggagtgacaagaagaatatgggtctcctcttggcagagtttgagaagataaacaaaaagtatttatcttcatcattttgttatcaacttaagtttgagatagttcagatcatcatttacactgctcgtctactctctagagatatactttttctgaatatttcagtgagaataaaaatccacatgatagatcaaacgtgcaattccttaagctgcttgcatgataattttctggtttcaaaggcgattcagggcatgtatagttattttatctgaccttgctcactagcaagagttttcttgttcgctaacaagggttaagggaccaaatatactctcagatgatggtgtaaccaactgtagcttgttttttactccgtacttaggtgatcgagatccattattgctggcttgcagggaaatatattgatttttcttcctcctgtgcatgctagatgtgttatatatattttttattagttggactaacctttttcatgcttttttgctttccatttcaaaatttcaaataggcttggaatccgcaaggaggatcttcccaagattgaggaagagcttgaattggaaattgccaaaagtgagctgacggagcttaagaaggaatgtgttgaagcaatggaggttcaactaaagaggtacatctctctttatatactaattggttatctgcttgagttgggacttatcagaagtaataagagttgcagcttgctgcatgcaagctaactaatatccagtgcatatcatatcatgtgtgcgtctctattgaaaaaggttaataacacgttgacgtgctttgttatcagggaggagttcaaagacgaggagatgcctgatgtcaagaagttggacatcagaaacttcctgtaggccataaatctctcaaggcattttgaaatgctcggacactccataatggttttcttttccagtgacagccggcgctgtaagcataccaatgaatgttattcttgctttttgtaataaaaactgcaccgaagtacaaagacaagtcaacggttgagttggattgcttgttaccttcctgcgtggagaattttgttttttgtattggcaatgtgaacgccaagcagcttactgtctccctgatgatgcacctgtgttggtttctctgatgatatggacacaccaggttgaggcttaggcaatggtttactgttttcgattacattttgattagaatactttgtttcctctaaaatcattatcctaattaaccgaaggatgcattattcttaagacttgatacacaaattctcagggtgaatttaaatgttagtaggaggattaatctgtgcgcagcaatagcattgccaatcggtaaactgatctggaatgttacgttaaagtggatattatgcgttgggagaattggtaagtacggcctcgggcaggtaatcaagttcaggaataagttcacttgacgtccctcaatttgtcaaaaatattagatataagttctgaaatttatctctaagccaaaatacaagtccctcaatttataaaatttacaaaatcagatcatccaacgtcctagatagtattatgcctgttttaaacttttagctcacgtggtaagccgagtcggcgtgaaacccaggacgacagatgggaccttgaacatctgaggggattgggaggatgggagaagatagtgaagaaagcgttagccactgacatgtggggtctgtgtggtgtggggcccgtgtgggtctcacgctgactcagcttgccaaatcgggcatagtactgcccaggatcttgggtgatcctgtattgtaaattgtcgggcccgttatattggtatagggatgaattcagacttgctgacaagttgagaatcctaaagtgaacttattcgtcaagtttattgcgataaggcccagtatctaatgtaaacatacttgtagggccagatcaatcaaccaatgggccagttctaatccaagaaggcaaggcccagttatagtctaaacatatctgaaggcccagatgggacaaacaatggcggcggcccagaccaatccaacaatggtccagctcaatcttagatcctggctggaaaatacttagattctgcagaaggtaggtgcaaccatcttcattttcatcagccaagatgggacgagatgatcagtagttcaggagaagatgtctagagaagttcatagttcaggagtcatgcagtctaacaaaacagcgccagttttaataggcacaccgcgcacaacagttcatatcatatcaggctggtttgtcacaaactcacaggtacactgaaaatatgaaacgagtatttgaaatgttcaaaatatgagtactgtttatatttttattcatattttgaaatgttcatacaaaaaaaaattaatactcatattttgaaataattttaagaatttttagttatgtttttttattggcaatgtagatattgtccaagaaattaatggtcatagtcaaacagtctcatagtcatcgatagagtgtcagacaatgtgtacggagtctatattattagtgagccgggctaagagtcaaccctttcccttgatccaaaacattgggcgtgagtgatcttgtctcacgacgtcatcgatcgctgcaaattttgagttcgtatacaaagacttggcgtgcgcgatccggtcatttctcgaatcactagcttctctaggactaacctagtgtgtcggtgtaacaaaatagggggtgtgtttagttcacatcaaaattgaaagtttggttaaaattagaatgatgtgatagaaaagttgaaagttaatgtgtgtaggaaagttttaatgtgatggaaaagttagaaaattaaagaaaaagttgcctaagtaattttatcatctttaagaaaataccgaaagatatcatattttctaacataaaaacttggtacttcagagtatctcaagatatcaatttttttatgtagaatttaggtatttaggttgtgtttagtttcttggccaaatatttttttaagtatacggacacacatttaaagtattaaacgtagtctaataacaaaacaaattacagattccgcatataaaatacgagacaaatttattaagcctaattaatctgttattagcaaatgtttactgtagcatcacattgtcaaatcatggcgtaattaggttcaaaatattcgtctcgtaatttatatgcaaactgtgcaattgatttattttcatccacatttaatactacatgtgtgtgtcaaaacattcgatgtgatgtttttggtaaaaaagattgaatataaacacggccttgaggattgtaaaatttccctgataaaatacccataatatttgcattagtttgcgtgcttttgagtttacttcggcatacaaaatattcaaaacaatttggcaaaacggaatggttaaatccacatgtgttacactgacaaatttacttaaagtcaaagtaaatttcagaatagtaaattcggaggagtacacttgattacaagtacattaactaaattgttttattccttgacctgacatgactcatgcacgctagtactcctcccgagttggatcgtaattaaccacgcaactaaattaaccgaagtcgtaattaatgcatgcgattatcgttgatgatcgagattaattagcctaacccctgattaattaaggggttaattaattagctttgcgggtctcgagtccgaatccgaatgggaagagcgggtcgtagtgctcgtcgccgacgttcatcggcagctgctccaccgaccggaaccacgtcctcgccagcttcccggtgaactcgtagtcgccgaacagcacgtcgctgacgccctgcccctccgtccccggcagccacgccgccaccagcgcgtcgatggcgtccatgtacggctcgatcaccagcggccgcccggagaccaccaccaccacgcacctcacgccgccgccgcagacgttctggatcacgctcggccccggcgccgggatggtcaggttcaggttgtcgccgagcgtctcggcgtacggcggctcgccgacgacgaccacggcggcgtcgaacctccccgcgttccgccgcatgaagccggcgtcgggcgcctcggcgaagacgacctccgtggcggcatccacggcgcggcggatgccgtcgaggatggtggtgccgccggcggtgaggtcgttcccggcgaggccctgccaggtgatggtccagccgccgcactggctgccgaggtcgtcggcgtgggcgccggcgacgaggatggagcgcgcccgcttcggcagcggcagcagcggcgcgtcgccgggcttgccgttcttgaggaggacgagcgacttgcgcacggcatcgcgagcaaggtcgcggtgctcctgcttcccgagctcgccggcgaggctgaggtcggcgtaggggcgctcgaagaggcccatggtgaacttcacccggagaatccggcgaacggcgtcgtcgatccggctcatcgggatcgtgccgttcttcaccagcgccgccaggtcgtcgatgaactccgtgtacgtgaacgggatcatcacctgattgcacacaaacattcgaaaattaatcagtcaattaattatgaaatgttttgggtgtaaaggaccatttcttggatcgatatttgtctcttatttatcaatgaaatgaaaattttatgatgaaattagtttttgcatgtattaatgtgtgcactgtactgaccatgtcgatgccagccatgatacccagcttgatggacaacatgtagtctgcatgtgctggggtcgtgatcctgtcaagcccttgccaatccgagataacgaatccctgaaattgaataacacattaattaattttcaaacttaaacagatcacatcatatatgcatgaagatctcacacgtatgtactaccgtctagaaaatagaaatacaagtcgagtttgactaccaattaattttaaatctttgactaattattaaaccaataataatattttacatgcaccgatacggatgaattcatgttcaaaagcacataatctattttaaaatataaatatttctatattgtttagtggagaaaagttgccaagaaaataattgggtgcctctcattgaatgagtggtggttggggggctaaaataaaaagaaatttaaataagaggctattaggaattgcttatattttagaaaaaaataaatactagaaataattatattttaaaactgagactatttttgttatgaccatagtttatttttcataaataaaataacgaaagaggaatttactttcaaagtttatttttaaccatcaaaattaagccttatactctccatttcaaaataaaccaatttagttggagatgtgatataacctagtacgtacgacttatatccaactttagtgtattaagtttatttattttagggtgaagggaatatatatatttgtagacaaaggtatagcatatactacctccatcccaaaatgtagctatttctagcagagtgtcttgtcctaaaataaagctatttctccacatacctcctctcaaccaatcacaaccattattcttcacctactttctcttttcaaccaatcacacactttctccaattattctcatttactttcttaatacctgtgccaacctaaaaaatgactatattttgggacggaggaagtatatatatagtagtagtgcacataccctgaagcggagcttggacttgaggaaatcggtgatgaggaagtggttggcgtgcatcttgacgccattccagctggagaaggacaccatcaccgtggacaccccctgcgccacggcgctgtagtagggcggcatgtgcaccgtcatcagctcccggagcgtcgccaccgtgttgttctcgttcatgccgcgcgtcgtgccgccgtcgccgacgtagtgcttcgagcacgccgccacgctcggcctcccgccggagacgaaggggacgccgcggcggccgccgggagggatctcgccctggaagccggagatgatggaggacatgcgctgcaccaccctggggtcctcgctgaagctctcgtagcagcggccccacctcgggtccctgcacaccgccacgcatggcgcgaacacgtacgggatccccgtcgccctcacctccgccgccaccgccgcgccgatcctcttcgccagatccgggtccctggagaagaacgaaaaaaattgataatttgacactttcttcgttgcccaattgttttaattgatacttgtgatgatgatatgtgagccatctaagtaaatgaaagtgggtcagaatgtcaaataatcgaaacctattttaagaagtgttacactatcaaatctctcggagaagaacacaccatgttcatatgctctcactagctagctagcttatctttgtatattccctccctccggtgatgaataaaatccagtaaaacttttagaaaactattactattggtcttgtgttaaaataagattacgacattattgtatgatgagaaattttacgaacattttaaaacgtaactgaagataccaaagatttttacactagaaaataaaatttggtaacttaagctagctaatatttagatgtaccaaattttacaataaaaattatggtactttatttttcaaagatggtaaaattactcttatgatagtaggggttttttttcaagtcgaatctgtctttttttttccttttcaaattcagcgcgtttgagaaaccattaattagagtgacaacgtcaaaatattactagttggcgagttgggcaattagtaactctttcccttgtccaaaacgttgggacgtgagcgatcgatcgcgctaatttaaaatctcaaatcttggatctcactccatcatcatcgagcactgcaaattttgagagtttatatacaaagacttggatgattaattaatggcgtgcaatctggtcatcttcagtaaacttatcacaactagctacatatgggaatctacttaattcatgcatcattaattgagtttaattaagggggataattaatcattttattacctagtgcagccgaggccgacgttgtgggggaagatggtggccttgtagacgttgccgtggccatggacggcgtcgatgccgtagatcatggggatcccgaggcgcgtcgccatggcgccgcgctgcatctcgttcaccatcgacacccacgccgccggcgacgcctgcgccgccggcacgctgccgccgccgctcagcacgctccctgcaatttgagagatatatattcgtcttaatttaatggccggtttgagtagctagctaattttgattaattaattcattttgaatctgttttagtatttacatttatttatggagatgcatgccctcacttgtgcttgcagtgaaagctaagattcaaaccttgtatttacaaaatcattagtatcttataatatccatatttccatgaccatatcatacggattcagagtgtttgactcccaatctcaccaaactggttcgttagacatttgtctgcattacccattatcaaagtacgaattctttaagaaatgttattttgttatagctagcttaaacaaactcctggccgaatcacaatatagacattcgttcaaacttcaaactttttcttcacgaacgcgtaaaatctttgcatgtcaaaaatatatattagagaacttcagacttcaaactgttttagtttgacctgcactatattatagttttttttcaaacacgcaaaagctttcatcgatattaattagatattatatataatttcctgaggtgtttgcattcgcattctacttattatatgtgtatcttgtttttagatgcaagaatcaatatgtatctctgctgcaagaaccaagaagcaatcaagtataccaatgaagtagttgcgcatgacgtcgaaggtggcgttctcgcgctcgatctgcgacatctggccgatcttctccgccagcgtcatccgccggagtaggtcgtcgatcctcttgttcagcggctgcttcgagtccttgtacttgggacactcccctcctcctccgccgccgcccgccgccgccgccatcgccgtcgccgcaatgcagcctacacacaccaccaccacgagcacggcgccgccgccgctactacctcgccggagtagccccattgctcagctcaggctaagtgagatagagttggatatgaagtgatgagttgatcgatggaagcttaattaggtgtctatttatgggcgagtttagtgacccaagtgaccaagtgtgtgtgtcggtccaaaaatattcatcgtattaaatgtggggctaagatgaggccatcgagctagtttgaatggttttgagtttacttcgacatttaaattgctcagaacaagttggaaagcagggttgttaaatccacatgtgtattatgcagacaagttgcttaaagtcaaactgatgaacttcataattgattcgatcatggtcggtactgtagtagtttggatcctctgacagaaagaaaataaaattgctccatttaagtctctgaagctcctgcaacgcatgcacaaatccctaatttactgaaaattaagatttcttttgcttgtcagtttggacaaattcaggccacctcgcggcttgccctaaattaattatctcctagattcctaattagtctcaccggttgccattagaacatgtaaaatggtcattaacagcgatctcacctttactaattaagaatacttacttattgatacgaaggatagaaagaggagagataaaatatcgttattatgggtaacgactcttaacctctataatataaaagcatggttgcatatataaaggtgaaaaatgaaaaaaaaaagtaataaaagaattttttttagctaatggtgagagtgttttaactgttataaagatacgacttctaaataatcttgtattttctaatggatcatacacatatttactgttaaacatatacttatctcctaattaatcccacgctccttcattgcgtgcacaaatccctaaattactggtaggtttttttcgccggaggtgaagaagatccgaaccgaattacattaagatcatgagataggcttcagaagtcatttgccggttgccacaggctaagattatctcgtatgtttaggcggagctacataaaagggattagagtttctaggcacctggtcaagtggcggagctaggagctcgacacgcctagggctcaaattgaaggctaacaactatccatatcaattcgtacttggaagtgcagtacaagtacgaaaaaaaatgcaagactgaaatacaatttctaaatatgcaccaagtacagtaaaagtgtagaaaaagtacaagactagactaaaattttattagaatacctaatgcgacgtatattcatgattttcactcttcatcaacagaaggtagagaacctgaagatgaatatagaaaatgatattacataatgtaagtgatgcaaattatgagaacttaattatttgtagacaaagcaatgcatgacatacctctaggtaatttgtgcttgcgcgtcctcaaagcacgataatgttgtataatctgacgatcttcaatgctagtaaaaacatcccgctcaatatagcatatcatgcagtgattcatccattcatcattcatcttgttccgcatgtcagttttcataatgttcatagctgagaaggctttttcaacaggcaaatttaaggttaattcaattaagtgatacaccaatggaaaaattctctatcactttgaaccatcttaacagcaaggttaccaaggtcagagcaacttgagaaatccaaatcagatctcacatcagagataaatgtgttaagttggtctctaaggactatacaatcatattcagaaaaagtcatctgcataaatccttgccccgcacctgccgcaaggaggaggaatggaaaggttttttttttttttttggtaggaggaaacccattaattaattaattaattaattaactaatgagaaattaatggaggacaaatatggggccttcgtaggcctcctttctgcgcgctatggcccacacggcccacctagtatcggaaaataagaaatcgatcggaaagaaaaccctagaagcgaagcggagagaaagcaatggcgtccctgagcaagcgcggcggcggcggcggcgaaggggagggcatcctggcgtcatggatggcggcgcatgggcgcgaggcggcgagcagggcgaagaaggtggtgcggagcacggggaaggcggcgtggatcgcggggaccaccttcctggtcctcgtcgtcccgctcatcatcgagatggatcgcgagcagcagctcaacgaccttgagctccagcagcaggcgctcctcgggcccgcgcccctcaaatgatccatccatccatccttaacttctactaatagtgttcttgcctgtctagtcagacaaatcaaacttcttgttttcattaatttcaccattatgctgctctgatgagatgtcgtcgccgctttcctttcctgatgttactatttttcacgctcatcttatcatgccaactatatttcgttctgtgcgattcctgcgccttgtgccgtttattctttctcgtcatatgctgctgtgatgagatttcgatttgcatcgaccagggttacttttttttttatggattgacatctccaggtttatgaacaacagttactataataattaaggttttctttttgtaaaaaaacagtatggtctctgtaataaaaaggagaacattgtactccagtttataaagttggatcacaaatgggaacttatgaagatttcttattcataagagtatgactcgagcaaagcatatgttggtttgttacgcccccgaaactttggcaaacaacaatgtgtgatggtaaccaagcattttgatacaaacagcaccactttattgcattttgatacaaagaacactagtttttattgggtactccctcaaaattgcactcctaatttaatttgaagagtgcacttattttgagagggatgaagtatatatatgcttatctaaccaaaagaacttttacgttataaatttggattcgtcactaaccaaactgtcattgctggcttatgatagattttctggcaaaagaatgacattgctggcttgtgatagattttatgccagtattagcaacaaactgggcagcgactaattctcggttgataaattagaattaatttgagaattcatccactgacccacatatcatgggcacgactgggggcaaatcctcaatttctgatctaaacgataagtccgggtatatgataaactcggagcatcaaatcgatcagcatacctcgaggggaagcattgcaaacaatcacgcaagagaagctgagctgctgctcctgctcttaatgcaggcatggcacatcaaggacgggcatttgcatcataataaaacgtctagccaaagttggataccacacattcttcgtcaacaaactgctgctgcgacaaaacccaaaaccaaaaaaaaaaagcaacctaacggaacggaggaaacaacccagtagttcttagttatgcagctctccctcccttttgacggatcaaaacctcatgcttgcagcatatgcatatcccaccaggccaccaccatggggtggtgaaccatttagtttcttgcgttgtggctccccaaaatgcccctctcatggtgaggaacacgctggtagccatttgatggcctgccactaccacggttgcccgcatattcgttgtcgcctccccctctagcataccctcgccctcctccaccgaaacgacctctgcctccccttcctgccaatgccaaacacgcaccaggttcatatcatacttacgcaagtatatgccaccatcaactacaccatgaagctgtgtgtagtctgcaagcaaatattgcataggtgttggaaaaataaaagagcaacttacttccacctcttatgccgctgttaggcttccgctcctcaacatatatctgccgcccatttatttcaattggtgaagcctgaaaattggcaaaagatttagcatatgacctgtcaaaccatgattactaattcaagcgaaggatgaccatatagtgcattaaaaaaggggaaagcagaccaccaattaaacatcacagtaattagtaaatggtgaagtgaatatgcattaaatttgattttaaaggagtatgcacacacaaattggagaaggtatttaatgcatgtaaaaaaaagtgagttttgttgaacagtttgccaccttcaatgcattgtgaacaccactaagttcttcgaattccacgaacgcatagtagcctccggtctcctgccaatgtcatacaaacactaagtcaaaagaaaattctatcatatcacgtaataaaaaatacatataaggaaccaccttgcggcttctgatagcaacaccatcaggaatgagccgcccaaacttcttgaactcattctcaagatcagcctcagatacagaagatggcacgttcccaacatagacagatttgctctctatttttacgaacagaaatattaaaagtcagtgggtaatgtgcaactcaaatcagtgaaagggattatgatgctagctcaaactaaaggacaaccttcatcatcctggacagcaaattcaccataaacatcggtttttggcttctcggttgccacagacgaagtcataaccgaatgctgtgcagcctggtttgtctcggttgcctggtgaggtctagtcggggctggctgggctacagggaacaccagtggagcttttgcggttcttagctgcatgagttataccatcaaggttttaaatatgcatgagatgacatcacaaaaagaaaaataatcatgatcaaccaagtgaaggtgcaacatacaatggaggcataggtcttctttactggttcaccaacaggttcctctacatgaggaggtggaacaggtggagattgcactggctcctccggtgccatcgccattccatttgtaaaggaagaaattggttcttcaggaagaggctcatctccccaattgtctgactgagaaactacttgctgtggtggctcagagtaagtatagttctcaacagcatcactttcttcagatgttattgggacagcactttgattttcctcttcgtgaatgtactctggaacttgaggtagaaaatatatagttagtaactacataattgcaaaaattagaaaagcagcagcaataggcctattcatacgtgcaaggtattgacttttattttccatggcaacattacaatttgaaaccatcagtaatcaacgcatacggaacatactttttgttggtgctcatagacagccaacacagaaggcatgctagaagatataacatagttcagaacatacgaataacatggcacaacagtttagatagatcattgacagagaataagaaatatggatcgcaaataggaaaaagaaataagaaatatggctgaacagttaaaaagaaaattgcaggaaattatgaagctacaaagatatattataccaggttcgacgacggagttggatgccatgttggtctcgaagttgtcctgggcaataacaggtgcaggttgcacttgctcttcgtcaacgaaatggaaataatcattgagaacaaagtaacccttttcctggggagcaaggaaaaacatctggatgaatttcctttggtggctgtactccttggtctgtacaagaccagataccataactagcacaccatcaccccatgagttgagaaagttggctgttttgatctcgatttgggtgaaattcaaggacataatgagggagtgtatatcctgcaacagttagcacgcatgcacgcaagcattagaagaaggctatgtagagtaaatgcacatgacaggtcgacaaggaaggaaagacaacatcagatatatatgtacaattcaagtcagtaagtcagtcaagcaaaggtggtgtgcataaagctacgaattcgaagatgctatgctagataaaacatagtacaagttagaactagtagtgcatagtaatactagtgcatagcaaaggtggattccattgcaaagaaaaaggatatatactatatattataatgaaaagagattgcggagaggagaggaggggtaagtaaccatcatggtgctggcggtggtgttggttccagcgaggtcgtcgacgcggaccatggtgctggcgtcgttgtagaactggtggacgacatcggggctctgctgcaggaggttgtagtagttgcgaaggaagtaggtgccgacctagagaggagagggggtgagcgaacgagcgagcgagcgagctagggtttggtttattttgaggagagaagcactcacctgagtcgccgccgccgccgctgcggaagccatggtgcaggaaaccctagatctgcgtccgcgggaagggagccggggaggggagggcgagatctactggagaaggagccgatcgagacgatcacgagcacgcccgctggtcggggccccctccgtccgccggtggcctcctctcgccggcgacggcggcggtggcggcggcgctcggagacgacaacgcaacggcggcggcggcggcggaggaggcggacacggcggtgcgaggggaaggcggaggcggcaacgcgaggcggcggcgcgaggggggaggcggaggcggaggcggcggcgcgagagggagaggggggaggagatgcgggtggcggcggctaagggtttgggaggggaggaggaggggtctggattagtgggcgtcgttttgcgagaaatccccttcggcttccacattttagagatctattctaattcgtgattttctcttcttcgcatggaatacccgggttttgtaagggtttttatgtaaaataatgcctcagaggaactgtttgtgaggatctatatagaattacgcacaaaacgggggctttatggcaatattgcaagttcgcgcgtatcccacgtggacaccgcgaggagcggcctgtgggctgtgtgtttgcctttgagagggaattaatctctggcccgtttggcacagctccagctcccaactccaacttacctagagccagagctgtgtcaaacggttcagatcatttattttttggagcggagttggcatagttactctacaaatttgtactacgggggtagagctgggtttttgctgctccacagctccactccactttaaaagacacactaccctttaaaattttagtgtatttacatgaaaatgccactgaactacctccaccaacctccccctcccgttctctctccttctccgtctccctcccgagccctaacagatgcagtaggcggcatcggcgtcggcgtcgggctgcggcgttggcggcggcgccgtcgatggcggcggcaggctgcggcgtcgttggcaggcggcggcgtcgtcgtcggcggcgacggcaggcgccacggcggcggtgcgcggcaagcacgcgggaggaagatgggcggcgcgcggccggcggagggcagagggcgcaggggatggggcggccggcggctgggatttttgtttttatttttttttattttttttctttttttaaatctgaagctgaaatgtagccaaacacttttgatgggtgtccaactccaactagagttagctcccactgtagtaggagtttggagttaggagttgtagtttggagcactaccaaacggagcctattttagcgaagtgttagcgtttgattttcatggatcgtcgccgtgatgctcgggtgctaccgggaggtgaatccggccactattatagtacttaattgaagtcatcgaactcgttgccgtcaaaaactaatctattatttaaaccgattatttatccctcgtctgatgagtaacctgctctgtcacgtgtatcatagctctgctcggccttgtttggatccaatgaaaactcccagcttctcatgggaaatgggccggaatcccggtatgttagttaaggcctcatggaagacagtatgggatcatacactgacactggccagcagggtttacaaatagcaatctcgattctccggaaataaaaaaacacaatctaagattggccagtgaaagacgagccctgttagattgtaataattggctataactctttaagcaaaggccggaatgtttttccattatctaaaaagaaagacgagccctgtgaaacattcgattttttttcgcaaatttcaaacaatatacatgttaaacaaatttcgacacattatgaaatttgaataagacgcacattttcaagatgatcgaaattcgttaaagatgatgaacctgttggccaagatatattgagatggtgttagagatgtaatcctgctataatatgtgaaataaacagttttaaaaactcggtctagccatatacccctccatcctaaattacagggtgtcccttttttttaaagaaaacttaaactcggtagcttttgattaatgactatactaaccatacatttttttttgcggggaaaagggaagtattactcaggaataatatcgtcaattacaagctttgagataaaggtgcaatcattttcacaccaaaatcccgacaagttttcactgcgacttttattagctaacatatgactaactaaaatttggcttctatgaaccttcctgagcaaacactcccgacttccagcgaggagatccttaatctctctaacggcaaaggcaagctccgagcgctcaacttctttggcttggatcatttgtaacgctaccaagcagtccgtttccacctgtactgggagcagcgtccactgaagcgccaaggcaataccctctctgcacgcgaccaactctgcttctaatgcactatgacagctgttcagggttttgcaggaagcaaaaatcaccctcccctcccagtccctcatgactatgccaatgccccccttctctgacagggcatcaaaagagccatctatattaaccttcaaccatccggtttgcggtctcacccatttttgtttgcaagctggtcttgatcctggagggacctctttcccataagccaagacagattagaacgttttttcctttctctgaaccaactacagacttttgtcggatgttgaacagtgactgaatatagctctcaaggaatcttttagaagactcgatcgttggaggggttttctcatggacgatttcattacgaacaaaccaatttcgccataacaccaagagaagggccgcccgttcagattcggatagcctgtctaacagatcaaacagccaggctttattatccatacgcacatcagtgagcacaggaaagtgcccatcaccttgcatagccatcagcaaaaatcttgactgggaacagcgaagaagagcatgctgggtgtcttcagtttctgacccacataccccacaggtagctatccgctcaagcttccttttcgttttattagccattgttgcaagggagtcagtggcaaccttccaagcaaaacttctcactttctgagggacttcacacttccagatcaggtcccatctacgatcgcctgccatattcgacggacctgtatcctcttgattcttcaaattcagagccaagtaataagcactcctgactgagaatctaccatgcaagtctggatgccaagctataaaatcttcgtcctcccaatttgaaatacatatgctaagtagtatgcatgttatattattagatttatattttaaagtactttcatgtgacgctaatttcatattcgttaggaaaacataacattaaagaattactgatcaaaataatttgggacggaagaagtagtagtgcacacttttttttctcaaacttaatttacagctaagctgcttagaaacaacaacaagaagaagaacaaaaaatcaatgacgaatcacattatatcatccagagaacacatctagttatacactgacgacgaggaataactaatgcactactcagcaagcaataatttatcaaggctacatggaagcatcggcaaggtccttcctgtacggagccggctggtcctcgtcggcggcggaggcgtccaccaccggcgtcccgccggcctccacctgcgcctgcgcccgctccggcaccggcacgtacgtcgccaccgtgtccttcctgaacgtcaggtagacgacggcgaccaggtaggcggccatgagcgcgaacaccaccacggagatgaggccattggcatacttggggaggttgttgtggacgagccagtccacgtatgtccacactaggaagtaggtgttgacgacgatgagcgcgaagctcaggatccacgcgatcaccaccgtctgcaaaaattattggatcatttgccaatttatgtatctagcatggcgaattaatcggttttcgtgtttgtgtttgtgtgggtgggtgaatgtgaatgttttttggttggagaaatggtttaaggaagcttacatagatggattccttgaggggtccaactttcttgctgctgttgcagaacttgagtagagggatgagagcgaacggcagctcaaatgacaggatcatctgtatccaaatcaagaattcaggatattgttgcttttggaggagcaaagcgaattcctacagaatgttcaattggaaaaataaagctgaaaacaggttgatgagtcttactgatgacaggatgattagcttgccggcgcctgagggaccactgacaatggagacgatgaggctaggagctatggcgatgactcgggtgatgaggttccttacccaattcttcatcttcatgtccagaaacccctggataattatcataacaaaagttggctatatttactgaaatagataatactcaagagtggacaaatgatatgcaaggtatcaaatagtttgtacaaacttgataacacctcgatcaatagtgtaaacttgacaaaccctgctccaggtttactatcaagggtgagcactacggaactgaattacctgcatgatgacctgcccagcgaacgtgcaactgatagtggtgctttgcccagaagctagcagcgcaacagcatacaccaccgagcttgatctccccaaaacattctgaaagtaagagataatcaaaataaggcttgaattcagaatgtctgacatgatcctcagtgagctctggtctgtaatttcttccatattacagaacaagatgtctataagatgcttctgaaagtactatcttttatccaggaaatgaacattcgaacagttcttaccctgagtaaaagaggtgtggattgcagagttaggtcaccacacgtgttggcatcagctggagaaagattattcgcattgcaaatggatccagcaacaacaacgactgaaacatttatgaggaaagccacgatgaatgcaagactacactcaataaggaagtatctgcaagcagcctatcggaaacaagatagggtcaaaccattagccactcaacaacaaaccatagctgatcattacatcatctattatcaatgcaacctactctgatgcttttgtctgatcgtggggtcttccttgacaggaccagagcagagtgcaagaacaagttgtatctgcatgcatgttatgaaaactcctcatctcatgaacttgtaccatggatcaagtaaaaagtagctacgatcaccaaagccctgataactgattgggtttcttacggtgtgatgatagcgccaaagagtgcgatcgcattggcagcagcgcctttcccttggagagaagggacaaacatgcccttgaccacctctcctgcagacggcctcaaatagcttagctctccgaagaagcaagctgccatagtgaacatgaatgctgctatgatgaactccagcttccgagcctggtggacatgtcatatggtaaggtcaattcgtcagtagcccattctcagtgtaattcatctgacaatcatataagtctgagaaattctttgcgcaccccaaatctctgtactccaagaagcaagagggtgctgaacactgtgagaataactccagcccacactggaatcttaagcaatatgttgaacgcaaaagctgtgcccaacactgcactaacaaaagaacgtgttactcatgctaaatctagcacagaaataaataaataaataaataaataaataaataaataaataaaacatcgatcaaccttcaggaatgtcatcagaaatcaccgccaactccgcaatgatccataagaaaatgttgacatagtgcgggtactcttccctgcacagttcagcaaggtgccttcctgtacagaactcaacaaaagcatggacaacataagatgataaggtgatgatgcatgattagcatgcaaagagcaaggttaatggttaagtgaaatatacctgttttcactccaaggttggcagctaatgtttggatcagaagtgcaaagaccatcccaactaagatgacccacagaagctgttcattgtaaaatgtaaattgatgttaccagaagaagcattttatataaagaggaggcaggaaaaacgaaatagttaattttgtttttctcctacttttctgtttcttgattgaatttgtcttctttaaatattaggaaagaaacaaattattgaccaccatttactaggcatgggagactttgtttgatttcgtgtactactgctactattatatcatatatataaggttcatgtcatgatagagtcatctcaagtcaatgattgatattccaacgttcttatatgtgtactccccaaaataatccaattttctttcttcaaataagacattgttgcttatgctagttaacggggagtccttttggtacagtccttaggatagacttaagtttaaactttgattatttaggcctttaaggaaacatatttcaatattctgtaaaggccacaccctcagtggaaggtttagaattcttcttgttcagctatgaaatcagtgcaagaaaatctcaaaatattatttatatttggaattttaaagatatttcaagtcaaaacatccaggaatacctctaaaatgtttaagagtctgttttgttcagatttgatgcccaaataagtgttttcctgacgcttatactaagtaggttctttgtaatagttaacaattttcaaaggccaaaccaggcaattttccaactaataaatggttccaagatagtctttcaatcatttattccaagattgggagcctttcaccaggtctttatttgattaaccttggttacattcaccctttccatgcgcaggcaaaaatctatgacacatggttaattagttcgtaaaagtagttcagatccaagacgaagaggcaagaactatgcagtgtacctcatacttgaagtcagctccagcttgcatgtcagtttccactgtcaaatcatgtttcagaaaaaagctataccacctcaacctcttctttttctttttttcttaatgagcgtatcaaaacaatatgaagctctaggcaaaagataggagcttacagttgctaggatctaggaagccaatggccaccagagctccaggcccaacatgagccaagaatttcctccatcttggctgttccacccagcaaaaagtaagcataggattgaaacaagcactagcttattgtggcattagaactccatgaatgcgcaaaatgtagtcgcttacctgcacccgaaactgcccatctttttcactgtcaatagtcttttctttgtactcatcagtctcactaacactctgcaccacacctccatggagagtttctcgtccaacctctctcatctcaccagtcccttccatattctatgttgctaatgcaccttgtctggaagatatgaaaaagtatgtcttgctctagttaagagccacatacatcctttgtattttatagacccagagaccagttgacgactgtcccatacagaaaccaaaacttcaagtacagtacaagagcagagtgactagctatcatgatggttcctgttgattcctcgcttattagatgcctttcagatctgctactcttgttgattgcagtaacaactgagtctgcaatattaaaatggaaattctaatcactttattttcagtattaaccacctcaatctagaatgtttaagctgctgaaaaatagcacttttagtcacatttcaacagcccccgccgcactataagttgtttagtccactgctacaactaaatgagatgcaaatatttttcatcggacaaataagtcatcacaaattctggtaaacttgggcaaacaaatgcccagtggcatgaggggcccaaggctaactgcagcataacacaatcacaattacaagctgactaccacgcataagaattcaaagctgcattacccaaacacctagacgtaaattcagcatgaccatcgatgttgtcatccgtcaaacctgaggatctacccaataggattttttaaattagaagggatttccttatctcccatacacagccacatgggtcgtatgggtcttcgctcctagatattttttggcccttatacaaagtttgatatgttcctttacagctaaacacctaggcttaggaaacaccaacgtctctacctaagatacaataaaatacatttgataaattgttaagaacattaatgccgccgatgtacctttgcttggctgttgctttccgattattttggagcctttcgggcagccatttttcggtgaaggcaaccttaagcagctcagacctggtgcagtccacatctctgtattctattgtagctattcagatgataagacttaaaaaataagcaacagatgaaaggacaataagcgtacagtcagattgtacttaaaaaacctcaaacctactctccattggaatccatattctactcaccaaattggaactagcagagaagagtgtgatgtgaccaccacctcatggaggatgaggtgcccctccatgcaccgaatggttagcttgctaacgagttgatacgcaggcgtgcgaaaatttatattgtcggccatggcttcatttggtcgaatgtggaagtcaagaactgtggatttatggcagtggacagaagaacaatgacgggaagtgggaactagacttgggaacggggaatttaaaatgctattaaaattttaaattaaaattgggaattgcattttaaaatttaaattgcaaatcgacttaggttttcagtagtactaaaatcccagaggcacaggacgatttggagtgactagcagtgatcaaattattggccacgaatcaaccagaaagctcataaacccctactacctaataatttcacaggacagtaaaacacacgagtagctcaccatcgccgagggagagaggcgcgggcggctcctcgccggggggctgcggcgacgacggggacgacgagcgcgaggcggacctcgacatggtcccccgcggcgcggcgctcgggaggggccgcggggtcgacgagcaccctcgggacggggaccctgtgggggacgggttccccggcgagcgagaaggagaggaggaggagcgagtcgtcgaggcggaggtcggcggcggagagctctgggcggaagaggtagaggcgtcgtcgccggcaacggcggccatttcggtcgcgaaggtccaggcggaggagtttgaagtcaggccgagctttaataagagaagcccagcccactctacataataaaagaagcccagcccactacctaatgaaacgagcccagccaataaaataaaagaagctcagcccactacataatgaaacgagcccagccaataaaataaaagaagcccagcccactctacataatgaagcgagcccagccaataaaataaaagaagcctagcccactaataataataattgtttaacaagcgtcagacgtgttggttacgtacgcggactcgtggagtactacacatatgtgtgcaggtgcagcacattgcgaccccgaccgcaacccaattaggcgcggccgcgatgaacgacgacgtggtggctgagatcctcttgcggttgccggcgaagagcgtcctccggtgccgcgccgtctgccggagctggcgccgcatcaccaccgccgactacttcgtcgccgcccactcccgccgccggccgctgcagctcctcggctacacggggcccaacgacgagtcgctgcgcgacgacgaattcttggtcacctccgccccggtcaccgccgtcccagccgtctacgacgggacgacacggagtgccggcgatttctgcggcgcaacgtgcgcctgtgcctccgtggatcctgcgacgggctcctgctgttcgagcaggtgaacgccgagaccatgctcatctgcaacccggcgacacggcagctcgtcaatctgccgccggtgagcactggcggcgtcgtcgtcgaccggaacgacctccggctccactcttccgccttctacttccaccggccgtccggcgagtaccgcgtgctgtgctaccggaagggcaccaactacatcctctccaccggctccggcgaggcgcggcggctcggccccgtccccgaccagcaacgcaggacttgctccttctccgccgtgaccgtcggcaagacggtcggcgagagcgtgtactgggaccgccgtgaggtcgacgatcggagccggataatggcgttcgacacggtgtcggagaggttccgggcggtcgcgccgccgccggtggagcatgccgacgaaggcccgctgctggacatgcatggacggcacgctcgccgtggcggcgatgccggcggagccgtacctggacgtgtgggccagagacggcggcggcggcgagaggtgggtgcggcgcctccgggtggagctgccggcgggatattattccaaggagttgaagcctcgggggcttggtagagctatcttggacgacgcgggtctactgcttgtcaccttgtcctgcagatggggcttggtgtacgacaccaaggagaagaggatgctcagctgctctcatcgtagcagaagcaatccgtggaatgcagcttaccgggagagcctcatcacggtgaaaccttgcacacccccgctcccgctaaactctgagccatggttaaatttctactagtggttgcagtgatatgagtagcgccccaatatctcaagttcaaatttttataggagcgaatttcagattggattatttaagagctaagttcctaatttaaaaaggctgcatatatagttggatgtaaaggctagataaaaaaaccctactaacaaaaattactgtccacgagcatactgtcgacacatcggtgacggagccgccggtgaggaagtcggcgtcgggggaggagagtacgcaggggcctctccggtgagatgccaacgtctccatggcggataccaccttgctcgtgtcgtgactcatgagggttttgtttttgttttttttccttttttgttctttttttttttaccgtggggttttgggggctaaagaagaagatggttacgtgtatgtacagctgggtccagttctaaaaaaaatacagctgggtccccgggtccaccggcagtgaaacaattccggtggaccaagtctatggcaaagctagccgtgtggcatagggcccacgaattagtagctgggttcacgtggaccagcaacagtaacccaactagagttatatctcttgaacagaggcacaagcgagaaaattgcacatctaccattccataagaatggcttcgctagaataccattatgaaaatgggcttcgctagaataccatcctcaatcagagtgtcttcgccaaaatgccatcctggacggaaatgcccctggctcttctttttcctccatcccgtgcgtgaagagctcgccggcgaccatggccagctccaccgccgcgccaccgatgctgccttgccgactgcgattggggtgttgctctccctgccatccccgccagtgccgacggcgggcgcgggctccagcggagggctgcacggtggcggcaggtgcgatcgacggcggcaagcgcgggctccggtggagggctggtcgatggcggcaggcgcggttgacggcagcgggcgtgggctccagcggagggctgcgcggtggcgacgaggaggcggcggccaggagcggcgccaccggctccccgtgcatgcgcgtcagccggatcctcgccgtcgctgccggagtccttccgtgatgacctcagctgcacgagcacaccactctaccgtcggcaaggcggcatcggtggcacggaggtgtagctggccatggtcgctggcgagctcttcacgcgtgggatggaggaagaagaagagccaggggcattttcatccaggatggcattttggcaaagacactctggttgaggatggtattccaacgaagcctgttttcataatagtattctagcgaagccattcttatgggatggtagatatgcaattttctcggcacaagttgaataacctaacctaaggctattgcttctgtagaggttagaacatttcatcacacttttctaaacctctatgatcaagcagaaccataatcccagaaggaagatgcccccaacttaaaaccaagagaatatgaaaatgcaaggcacgtttgaggtaatttgcacagatcatatgaacataatcagttgcatcgaggcacatgaatccgttgcatacagatgtaagaagaaactgacaacttatacagtatgccaacagacacccattccaaacttatgcaaagacaagagacgtgcaaatcgattcgtcatgaatcatgattcttacataggtaaaaaaaatggaatgcgatggtttcactgctactaaatgctaagtactgtgtgaagtagattgccagatggttgaaccacctaccaccggaaatatactgaaccgaattcactggtagctgggtctaccgttactccattttgatgtcacactgtcttttgacagcagaagataagctcaatgtcttgcagtttatcgagatggtcaatgtgttcactgaaagaacaataaactgtgcatggaaaggtattaggacattgggacatgatcacatgatctaagtttatcaaattttcaagtcaatgctctggagacgagaggaacattctctagagagaaaagcaacaaagtggaactttatccctacctgagcttaggcttccaataaattcatctatttggtgcctcatcatgtacaactcttcagccctacatttggatgatcactcctctattatcctgcgtgctgggaaaagcagaagttcaaaatggtggcagaataagagtaaataaacaatgtatactcatttgcacacaacagacttgcccaagtgcaacagttgccaatgaagctggccaaaattgatatcgaactatgatttagacaaagtatgacactgtgcaaataatcgaatgtactaacgttgggtttccccagaggcggcgcagatgaaggtcccaatctagcacaaatcaatgggatgtgcagctgtgcacaacattcatcatcaactgtcgcttcagttcacatcgaatccctatacaaaaataagcaagaacgattagttcagcattcagaaaaacttacattaagttgtatgaatcaagctgtattgcatatatattgttgcaaacatagtttcgaacgtctcagaatagtatagagctttaaaatcagatcaattgcatttgggcccaaaccagtaaaacttacctatgtatagcttaacacccattcacagggaatctgaaagtttagaatagagtattaaaaaccccacaatataactgaacgttgttgttttaatggcaaaagaaaacagggattgctctagtttcaaaagctgcaattcattgtagtacaccgacatctgaatgcccagtttaaaggtagatttgttttttcttatgctggattgtatgaattcgacataatttatataaagaattatcattcatttgccaatcataactattatactgttagtccaaactccaaagaagagtaaatataacagcacaatgcactgaacatgtgagatgttgagcgcaacaatagtgtggcaaacacatgctgctcatgtacttaattgcaaaacttaccagatatagggttagatcctttgacatgtctttcttgacataattgctttaatcataactctttctgaaaggtagcctaaaatagcaacactgcacagcaaaacaaaaaaaaaacctattatatgcaaaaatctactatatagtagtgctgtcatgtaacgatgatcttaaagtgccaacatacatgatatttagtgggttgtagaacaaaagaagtgcttggacagtatgaacctcagacaggtaatctagcgcatgtgttaacatatcagtggatctttcgatgaatagagagtacaacattcaaccaaagagtggttatgagttatcaatgaagatgaaatgaaatttgttgccttattatactcacctttcatatgttgcgatctacttatatgttaaccatccatattgaagcttacaacatatgtgctttcaagttgtattagctagttacaagcaagttctaaaacttattatcattcataagcttctactgtctgcatgtaatctagggtaaagagaaacttactcagccagtgttttctagtacataaatgtcatcattctgctgctgcttattctcataaacgttgcctctttgaccccatcctgtcttcactctcttggtgattttcatgactgtgcgagcactgtcatctctgttgaatcagcaacaaaatcaatccgttgcagctcaagttcgacacacaaaggtagaaagtgcagacctatttttctagacaggataaatttcatttctaggttctgagtacatatgctttatatactaaatcagttataatgctttgttgctagtctaaccaatgcaaaaacttgcacaagaaaatagactaaagaaaatgtcacaaacacatcagaactaaatttgtcatcacaatacctgtgcaaaagagcatgccaatcactttcagcatgcttgtcctgtccatgcttctgacttctaggcttaaattcgccagaaggagctgcaagaccattatcacgctctgccatttccatcattttttgtgagagcatatcaacatgttgcttctttcccctttcactcaatgcatcaatcactggcatgaatgctgctggatcaaatgaatatcctttaaccattaacagcttgagtaacctatgtccatgatccacctcatcaactttgcagagtccctcaataatctgcttatatgggaatctatggatagagatccttaattcaagcactgtttctagaatattcatggcttccaaccatctaccataagtagataactgggtgcacattaaactatagagcacttccttctgaccacatgtactcagagaagcatcaaatactctctgagctgcagagaaatctgaagttttgcagaaagccttaatcaacaactcaaaagaagttatattaggaacaatttcattctgtaacatttcatctaaaagaggcatggccttgttcaccattccccgttcacaaaatgactttatcaggctattataggtcatgacattgggacaaatccccttccccttcatttcactaatcaatttaaggatttcatctgaattgtgtttttcccgaaatccccatatcaacaagttgtatgtccttgtgcttggcttgcaacctttcttttccatgtccctcaggaccttaacagccagagaagtcttcccatgcttgcaatacccatgaataaaggtatcatatagaaccgaatcaggagagatatctttgcctatcatctcaagcaatttcttctttgcttcatcaaacctgccctctttgcacaatgcactcaccagtgtagaataagtgattcggtcaggaagacatcttttgctgctggaagaatcagtaagtaaacttaggaatgaataacctaatctgccaagagccaaactaccttcgttccacatgccatcgacaatgtccatggccatatccaatttgttgtttctacatagtccatcaataatgatattgcagcttgctgtatccaagctgtatcctttctcactcatcctctctaacaatcgttctgcctctgtaatcctaccagctttccacaaactttgcagcagaacattgtaagtaaatgaattcggggcacaccccttctgtgccatctcatcaagaatcctattggctgcagcagcatttccctctgagcaataagcgtggagcaaactagtataggtcacaacatctggtgtcatgacaccactcttcacaaaatcctccactttcctcacatcaaacgctttgccctccttgcacaacccatccacaataatattgtaggtgtagctattaggttgaacaccctcatgcgccatctccctcagcagctcctgtgcttccccaaccattccattcctcaccagccctgacaaccaacggttgtaactctcaacccgcctcaagaaaccaccgcacctcataatatccaccaggactcttgcttcatccaccataccagcctcacagaacccactcagcatcacgtcaaacgtcacctggtcaggcctcggcagacctctctcccatttttcctgcatgtcgttgaatatcctgtatgcatctagcacccgcccagctttgcagagtgcagagatcctcgcattgaatgtgaccacatttggagcaagaccctcatctctcatgcgctcaactagcctctcagcctcatccacctggccctcgcggcagaaccccgcgactactgtgttgcataccaccaaattcatcgttggcattgaatcgagcaccccaagcgcgtccatactcctccccgcacggcagtacccacgcgccaggatcccgaagctgaactcgttcctttccggcattgcgtcgaacaccctgcgggcgagctccatccggccagcggcacagagcgcctggagcaggatgttgcgcgtgaagacgtccggggcggcgccggacaagaggagatccttgtagagcgactcgacgaggtcgaatcgggcctcctggagcgcggcgaggagcaggcggttgtagacgggggtgggcggcggcggcgcggaggggagcgcgcagagggagcggaacgcggagagggagaacccgagcgggaggcgcagcggcgacgatgaggaggagaggagcgcgaggaggtgcggcgcggggtccgggagggagaggaggtggcggaggaggctcgggaggagggcggcgtcgtgggcggcggcggcggcgaggatgcgggcgaggaatgaggtggagtgcggcgacggcggggacgcggcggaggtgaggtggaggaagaggcggagcgcgacggcgggggaggcggcgttgcggcggaggagggcgaggaggtggttggcggcggtgggggaggtggacatgggaaggtggcggccgcggggcgacggcggcggagagggtttaaaccggcccgggccgactggccggtggggtacacgtctggtcaacggcccagtccactgacactgactggtgggcccggccatgttacattttttatgttacattttttgtgtccgtatttccacttgctgcttagagcagatactacagatttgtagccagctatagcacggactccaagacacaatgtgtgtatgataagtgggactagatgttaatagtgtagtacgtaactattgtatgaattggctattaagttgactatagatgatttatagctagtagttggctatactattaaacttgctcttggtatactccgtacctttttttttctgaaatttgcgcttaattagttcggtgttctgggttcctaaccctgcctcgttttccgaacacacgtttttaaactattaaacggtgtgcttttttaaacaaatctataaaaagttgcttaaaataatcaaattaatatattttttaaaaaaaaatagctaatacttaattaatcacagactattttagttcaagcttactccactccaaacattttgaaacagggtgaatatacaggaataaatttgttatttcacgcggctgtgaaattgtaagttggaaacagcagacgttacagagtatttcacgttacatgaagcagtgcagcacaaaccactgcagatttactcaacatgagatcattgccaggctatagataaagagagaaaaaaaaacataacctaacacacaacgctgactgaggtaaagatcagtaaaatgaaaaagaaaagaaaaaagaagaagcaagaaactaattccagttgtgagaagagatcagaagcaagaaacattctcggttctcatgaccaggttgcaagtcgagtagatggaagcggcagcagcttgcactgcccactcgctctcaggagtctccgagttcttcagtttcctgaaagacatcgtagtagtagtatttcagtaagatatatcacgcataaagtgaaatgacttggaaactactccctccgtcctaaaatataagcatttttagctatgaatctggacagattcatagctaaaaatacttatattttgggacggagggagtaagacatttagttgctatatatttgagtactttgttcaactaagtctcatctaacagaaaagggtggatcgaatcgaatacgttgagaggtgatgatgagctaaccataattcagccattggtcctactaatggagcctcgcaagccatgtatctgagccctttctcacaattcatttgcatttcttgcacttccttcaaccgattctcctgcaacagtaatttagcacggtgtcagtagtggaacactgcttaccagaatggatgtgcaattgcgcatgcacatatgcttttgtcataaaaggcgatattgcgagaatatgctagttttgtgcacctataatgaacactattatgaaaaaaactcaccagatgcatcccctcctcctgaagtgttctgtccatctgaagaaaaagagaccgccatcgtgccacatgcgcttctggaactgtttttccagtagatccaccatcagaagaatgtacaacggatggttcgttctcttggttatatgaaaattctgttgatattaggtagggcagttcagtctgaagggcattcctgactctcttcttgctgcgcttcaaagcttcaagaataaagaaagcatattaagcagaatgtatgggttacagctttgaattatgtttcaaactcaagaattagtaccagcaaggcgccctctgatgtcctgctgtagtagctccaaccactgagaagcaacattggccgctgatcatcaaaaaggcaaggcaactgtcaggtatagataattctacaaacagtgaacaatgcagttctggtgagagtgtatgattgacgaaataagagatcaagtataccttttactgataacacagtcatgtaatcatgattagatgcaaaatcatcggctgatgtactgcaggtcctgtctgaagccatagtgactgctgatgagagttgcagtttcagatcatcaccgtcctctggaaggaattgtgaagcagtaggcaacccttggtgaaacggcatgttgctacctttcatcaagaagtggcaattcatcatattacccccatatctctggtcctgagccttctcactaaattctctccctctttcgcctgtttgactagcatgaactgcctggttctctttctcaagattctcagagtgcaccatagcctttattatggagtaaacttgcttgctgtttctcacatggttaatgattccagggtttagcccagataataggccactcggagcagcaaccttcatgaacttgtttgtctgttccttctgagcaaaagtgttccttttggattcatcgtctcttttccttttgatgggtcgaccgcgcggcctaggacccactgcagttccttgagatgaagaaaggaacccattctgcttcatttctctccacttcctgtgtgactcactctctcctacagccccagttgtgctaccacactctgacggatcactaactttcgtctgccccaacttcttgtaaggaaagaagggattaagttctgcagcattggaagaatctactatattaagatccaatccaagaggtgcaccattcattctgttctctacatgtcttacatcaggcttaggttgcaagtctgtcctgatgttttctttatcacacaaattgttcacctctgctgcatcagaagaacggcccaaggtgaggcaggcagcctctggctgaagaaatgaaccagtctcaagcaatgagggctctccatcttcacttcttgttgcaacttcagcagtaacttgaggtgtatctttcttgtcacatggatgtagacaagattttgctcgatctgacgaatctgaaatccccactctcatatctacatgatatagaataattagtaagcattagcagtgcaaagattaagggaagtaaccagtaacacggtcaattaggataaatcatgccttggacagtgtacagtacataataggaattcagtggtgtgaattgaggctaaggatgtgtacagtacataataggaatcaggaatgcatgggtttatagccgtgtttttaaaaaaaagtgtacaaggccctgtacaaggatgcatacaaggaacgagtgacccaaccttgtaccgcttaagccgcataagttctacaaggtggggtgaccgcacgaaaccacataccgcttttcaaaacattggtttatggcaatagaaaagagtaacactcacgaattattaactttgcatggcacagaaatcaattgtcaacagcagtttcatcctgaatttatcatttgcacattctacacatccaggagtaatcttatgttggtagcggtacagaaatatgctgagtttgttatgtcaattcgctcctcaacagaagcaaacaagaattcttaattacagctacaagaaaggctaatcgaaaattcgatctactcatacgcttagatctgtagagaagcaccataatctaccgtcacatgtcgaaattctgtgctgccagcgaatgaagtactactgcatacaaagagttcaagaacaactaccacccaagaaagtaaaaaactagcatttccagatcacccccgcgccaagaatcatccaaccagcacagatcaggaaccaagacggcaagaaaagaaaatcaagaagcgccgagaaccccccacctcccaatccgaccgccgcccgcgacccgcacgacgcctccgcagccaccgcccgacccaattcctgcaagaacacacaccacaacgtcaaatccaggctccccaaatccaaaaccaagaaccaacgacaccaacatccaagaccaccccccccccaccccaccttcgtggtcgtcgtcggcggcggcggcggggacgacgcgcccgatccggcgggatccgaggccacacgcagccccgcggggtccatccgggaggccgcggcggcgcgcccgcgaagggggagggatcttggagctagggtttgggggggggggagcggggcggagggaagctttgcgtggatttgaaatggagacgggtgcggaggcgtgctgtgtggggtggggtggggtttttatggtgtgcgggttttttttgaattcgagcggaggtgggcgcggtttggatggggatggatggatggataatgagacagatggacggacggatgggtggatggatcgctagcctttaatcgcaggagcggccttgcggttgcggatgataggaggggagcccgcggatttattttcttcttctttttttcccaccttggtggtttgaaggtgattggtttgaattttggttgtatacacagctgtgggtttgaattttgaatggtgggctactgaccttgtgtgacatatggtgaacacgcttcaattctcttgatggagtaacgaggggaggaacatcaaaaggacaaaaggaacacaagccatgctataggctatagaaactagtactagacaagatgataaacattgcttgagaatgttctaacagggcacttgagacgtattttgtgtgtacatgttctttagtgtgcacctccaaagtcacatgccacatatatggttgtatgtctaacataaacgcaaaaagttgcacaagagtgcataccgtctaacaagatcatttgtgggatggaagaagtatatttttataattttgcttatgagcattgctacatatgcaagcctcaacacgagagaattcattatatggccctaggtttatcacatgtctacaatttaccactgacttgtcacgttgtacattatgctatcgacttttgcttaacttttacgatttaccatcgctatctggttagcctctgttagtattatacaatcttatccaaatgaccaaaatacccctaggataaaaactttcaaaatttgaacaaaatttttgaaatatcatattttaagtttttgccaaattttggatgtttacaatatgatattttggaaaaaaatccaaattttggaagtttttgtccttgtggtattttggtcatttagacaaaattgtataacggaggctaaccggacaacgatggtaaatcgtagaagttaagcaaaagtcgatggcatattgtagaatgtaacaaagtcagtggtaaatcgtagacttacgacaaactcaatttttttttgcggggacttacgacaaactcaatggcatatatataatagattctctctctctacaaaactcttataaacaataaccttagctgtttgatttaagtagataaaagctatagacaatctagatgtactcacgagtcacgacgtaagatgtagtgtttgtaagagtttggtatgacacaatttaggccctctttgtttaggcttaggcttattggcctagacttttaagtcagcttattggcttatatgatttataagccggtggatttaatgtcctaagtttagtagttgagtcatacatctacctcacataagccaaaaaagcttctccaacctagcttttggcttaatagtgttagagtggcttatggctttaaaaaggccaaacagaaaagctgcttgtttgtttaggcttagacttttcgacttataagttggtttataagcctaaacaaagagggccttaatatgtatagacttttcctttgcggattgacaaggtattagtccatactctcatatacaccccatattaaaacattataactcaggcaaataggatagagaccactaccaaaagtaaaattttacatcctaaaatatgattctttccgtctcatttgataccaacccttcactgaggatttatttagcaaatgggttataagaggtgagatcgggataggaaataagtgaaggaacaagaaaataaaccaactgactattttgttgtattataactatggctcgttgtatctccactagctccgactcatctagacggtcgttgttggatgaaggtctccatcttacgttatcatgactgaacttaagcattcatcgacttgtatgcagggttttacggtgccaatgcacacttgaggtaacacaaagtgccatgtgtcgatcagattgtaagttatgaataattttttcgtcacaagtgcggcgatatttggtaccaaacaaaatgtatggcatataatagttatagtaatcactttggctaacaaactgcggcaattctaagatttgatgtgacaatctttgctacaatccgaacaagcctaatattttacaaagataatccatcgcatagctagatcacaaggaaaaaaggctatcacgtgaacatgttccaacctagttctggcaacagttagagcacatttggtttttcagttcgcattacgcatcactcttccgcgccattccatccaacatttttatgagatacatgggcctcatggcccaaataggtgttgtgttttttctctttattctcaaacttgcttttctgttttcaaatacatatgtataaatttccatgcaatagttctatgtagaatatttctatgctaaaagtttctatgtgtaggtcctaattggttacacatattctctaataagtcaaaacgacttattagaaaataaaaattaatttataggtaaaattttttatatatgtattctttgcgacttaaagctaatgttaaaaaaactacgttgaaaatatcttaaaatcaaattcaaaattaaatttgaaaatataaattttggctttagctttggcttattaggacaatcaatggggctcgtaaactttctagatcaacatacttttcaaaacgtgggggcctgatttcaaatgaatatatccaaaacgaggaaggaatgcctatttctatctcatcttcattctaagtttatctgacacgaaaaaggaccatagacacatatatagttgactcgcgcaacttcagttcacgcaaacacatgttgagaaggctattgggcgatcagtcgcgcgcatccctccccgtgcgactggacacgtgtcgcgcgtggggagggagcggcggacgcgccgcgcgagagtccgacttttccttttttttttccgtgttttccgtttctgtttgtttggcttttttttttccgtttctgttccgtttggtttttccttgttctttcggtttcccttctgttttttttcggttttttaatgtatgaataccaagttttgtattcgtacatatgcaaagtttatatacacgtatgcaaactttgtatacgtgatgcaatttcttgtttttattttttaatacgtatgtatataaagtttgtatacatcgtatacaaagtttatatatatcctatataaactttgtatacattgtatataaactttgtatatgtgtatatattttttatgcgttaaaaaatattcataaatatatacacacacgtatatacatatgtatatacatatgtatatgtagtatatacacaagtatagtagtagatacagagaagagactagaggggaggcgactgaccccgcgcgcatgggggcgcgtggcttatcgtgtatcattgtatcagcgccccccaacacatgttattaaacccaacccgacacaaaacgcatcgcgacaaaataattatgacatgaacagtactgaatatcaattgtattttataattttctacttactgttaatattaggattttgacaagataaatgtttttattcgttttaataaggcacaaaactgttttgagcacttgtttaatcgcgtttgaactttgacgtgttagttttatgttcccattccattccaccatgcggtccacgccccctcgattctctctgctttccgcgctgctgctgaccgacgacggccgcgcccctgtcccggtctcctcctcgtccctcctccccgcctctccactcttccagaacatcgccaccgccaccgccgccgccgccgccgctcgccggccacgaccgcccccggcccatctacacctccgccggatctcgcagccgcgctccccccattggagggagatccgttccagcgcgtgggtaagcagcagctgccttcaacggttcaacccaacctgcgtgatagataggtggtgggtggtgtgacgcggggggtgttgcaggtgatttggttcgagagcccgcgtcgcacgcaccgatcagtttggggggagggggggggggggggtggtggtgtgtgatttggttggagaggagagtatagccttgggaggggaatcggaattgggatgtggaatccccttggattggatgaggtgatttgatgatttggtaccaggatatactagctcgagcacatgtgctgttggaattggattcccacctattgggtttggttgctgctgggttgagggagagtagcgttaatcattggtccccgtgtagtattcactgcagcggtatcagttattgcccgttgatgctcgttgttgaattcttgaacatttcaaagttttttgatgcatccaattgctaatttctagattctactcaacccaatgctgttaacagagcccgtaaatcagaggaatgttgtaggacatgcaagtggtgcagaagtaacacatactcatttattaacgtatttttctacgaatcacatcaattttgcttaaaagttcgccaaagcactagcagaaagcagccctagtgacagcacatgatcctattaccatagcttttggagtataacttatcaccttccttcccctgattgctaactgaagaggagggtactaatatccatacttcaaaccatcaggacgaaaccaattctgcgcaacttagtaatgtggcttgtacctttcttttgcgcagaaagagaactttcattaatcattaatcaatacccaaaaggagtacattcagctactattgttaatacaagtggcttgtattttatacagagtataaactgctataccctttcagctataaattgttagttattgttaggtttgttggtccttttgcccctgcaggatttaatttcaacacatgactggtgaaatgtttgcttgatgatgtccggacatgatttcagtattgttcataatgcagttggcatctcatgccactcaagcagatgaagcaacagagcttgcttccagctgtgattgtgcagaagtgccagcttcacagcagatagtttctgaatcaagtacagcaggaagctccacagagcatctagtttcatgtgaaatcaagccactgggtgttgatgaagacattgaaactattgatgctaacgaagaaacccaccttgtcattcaagactgtccacaatgccggatttgccttgataatgaaggtccattctgtgacttgaagtatctttcttatggagtgccataaaggctttcgattttttttttgataatattcatatttttatgttgagtctacatttgatctgatattttttccatatccactacaagcaggtgatgacttgattgcaccttgtcattgcaagggcacacagaaatacgtgcatcgatcctgtcttgataactggagatcaacaaaggtggattcatgaacatttgctctttatgcttcatgtacctatatttactgccatcgcagaatccagttaatcattaacctaatccagctctgacctagtttctatgttacatttccaccaggaaggttttgccttttcacattgcactgagtgtcgggctgccttcttacttcgtgcaaatgttcctccagatcgatggtggttgagattgaagtttcaacttctggttgttagagatcacacgttgattttttttattgtacaactggtacgagttccacaccttctgtaatctaattcaacaaactgttttttctttactgaaccaatactgaatacatctcagtaggatttctccaactgtttaccctaaaaaatgaacatgctacaatactgaactcaagcatgacatggttgcaccttattctgttaatgtataaagcagtaatgattttatggatttatattgatatcaccatttctttgaagagatgtggtagttagttcactgacttcttactaatacattgccatgatttctggcgtgagatccaaaagataaacgtttttgaataaatgcacaagaaagaggcctgaaaatggtcacgatgtgctgctgtaagatgcatctttgtttttgtcttacaatcttatccgttttcctgcctgataggttgttgctttattgggtatgctagtatacagattttatggagatgaactacgagaaatgtttggttatgaagagcatccatatgctttttatgcaatggcaagtaagttactttttcatagtgatatctggaaatgtcatgaactgcatcttatctagaaagctcatagagaactgaaaaacttatcgttttcttgtgtagcatctgttcatgttgatccagttcatgacatgtactgtcaacatggcctggcatttatgtctctaaagaaagtcactccattctattacatctttcatttcatacttatagctaccatttaaaaatatggtgtggaaccaaagtacagtgcaatttatgtagaattgcttttatgtattgtgaagatcatcgcgcagtttataatggcagctatagctttgggcctttgagatgaaagataacatatactacacttaatgttgggcgtccatgattatctaagtgctctctatgtaaatggaatcacggaagatgcttttcagagggatttgtttccatggttcttttagaagactgcacgaattgtaacatagtcaaaacaaaagtctatgtggtcagagggaactaaaagcaactggcagattagatgagaacgccgatagcacatatctcctttgttggcatttaactcaatgcatgtgattgcacaggtcttgatgtacatatttttgccctgtgaatgttgtctgtgtacaggaataagaactatatcctctacttctacgttaaaaacttgttgacaaaataattaacgttttaaatgttacttaaattgcagtattggctattgttttggttggtttgctgtatggattcttcatagctataatatgtgggcagaggatcacagaacggcattaccatgttcttgcaaagcaagagttaaccaaggttggttaaagaacataaagatggaaacacaattttcattgactgatcttttcattttcaagaactacactgtgtcattgaaatattaatagtagtgccatcaactgttcaatctgtatatgcacaaaaacatgcagatttcttcatcttttttttttttacttattccaaccattacatgaccttataaggttgtgaacagactctctcatctctatttgcgaaaacaaggttggtttgttttagtgaaattaaataaataagttgtgggtgtattagtaataagggtgaaaagactgcctaatcaatgatttaatggtagaccatgatggccccagcagggaacacaaaatgaggtttcttatgacataatgtagattctttcttagctgacagtttttttatgatgcgaaaagtgttctatttacattcttcccttttccttatggccaggggtgtagccgagattcttccaagcctaggactagagcattgcctttgttatagctttttttgccatgtgggacctgagctctagttgccccacacatggttcccttcctgcctatggcatattatcttcttgtataccacataaagcttgtatttaaagttctattcacacctcacagtatttgatattcctctgatggcaggagtatattgtagaggatcttgaaggaactgatggagttcctgaccttgatcctaatcatgttacagagctgaggattctggggctatattgagtactggagatatcatcaattcatcaggtaggaaatttagcacttgtgctataaaatgtctgtttagatctttttatgtggttgctacttcctcagagatctctctttgcatcctacaaatgtagcagagctcttgattaacaatagccacttaaaatgataaaatgtggcatcaagcatctcacacatccatattttgccccagacatatgtttttggtcattttctacagttttgttttgtactaatgtgcaatgcatgtgatgccaaagtatttctggataatattttatgatcactgaggttttgctactgcgtatggtcagttgaatgccacaaatagttctttcactgtgataagatgaagaaacttgtacagaagagccccgttttttaatcttttttttttaacctaggagtgcttatagctgacttatatactagtgatccaagatgaatcattgtaactcagttagatcttccacattttctgaaaacagttggattcagtccttgagagttgataaaccatgcttgatgtggcttctgatgaacagattcagacacacctcaaaatcttagtttttttttgtttcatgggaacaacacttggctaattcaagttacaatacaaagatttcccaccacaagggacgtaccaacttgatttgaatatgccatgagccatgaagagtgcatacattttgatggagaagctgtagatatatatattcatagcttcaccttcctattgagatccaaaactaaagtaactgcattgcaataaccaaatccatcaattgttgttgtgctggcataaatcaggctaatttctgattaatcttttgtactatttgcaatgctattacttggcttaagaaagagcaaataaaaaatgtgattaaaagacctgatgagatgatgagaaaacgggaaaaaattataggagaagaaaaacaatgtagtcggaagaaaaaaaaaactggaaggagaacaagagtgtgtgaaacatttttgtcaagcagaaatgtttgctgaatggaggaacaattacatggaaggtctgtggatcagctattatctttggagtagtccctagtgccttatctaaggttatgccctctattatgagattgcctcgggaacaagtttttaagctcccataagggtcggctcctctgttcatgaaagacctgctgccctgccctgctaggctgcttgcgggcccagtttcaggatgtcaaggaagttggtgaactgatgataggaaagcaaaagccctgtaaactatggccatagccataacatccaaaggtaggtttatacttttgttcctttagccgaaccttatccatgtccttagtattattttgttactgccttgattttattctatcaagtttctgctgaaaattccaaagacggataaatcttcaatattcataccttgtcactgttccagtaacatgcgggcacccaacttggcccagcaacacctgataatttgcttgccttgttggactagcccagcatatccgctgcagtggtgctagaatgttctagctatgctcaatagagcaaaaccataccaacttgcgttaaccttttggatgaagaacataagcaccattggttagctggtgtgctgtagatatacattgcatgttacaatacacgaaaaacagatttcttggaaaataaatgtccttttcttacctaccgttgggagcaatgtcagagacaatctcttggaattacaaaactactccagcacataaagactttctttgaactcacaaatcaagagcttgtccttgagctatttcagcagcacattttaaaataaaatattttgtttccattgagttcttgtgctctaatttgtaaagctgaaacagtagaggaatcgatcactgatcagtttctattggagcagctataatttctgattggatagcttaggataaaataaataaatagaaggagtttcaggatgaatttgcaagcctgttctcatcagttatcttcccagaaccaaacattctgttcccattgcccgctacttaagcgaagaatatattctcctatgcatataaatttggtagtcttgcaggcatctttctgaaagtagcagaatatatgggtagagactagagagtactgttttttgttatattgacatccactaataaagcatttctctcttagcaaacattctcttggcatttttttttaatcttgattgcgtgttcttgatcttctgtaaattcgttttacttgctttcctttgtcagttttgcctgatacagtaataccatccttcatttttccccctttttcatgctatacattttagttttcttatctgttctcctctgcttttgtttacttcagtgagcaaaactgtcaataaacgaaccatcattctgctgtagtacttgcttcaaaagattgaatttgcatttatatgtggcaacacttgcatcacctatgactagtgtacattaaatttgggcaagtcaaggctgcacttgtctgtaaattttgtcaatgtgggttgccaagttctctatgcatgttagtgtctcttgacaatggcttgaatctgcttcccatttccccacttttcaattttatatcctggctttgtcactaccagcctagactacatgggttgtggagtggagatgatttgccaattgtgagcatgtttttgccgtatcttctccaggtcacctttagcttgtttctttgtttttcagaaacacgacaaatataacaagaacactattgattgaagaaaaagaatgttagtgccatttatcaaccagacaaatgtttgattagccactagtgattactaacggaagtgcttaacaatgaccgcaaacttttggatgattcaagatctaggtatcataagttcacaacatcatatcaggatcatgccttcattgatttatggaggaaatacgccttgggtgaattacctcctctggggaccagggttcaagacaaagactcttcccttctcttggggataaaaaagagctcgatagcttgaattgtcatcatatggccagtgggatcgatttgggagttcaaaaaacaattagaacataagaacaatataacacataaaaaagggacatgcacctgagtcccttatcactcgtaactattttcagctgtgctctgtcatggtcggtgcaatgattgtgtagagaaggccatttattgctcttgagacaccgtgttgatgcatctgaaccaacaattcatgatgacatactgtttctctgttatgcaactcaatatgctatcacccagacaattgtgcaaggttgggtgtagttggtgaagttactgaaaatgtgttgggtgatagaagtggtactttgagaatcagttcatgccatgtatgtttccatcagattcatctctagtagccctaaatgttcttaccatttaaattcttgctgaatcattaacatcaattgcaatgcctaaccgctgtgtttatttcatgtgtgttacactagaaaactgtatcacaacatgtaatcaaaaggaattttgcttttggaaaaatgactgtcaatagcaatattcttagcacattttgttaagttatatggtgaattttacttttctatatgtttttcagctaaatgtcgatgctaaaatggtcatatgggaaaagctctgtttagatacaaatccataaggctgatgctgcacggacatcatccagaacttcagcacaaggcatgacaaacgggcttatctgcgttttggaagacatgtttgtctgaaggcatccaatagagtttagagctatttcccttttttccccatgtaggataaattgctctcacacaaaaaggagaataaggtgagtcccctcagactctgaatcgatgatgaggattatgatagaaatgttaggatgccatttcgaatggacattttattagatattacttgtctcttcatgttcacaataaacatgaatagttataagaaaatgaggtaaatagagacgtatgcaagctttgcttttctgccttcataatttgcaatgcacatgctgggcatgtactggatgacctttttaattgtttctcccgtttctgattttctatggtttgctagtaccttgggacttgggatatgctgctgaaatgaagggcaagcatgtagggcagtactcctgccttgctgcctgcattttcacaaattcataatgtagcaaacacctctaagtggacagccgatcattaaggatccagtggaaccatctcatgtgcaaaagtggacatgattctgatggacacatgaactggattctgaaagttcttggcagcaaccctaacttttagcttgagcattgcacattattttgcccagaaagctcttcattttccttgggtgatcagacaagctcacaagcaacataaatttgactaaacagatggcaccaatccacccatccattattagtttctaatgttaggtcaactacacacttgcagctacaactgctgaacacaactttgacatacagttgcttaactttgttcctctttgatattgacagagatgatgttttctctaacatgaacacgtgcacagcaattaaaaatatcgccttctcgttttgcacaccaccttaagcaactttctcagctttgatcctgagtaattaagctaattaatgcaagtatgcaactatacaagattcaagcttttgttggaagttgaagacccactcactaatggtgggagtctaaagttaaactgcagcagcaagagcccagaagcaagcaaccatatgtacttaatctggcaagaatcactgcaatttgttctccatggcaatgcattgatgaccaactagttgctgaatgctactctgatggtgatgtatcatgattatgctgggtgacagttacagatggagacttcagcttctctatgccaaagtgtcccattggaactgtatctccttgattaattaggtggaggaactgagacttgatttgggtattagttaataaatgctcatcatccggggtttctgttgcataattaagacttaaccaccttgcaattacatatatatgatagtattattaaatgacaagcaactaaaccaataaaatgaaggtcaagattgatggctacatagggtgcttcagtctttgctcaactgggagtaggatcctaggttcacagtgtggtgaagctgtctcttttctagtcgtgcgatcataaactgaaggtcaagattgatcgctacagtaattcatcctgtcagatacttgtaacgagaaaacaatgacaacattttccctaaaaaaaagaaatcgatgacaagctctttctctctctctctctctccccctgagaaaacaatgcatagtaaaaaaacttccagtccaatatggacaacagatagaattgcagagcattattgcaaataatgtaatcatttaacaaatatatccatggatatgccatgaaatctgtaccataagaaaacaatgcatagtaaaaattccaatccaatatggacaacagataaaattgcagagcattattgcaaataatgtaatcatttaacaaatatatccatggatatggcatgaaatctgtaccataccgtatgttcttgaaatatatatcttgtttatgcggcaagaaacagaaacctgattggtttatggatcggatcaagatttttgcaccaagccaagaaggaatgtgatgctacatcaaaccttgatatctctctgtgcctccacaggatgacagtagctctgcactcctgaatttggaatggaaaacctcatgtcaaagaatttctggagagataattatgatatcatgttatatcatatcatataatctagtagcacccttttgaccaatgtgcctcttcagccacagcatcgagttgctcaaggtttctctcaacttgagatcaagaaaattgctttcaagcactattgtttaacagtgggattcaatttctctgacaatgacatgcaattccaatttgcttaataatatgaaaaaaaaagacagagatgtccaatggaatcagaggagaggtccatctgcagagctagtgttcatacttcatacgcttggatggatcaaccagccatttgaagcagtgattcagttaagctctcctcaccctaaaaaagagagaacagattaatggagaactccactaatatcatggtagagaagaactttaccatctagataattttgtgattcttaacttagatgagctagacaaggaatcctttgcttccttcttgtaatatttctaaaactgcaaaagggattgctaaaaggtcaggagcagaaagtctgtcaagtaaagtttaaaaaagtgcactcgatcatgcagtctgatggttttaatcctttcagagcaaggcaaatgcagctttaccacacaacactgcactaactgcaatgtcaaattgagccctaattggtgcatagctggtgcctctaagctagttggtctgtatgaactggccagtcaacatccataggtgcctggaagcttcagactctcagaaagttagtacaattgtgctaaattgaactgaattatacgcaaccatgcagtgggatttcccctctatccaggatttttatctttgtacaatttctgcaattcctgcacccaatcagtggccacaatctcattggctggcctccaaatggatgtgaagagcagtcactctccctgcctgctcttcagagtaagttgctactacaaccttcaccttccatgaatgcacattgcaaatctgcaagaacttcttatggcattgcaacagcctgcttttgaggccttggttctcccttgaactccacagacccctatccttcgcctcacacggtgatcatgacgggttctttcgtcgtgcatcccgccaataataccgcctttttgccttccattttgctcacatagcgtgtcaaaaacatatactaatgtgaaagtaaaagagtaacagctaacgatgtgtataagaagagagtagtatggctactttacagagcagtatgtatgcaagttcagttacatgtagcaaacaaaagcaaagaggcagtgtgcatgtgtgagagtattgttttggttttatttttatccttttccatttgcagaaaaggtgctccaaaaataaaaataaagcaggccgaccacgcatatttccctgtggccgatggctacctgcaacatggaaatgcaagggaagcagacaaatttattcagattctgccaattgtctatgcaattctttggtagaataagatggtcctggtttcgaatttttaatccttgcgctttatgctcttcagggaagtctttgaaacgcgtcgaatttcagaatccggtgcaagtactcatgaggatcgatgatgttgcgcgattcatatcgggctcaagaacatgttcctgacctgtttctgtttcaaatgcctatcaaaatgctactttgaatcagcttgaatcaacccaatgctgacccttattaacaataaacttttaacagtttttatttctgtttcaaaataaaggatttacatttcatcatgcaaacttcaccaaaatattgaatcctctaattaacaatgactgaatctaatctggggcttgcactgttcaagtactgatggagcaatgtgactgaacatgaacacagcagcctttgtctccaacacctccatatgagtgctaagcataaggcatcaccggccacatgggattaagaaacacacaagcaggttagtgcatgcataaaccccatttgcagcaggtcataatcagtattcaattgtgcacaagtacaattctgctgaggtgattaaaaagtgggcagagccttggtttctgcaagaaggaatcaaaaagattgttatttaattccagtaagccatatctcagcgtgatagatcatgtttgcagtgcccactatgctttggtaagatctgaaatttcatccactattaagatattcttatcttcgataagtaatagttttagccacatttagtgtgctttgaataatatcattcttctctttattccctggagaattattgttaagggagacctttattccatttcttgttcggccaattaatcaaattgtatatttaaaagtgtttattctggtgtaacctttgcatctccagataagatatttctgtgtcatgtctatgtacaataatcattttgtattaaaaaaactgttggctgatttacaagctgaaaatcagtcagctcagctaagaaaaacttaaattccctagcatcctagccttgtcaagtttctgaagagagatagttcttatctcaaccaccacggcatactactcaacttcactagtctcatgtataatgcatgaaccaacctttggacccaagtgacactatgatccaaaagattctgttttttttttgtgctcttctattttccatcctctgtgacatctacatctttaaaagttaacaataattgctaaatgcaaatcagaatcacttcaaagggttaatatataatggataaatatctgactaaattatttctctcttctccacaagcacacacaaacaaacacaaaacataaagaacttttttgacacaccaagtcatgctaaagtactattaagtaatgcagtgactctagtgcaattgagtacctgaagaactttcaagataccaacaggagaaccaaggtctatagttcttttctgtaggaagcattttttactatactactatatctacaagaaccagagttttccttctgcaatcaacacctacttactttatatatatatatatatatatatatatatatatatatatatatatatatatatatatgcacaaatatatacatatgtacatatcatgtagccggatcaaaacagaaatgtagttgtgtaatattcacttgaccaaagagaacaaatcttggcaacatatgtcatttaatacaagtgaaatcccaatcaattcaaaccaataatactcatatatttcaggatgtcactagacttgttagtccttgtactcacattcagagaacatcagctaaggtccccatcggttggtctagtcttattataagccataacggtttattagcgattaaaaaaatgatatgtgagtaaaacttttgtatatatattcttagtgattgaaaagccaaagttaaaaaaaaactatgttgaaaaaggatcaaattcaaattcaaaatcaagttttaaaattcaaattttggctttagcttataagccatagggcaaacgatgaggcccaaagctacatttctgcaggctctgaaacaatcaaaaccatcaagctcaactctcatctggatcgccggcgatggccgaccggagcaatggcggccggagacggagaaggagaatattcttggttggttcttggtgatatttgtttccctcttatgtatgcaatgcaatatgtgggtggtggagaggaaaggtggtggctgaggtgaggtgagaccaccttcttggcccttgattccctcccttttgcagcatgtcctctgcaatctccactggggtgagagctggctctactccatcaatgtagcaacctcccaggcaatgagtcaagcattgcagctagccaggtccattgcaccaattgcatctgcagatactgcactccactgcactgcagctgcagtggtccattccattccatttcactgcattcagtatgatgtagtgtaccctaagtatgtatagtgagactgtgtgtacatgaaccagttttttttctttagacaaagtaagtttttatttaacttagccaattacatcgaggaaatacaattgtactgagctaagcacggtctggtctctacataactaggatgcacacggtcaaaactcacgctcgcacccttacatgagctagttagcatggtgcattatgtgtatatatattttacaattgtcaatcacaagttgggagtggttggtgatctgttactccagttatacccactggaagatcagattcatgtgtggcagcagaatcaccaggaagcatgtggtttggtgggtaccaagatacatcatgtgagctggagccagatgaaaaaaaatgaatgaatgagggggtgtttagatggggctaaaactttttagcccatgtcacatcggatgtttggacgctaatttggagtattaaacctagactagtaaaaaaactaatttcataaatgagagctaatccgcgagacgaatttgaagtatttaagcctaattaatccataattatcaaaagtttactgtagcatcacattgttaaaatcatggcgtaattagactcaaaagattcgtctcgcgaatcagtccaaggttatggaatgagttttgtaattagtgtatgtttaatactctaaattagtgtccaaacatccgatgtgacaggacttggaataagtctctagaaagcagacaggcccgaatgaattgagctgaactgatgaaaaaaatctgtgtgctgctactgctgcctgtgaatgaatgagaggagctgagctacaagagttgtctgtcactgctaggctgctgctactgttggtgctgctgccattagttttcagagatgtgcaacagtgctggttggtacatgacaactagaaagtagtcttctagtacactcaaattcccaagaaaccaacagaaaaaagatgtagtagtggtagagaataggggggagaaaacaaagagggtaatttggagaatctctttctctctgcacaataaccatcagtactgtactgaacaaattctgagaaaaaaaaaaagaagagcaagcaagaaagaaaagaatactaagccagttaatacatttattcctgccataaaaagactggctgttgtcactcttattattcccactacctgtggaatattaacaagaatttcctgcagattgattgatttaatttactaccccaacatgtccatgagcatcacaaaaatgtagtactagttgcaacaatctgaggctagtagtaaagcaccaatataacattgcatctcaacacagtttagtaattcttaaaaaatataagaattactaaactgattaattcaaaagcaaacatacataccatgagtccatgagacagcagagagagagagagagagagtaatagtagtagtaattatatattgcacttccttgatttgttttgacagagaaacagaaagcttactgcctcattaatccttacatagttggagtacatgatgatgatgatgcatgcagaaggcttaacttaaccatcacttgatttaccaattacacaagataattaggccattaattagccctagcagctagcttagcttcgttaggtgcagtgcttagttgcttacccccagtggcaagtactgtaattttcttcatcttcttcttggtctctgccatggcagcttcagcttcagtgtttgagctagcaaagctggaacagctcgggggaggatctgaagaggtcgtcgaaggcggcggagtcgaaggcgaggagcgggtcggtggcggcggcgacggtgagggcggcggcggcggcggcggcggcgccgttggtgttgatgcaggagaggatgtcgttgagggaggcgaggcgcgcggcgagctcggcggcctgggtgcggaggacggcgttctcggcgtcgacggcgaggaggccctgggtggtgaggccgagcgcggtggcgacgtgcgcgttctcgcggcggaggtgcgccacctgcgcggtgaggtcgtcgaggtggcgctgcttccgcatccgcgaccgccgcgccgactccctgttcgacagcatcctcttcgcccgccgctgctccataagcgccctcagctcctcctccgccgccgacgacgacccccccgccgccgccgtcgccgccgacaccgcgctccccccgctcccgcttgacgatgccatcaatcaatcgatcgcaaagatttcgggagaagaagaacaacaagcaccactagattgctacaagcttagcagcagcagcagcagtgaagaacaagaagtgcatatactaaactgaaaccaaaatccaaaacgaacacgacgacgacgaagaacacacacagagatcgacaagaacgacgacgacgaacacgagatcgattattgtagaaggaagctagagagagaggaggagagggaaatggatggcgagtagcttatgagaagacatagaaccagtagaggaagacgacggagaaagactggacgagatgggtgcggcgccggagtgtggagttgatcataaaccccgagaggaggatctcactgatcacaggcgacatcgatcaggaactccagcacgaacggtataagcatgtgcctccctcctttcttccttccccctctctcactcgatcaacaagaacagcatgcaagaacaagaacaaagctctagctccctccctccctctccaatggcggctggggttataaagagcgaggaggctggctagcctagcaccggattcgatcggagcggtcggtggcaaaaggctagagctgagctagctactgccactgatcgatgcagcagcactgggcaagctgagccactggtgctagctacaactcgaggcgtctggatgtgtctcttgatgccaagtgccaagaagaggatggtggtggttgttggtagggaggaggagatgatcgaggagggggggtgtgggagcagcaacacgaggtggatttatagagaggacgcacccatctctctctctctttccagggcagtagagcaggggaggatgggaatcgcgccaacccgggaatgggaatgtaaaatactccctccatcccgataaaaaaaaacctacgatatgtagattcgtagtactagaacgtatcacattcaacagagagctgctacaaaacgggatcccgttgcaatgggatagacatattaactattctcttgcacgagtatcacaggtatcaggtcctagatatcacagataccgggtaacaggtatcacaggtatcaagtatcatgcagctggtatcacaataggtatcagatatcaggtactgtctcatagaagagtatcccgttccaacgaaataccgttgtctaggttttctgcatttaatactaggttggttttttataggacggaaagagtactattcaaaacggtatatttgtttaggtttttctctttacctaaggtcactttacgtacgagtgtctagaaaattaaaattagcgtggaatatatggtgtttatagagtaagcaatcttaaacacttgattttagatgtcatatagacatttgctaaatagtaaatggggaagaaattactgcaaatattgacatattgtattgagtcttgagagccgatatatatatatgagtacaagatttggttcttaagtaagtctagagatatagatgaaatataatcctatctagtataacaaacggatactatgatcatattcatatactccaattgttttaataatgtgaaagagatgaaagaggaggaaatgagccattcttcgtacagggataatctatacacaaacttcactaaaaacatgagagagtcttagagagttattgaggcttgtgtgttaacggcaacttattgtatatcttacaccttagtttatagcaatgataagggaacgaaaatataaatgcaccatggattatgaaatattcagaatggtactgatatatttgcatagtttttattttttcctttaaacgagttctcacgagtgtctagaaccgtagcattagtgtgaaatagtacgtgatatttagaatggtgtcattatctaatcgtcacttgccttcaagaacgggaggtggcattcaataacgactactgcacgaaaaattacggtcaatagaggttacctatgtggctatgcttatttgtatgtgtggatggagtacgtaccatccaagcttaaggggtctcttgctaattgatgagcttcctttgacgatgtgagtcgctaattaatatgtacgccatccaacattatatggtaatatgttgaactgattttttttaccaatatgatttgctaaataataggcgcatgctattgaactacaccatccatccccaaatataagtatttttaactatgaatctggacaaccgtgtgtctagattcatagccaaaagttgttatattttgggacggaggtagtaactactatcttcgttaaaaaaattatagctattttcggcaatacatctggataatttggaatggatatatataggagtgaataattccctcaccggtttttcaaagtaagttttaggttgaaacaagaaacatttatttgaaagtctaaatttatgagttgataacttaaatcctgaaactaggttgtgtttttttaatagggaactaggaggtgttggctgcttatgaaatgagcgttcgccattcatcacatatcaaagctccttgccaacaacaaagtagaacagtagtgcttcacttccactcctactctctcactcactcactacttgctttggaatcaaatcgaatcttcatcggatttcagaaaacaacaagacacacacaaaagaagaagattcaaagttgtctgaaaaaaaaaaagatatatacagggtaaattacttagcatgaaaaaagtagtaccactgtaggtccagtacaaattaattattaattaattaattaattaagtaaagagaggttagcttctagtgtttcaccattgatgctcgtgcgtgcgtgcaggggcgcacgtgcgggcctggccgatccaaggagatgctgtcatgctgctgagctgctctgatgcctccaggtggcttgcatgcatagttgcaaatgccagcttaacactgcagctagcttagctcccatcctgaaatgatatctacttccccaaaataattcaacacgaatctggacaagattcattgtactataatatgttacattctattctagattaagttattttgggactaagaaaatatttgacaggtcatgtttatttcgattcagattcaaatgtacgtactcacatattacaaaacacgaatacattttttttatgataaaagctttattgaattaacccaattacaccaagttgatatagccgtacctgaatacacatacacacttatttgcacgttccacctctgatttttcttcataatagaaaattgatttatgttttttcatatcagtttttctagccatttgcatatgcagctttcaagttcagtcttgcagtaactttcagagctagaatcaactgagcagacatttatatatatacatatatacatattcatggactgaactaagaatggatggataattcccgtccagataataacatcatcgagtggatcaggcagtagatgtagcttttatgttctttgctcctcacagaaattcagagtaaataaatgtccttttttttttcttcagtgaaaagttcagaaaaacacaagccgctcttacttcttattggctggagctctgtgctccattgtattgacccaatggccctacaaatcaacatgcatgcaagatgcaactccaggacaacatatttcacaatcatgaccctctccttgaatgagacagtatattctctacataactttctaatagttgatcttgaggttcagatttttttttagacataagtttagtacaatgaaaaaattttatgctactcaaaattctatatgatcatctgtttttcctatttcttaagtaaaaattagtccaagagccctggaattcactgaataatgatttgcattttagacctgaacaaatcaaacagggagtgaaaaatgaagtcaaaaacgaaattcagataattattgtgcagtgaattaactagtcagagaagattcctattggatatagatcagagatccagatagctctcaaaaaagaaaaatagaatcaagggagagagagagagagagagagatagagagatgcacaaaagctatcacagatcacagtgtgggtcatggggacatgaaagcagctgctacttgaagcagctaagctagcatgcatgctgttggacagacacacatatttatcgatccatctcgacttgattgataatttgatatgaacatgatcgccttagcttgtttctttctctcaaaaagaacacgatccttgttttcttttgggtttcaattaattcatttcctcctgaaaggctgcaacttttagaattaaaatctattaaaaaaaggatttgagggcttgaggcatcccatgcagtgatgctatcgcttttgctaagcaatatatatgcattttgctagctcttgtgttgtgtgcggttcatcacttcatcatcataatgagatagattcagagacattcagagattcagtgatgcacatcacagcacagcgttcggtctccatgctgccatgttggagccaaaagtgtgcatcatttttttaaaattatttttgtgatgaaaaagtgtacattattttgctgcagtgtagtgtagctagccttaccctgcccataccttagaattcatcaggccattgccggccgatttctctggaactgaaaaaaggttggttgcttgtgccttagctttgcagagcacatatctttacgtgctcttttactttgtataccacgaattaacactaaaagttatgcaaccttcctataggagctaggtggaaaatgagctcgtttcgctagctcggtgtctctgttcaaaattgctcgattgatctgtttttttcttataaatttaaaattattcaactttaaaataaagttggtatcactctacctcagttcattggcctgttaaccaaaaaaaacacacacctcagacgatagagaaaaaaatataataaattaattttgaataaatctcaataaaaagcataaccacctcagtgtgacagcgtccacccatactcaagtcccttactacacctaagaagaccgtaaaactgtaagtgaataatataaccttttcttttatccaatggcagggacaggggacggccagtggcatgtctcctccaacattttttcacacataatcacctaactaattaggtaattaacttaaatagtagtgtattatgtatccctaagactcttagacctcctctctcatgtttaaatcctgcctccgccactgtttttatctcatgacccatatatccataccaagtgagatgatcagtaattaaggtaaaaaaatgtagacagggtattacattatttatctctactttcatggcagatactatagtagtagattgtctggttactttggtagtacgacaagatatggaggagagaggggaaaaaaaaagaaaagaaaaatgtagaggtaatggaggtgcgtgcatgaagagatcaggcaggcatggcattgggtgcattgggggagatggcttctttcgcgccgacttccttgcacatgcgagtgttgcctagtcttgtgttgtgtagtgcgtattcagatccagctttgctcttgttcccacgggagagctgtcgatctttcacaaattcacaaagtgtcctttccttcataccataggttaaattggccaatggcaatagatcgacagtagttaatatttttggcaggttaaagcaccgctaaaagtaaaggttttcctttggtacttatgttggaaagtaattattttaactaaggataacctagctaagagaaaatggaaatatagtaaaaaaatattgcttttgtcataaggacaaaaccattcaacatttgttcttccattatcatttatcttgtttggtatggtatgttcatatggcctctaacttataacttattcgaaatgttactcatatgtttgggcgttggctttcatgtgttcctaaggaaataagaaatatgtttttgatgggtgcagcagctagctctttgttggtccatttggctaagcagaaacggagttattttttataataagttggtgtattctcctttgtagtttatcactttagttacccagtggttacgcacctgggctatcctccacaaaccggtattttggggtactactgcggtggtatcacgatgtttggaccaggtggcatgggattttttttactaagaacatgggtgatgatctagtatacggattaatagccactaatttctatgtttcgtgatgggggtttagtttcgtccttttattggttgtgtgcattttatataaaggttgggggtaggcttagttgctatgtcttaacttttaagacaacttttgattgctaaaagttcttgtattttgtaacggatggagtaattcggatatgtcttcaccacgtatttggatctacacttatgcatggagagagtgtttttctagatttcaactctaaaatatttttgtggatcaagtggaggaggttgtgaagcagggccaaaaggcaggtgtgttttcagctccgctctaggccctgctccactacatatttgtttctaaatcacttcacgtttggttcagctccaccttcttcataagaggatttgagaattgagatatatacctatctagctagtggataaattaaagatccagaatatcatcatagattcatacactaattgtcagttaaactgtccttcttgcagatatggcccaaagtatacatagtacagtatagtagtggccatacataattcatggctctcgtgatcctagagagctcgatcagagaatcactttatggtgacagattgagacttataaatcatcatatcgtcaggctaagcaagctagctattttgatacatacatgcatgtacatagctgcgtatatatgcggtggttaaggtgcatacaaacagtgtgcaccgttcaaaagatccggctactgcatgccactatagctcgatcatcaggaatagtgagtggtagggacgatttagtttagggtttgatgcatcattatatctaatgtaagctagatatatgatagggtttttgtttggcattgtagctcatgatcagtgtgtgaagaggtacatgatgtatagtggtccttgaaaagaaattattggggttgtggaatactatcaatgcatggccctgtttaagtgggaatattaaaagtttatagggagtgtctagatttcatatatgtctcatcccttggatgatatccagtggttttcaacttttcatcattccccctattactcatccaaaggtagtcatgtctttcttattatatagataaaaggttgaacaacatatatccaattgttttcatcatttcccctattaattaatcattcaaacaaagtcatttattccttagataaaaggtcaaacaacaattattctaacctaaacatgaaataaattttcaattcataaaaattacaaagttatatgtaaaagtattcaaccgataaaactaaagtaaaaccatatataagcaataacatatatacacagttcatacaaagtaaaaattgtacattacatacattgtaattttagagttagcaatatgcaattttaggtgactaaaaatacaaaatttcagatgtcttgaatattaatctagcaaatactaatacctctccaccaatccttatgcaatactctctccgtcctataaaaagaaaatcaaattctagctaagaatttagacacccatattttcaagtttaaaactaggattagtttttttttagctagagggtgtaatctatttctacaccttaagagatattattgcacaataattctttttagagggattgcacagtacttcctctgtttcacaatataagtcattctagcatttctcacattcatagtaatgtcaatgaatgtagacatatatatctatctagattcattaatatcaatatgaatatgagaaatattaaaatgacttacattgtgaaacggaggaagtatgtgtaacttcagtaaatgatggcgtgctagacttgaagccttgaatgctaatgttctggaatgttccacggctcaaataaggcctatgacaaagacaagtcggttcattgaacctgccagtatatttgtcaggcctagctaagctagcttccggccggttcagtggtgtgcgatccctgacaagcgtggctgacccggatgcatcagcgccacatttttctctctttctggatgcatatgggttcacttttttctgtttatatgtttttttcaactggatcagatggatgaaattaaatccaagttggatatatctcttgtggtggccaataaccatatgagaaaattttcacatacagaacagacatagatattttgattcctcacggaaaaggagaatttggttgttgttgttagcatcgatattgtgcgcattggtatcttttctagcacaacattagaccctgtttgagacaaaagttttcaatgactacaaaatgtgagccgtccatcagaattcatgtaatctctccgttacactatattaagtcgtttgacttttttcctaatcaaacttcttaaagtttaattaagtttatagaaaaatacggtagtatacaatcaaacttttatatatatatatatatatatatatatatatatatatatatatatatatatatatatatatatatatatgagttggatttttttgcatgcgagttcacatgtacccacaatctacatcctatatgtatcttgcacgaatcttagggcaagtatattaggttctaacaaaatgtaacatgcatgatatttacgttatactatattttttacaagtgtaaaataccttgtttatataatttttgtatttcttgtatgcaaaacttgtttatgtagtttaccttgtttatataaattatcttgtttatgtagtttttgatggtaggatatatatcattttggaaatattatttttgcaaaatgacaatttggtgatatagtagatatattgttttctcattttgactaaatatcatgttataaacaaaataaggattagagaaatacaatgcactagatatataaatgtcatatatgattattattgaaaaatttatttggtaaaaaatgcaacatacatgttatacatattgtgaaccaacctaatcctaattatcttttctccctatagtaagcattcatttggttaaggttaggtacattttgcagcacgaatcttggaacacatcaacggtgtagattgtagttacatatgaacccgagtgcaaatctgcattttcatatatatatatatatgtgtatatatatatatatgtatatatatatgtgtgtgtgtgtgtgtgtgtgtgtgtgtgtgtgttgtgtgtgtgttgtgtgtgtgtgtgtgtgtgtatatatatatatatacatatgtatatatatatatatatatgtatatatatatgtatgtatgtatgtatgtatgtatgtatgtatgtatgtatgtatgtatgtatgtatgtatgtatgtatgtatgtatgtatgtatgtatgtatgtattatcatactctattcaatggtagatttaatggaactaatttgatatttcatatggtgctaaacttttttataaacttgatcaaacttaacaaagattgactaggaaaaaagacaaacgacttataatatgaaacagaaggagtattccaaataagctgttaatctatatatagagagaccaaatcggataaaatagaaatgacataaggaaaggtaaatctttatcctatatattgttggctacatgcacctctatattttgatacttgttatttccaatcagatctcaatggttcatcaaggtgtccaaatgaatggcacacaatgcatatagctagacatatagtagctctagctatacttttggtgatgaaatatgtggagagaggccggtgcatgaagctgcccagaggtgtctaggcttgctcatatgaagcaccatcaccttgagatcctggagatgatttgatcactcaagctagctagctttgccctgttgctatcctgttaatatgtgtgtgtgaccactggagcaatgaggtgacaccactaggttagataagctacccaagcatcaatgttgatgtgtgcatggctgcttctttcttagtacccaaggcataattgcaccacaagctggtagctaggaaggaaccctagcttattggcttagttgtggctgtagtaggagttttgtggtgcagtgcaagctcctaaaggacatgacaactgcatgcatgcatggacctaccacacccaaatgaaccattgcaagttgcttaccatgcagggattatacatttgtggtgcatagcttgttacatggacttcttgtccccatgtgcaggattttaaaggcattgaataaatcgacgggttatcaatatgcagaataatactacaactataaatattataagttttgatcataattttaaaagtttaatcgaatcttgtcataaacatcaaataactatgacgggataattttttaaaagaaagaaaaatgaaatctctgaatcgggtataattaaaatacagctgatcatggatgagaatgtgctagctgaattccttttgatccaggccctcacatatctctggtcaccaacttggctgctcttgtgggggagtatatttgtgtggttggggcaaggtccattaccccacagttgcattgcaaacaagctaaggggtgagaaatatctaagctacattatgcatatgtgcttggggttgttgtagggtatgaaccacatggcaaaaggagaatctcctcccccttctcctaccaaagattcaaggcttgaggggtaaaaaggaagttgtgtgtgtgtgtgtgtggttgtgcacctttgggggagtgaagctaagtggcatggcatattgggttgcatatgcatgcatgcatgcttgctagttagtggcctgctgatccttagtcctgtgtgctctgtgcatccaatgtttgtgcatgcatatgcttctatcctggtttctggttttgcacctaacatgtattccttacactaatagccttgcggcttggagctgaacatatattgcatcaagaatttttcttattttggctaattattcttttcagtggtagggatatatatatatatatatatatatatatatatatatatatccattatcataaacgtaaaaaacaagcccactctcttagagatgcttacagaagtaagatatgtgtattgtatgattttattatagggctaagtgttcacacgtatatattagcttgtgcgtttatactctatttcgagaaaagggttttctatatgtttaaacttttcttaatatgactataagaataaaccctcttttggaaacttatgtttacatattcaccttatttctcattttgatttacttttatcttactttttattactattaaacttatggttgtgtgtcttatgacaaaagccaaaagatgtaatccatttccattatctaaaagaaaatgtttacatatgaactttttagctaccctgtttctgtggcaggacaacgttgtcacattggtacaaaaggtgttcttatctgtattcaatacactagtctaattaagtacaccaaattaatttgcaagtaatggtacaccagctaaccaacttgaagagattgtgtcacccggccgtatgtacaaaactctaacatgtcaaaaatataaaacacaaattgactagatatcgtgccccagtacgtccataaaaacataaagttctttatagcaaacaccacagaaatgctgggcttcctttacgaggttaaaagctcgcttgagactggaatatatagtacgtgccagggctgataggacggcttaactattttgataacctctcaaagttccaatgtttctttatttttttctgtaaaggaaaaaggtgcgcaaccaaataataataataataatagcttgactacaaataataaaattaattaaagcacctgtgatggagaccaagagcatgacttgggtatatgccaaaccgtcttgtaagttaagcctgttggttccatattcttttttaattggggacacaaatgagccgctcgttttctgcatatcttaggctttccatggctttgcatatcttcaactagacaatataatgtactatccataaagcaaaaattggatcattacagcctcgtctcttatttgcatggaccattcatcttatctagttagtgtgtggggtgtgcgctcctttcttgcttgctttctctagggccagcgtacaattttcatgaaccatttccattgttaggttcctgtcagaaccttacatggtataggaaagaaaaagtatggagaaaaggaaaaaaaatacagggttgttttcttcctctttggttctgagctatccaaacatattagcacgttttaaggtaataaaatggcagtgcccaatatctgttagtgaaaggaactgatcataagccatcatatattcagctatgcaacccgttttgcaattgcataccatgaattagatgacaagatcaaaagacaatcttcaccataaccattgtacctgtaatcaaaggcataccccaataaagaaaaactagaacacaaatcataacttctacaacaatgctggttttagtaatgacttgagctgtaacaggtgcaaaaatgtgtggctgttacctatctggttaagatattatcctgtgatatcttggttgcaggctgaggagtacaactattctgccctaccaatctcaatctctcccctcactccactcccaaaatcaaacagggcagatctttttcctggttggtgaggctgtggggcagtgattgtttcactgtgaccaaaccctagccttgtggtcacatgggaagcactatgagcagagaggctggctagctaggtcttggccattaagccaagtgggggctgcaatgcaattgcaatgcagggagtggtggccagtggtcacaccaaaggcctcaaatgtggccagtggtctcgccgtctttcggtgacggctcccatgtatgattgcttgtttcaagccagaaacagaaacacatgtagctccttgaagcgggtgcaggtaattccaggcaccaaactagaggcaatgttcaggaaaagtctgtctattatcaagggccagtatgtgcctcttcagcttcatttcgaaacacctcggttcctgaagcagcaggcttacaggtgctcccagcctataaaagagcatttgaacagtaatgagaaattccagaaaagaaaagggaaatcataatatagatattgatgttatccatcgtcccacagaacttcaaaagactaaactcgatctacacattgacaaaaattattcttctgatgaggaaatctaaaaataacagtgaaatttatctttttcctctttgtccttgtatataagtcatgttttcagttgaaatttatgagatgatggatgattctcacactaaatttttaaagttttaccaaaataaaatcatgactgtttgcatgttctttcataggacgggagtgcctgaaactatcccaacagtataacaaaatgtgacatacaggatatttcacgaaaatttccatcatgcagtttctattaatgttggactcatctgatcattattccttaatgaagacatctaacaggatgagttttcctagaggtaacaaattggtttcagtatattttattataacagaagtggcaaatttaatgagtttcttataccttggaagcagctctctttattgaactggacctactggcagaaggtagcttaagattctggctgcagtatgccatttgacaagaatctattatgtaacgcacatgaacatcttcctttggtatcttccgcagcaacttcttagtcgccttcttcttctgggacaacaaaagagcctgatacatcctgcaggcacaaatgcagtatatctactaaatgccacaataaaaggaatttgacaaggttgcaaagcaagcacactggtcaaggtatcgaattgcccaacaaaagcaagccaacattgtaaaatgtactggataatcagcttatgtgccaataggaagaatctaacctcaaggaagtcagtacattatgtggaaggcctgcagattcatattctgtccatatcagctgggcacgatttgaatcctttgcctttacacaagcactaagaagaaagtcaaggcttgtccgagaaacattaagcccaagctctttcacagcatggagaatcttcattccaaaatccaaatttacaggatccatatcccatatttgactgaagaccttgaaaaccattcatgaaagtaaacaagaggtaccaaaacaaagaaagcatggaaaaggtatagttcatggcgaaatgtcttgaggaacaattcatatacacctttatgaggaacaattcgaaggagtttgaacagtaaaaaattaataaaagcaattagatatttgtaatcaaaatcaagtttggtttctcatcatgtcaccctaattaaactgaaatgaatttatgaactagttaacagaataataagcgagatcatatagcatatttcctaaagataagaccataaccaagtagtaaaaaaaacgtggataacattagaacaaacaggatatccaatgtacccttaatcaaaaggaatttgccagccaaaaggtatagattctagtcaaaatcagtgccccccccccccccaaaaaaaaaaaaaaaggaaatcaaatgttcatgtgctatcctatccaagaataacaatcaatacctgatcaataaccatatatgtactcaattcatctttctccttaagctgcttaagcaaaccaatggcagcactggaaaagatgatgaaaataaagagtgaatgaaaaataaaaagtaaacagaagtataaatacaagtgcttaaatatcgattagcatacttagggtgattgtgctgaacacagtacagaagtactctactgcacccgtcaaaccacatgtttgagtcaccaagctcttccagaagttgatacagtctatccagctcaccttttgtttgggtattctcctgcagaaaaaaaaatactattaaggatggagactagaacaagtggttctcaaacgtgtaggcacaacccatttcttcattagaagtaaacatacgtaacagttttacttacaatcagggctattgctgattttggctcaaggtggcatccagattgcttgatttcatcatacatgataagtccatctaataccttcccatttgatgcaagagctcctataagcgcactcttaatttcattgaggtacttaggtggtatttccttgttttcgagaacctaagaaagcagcaaaggttttcagtagcaaaatagaacaagtacaacattagcatcttcgtagtaataataatagccattaacttatgtaatctaattcagaaaacacgagtacatgtgtgagatctggcacctgaaggtgcagcaaaattcaaagagaattatgatcggcaagcacattacctgtttagccatgtcaaaattcccaagtcttgcatatgcactaactagtgacatatatatatgcttggacatgtgtattccatcttgccgtaattgatcaagatactgtaaacaattcaacagccagtgcttatcccaacagaaactataaattgaaaggggtttaaaacatgaaattctaatgtcagtgtaaactatggtaaagaatcatgccaattgttcaatagtatatggcgttttagacattggcaaaccctccaatatgcaacttcaaaaattactttaaataagtgtattagtaaaaaaaaattaagatttatatgacaactctaattgcaccatttctgaaattccacatgaccaatctaaatatttttttacacaatgatggtcaaagataaagaagtttgactacgcgtcttttaaaatgtcagataattcctccattttcctttacttgtcacagttgaccataattttgtgtctgagaatacttggcactatacatttgtcacagtggcattccctattttgtcctttgaggaccaatcataaatttaacaatatgacattgatacaagtaatcagaaatatctagagtgttctttcaaagtttcgattatacataacgaaaacatattccactcacctaggagctttggttattttaggagataaaagttgattgcattgatatgtgtaccatagtcaacaatgagacaattaaacagaaaaggagggagcatttccgaacagagtaggcatgttagtatgtaatggaagatgcgacatgctgcatgatgatatatccaacagaatttaacaatgcaaatagaattaattacttggggatataatttcactaggtgttctttcaagaacatatacagttgcctctctatttgaaacacacacaaaaatggtaataataaacaatcaggtatgtgacaaacctcagagattttctcttcgaactcacagttaaatatcaaataacagtatgtttcagaatctggttttactccggcaatctgcatttgcgccatgaccatctgtgctccattgtggtttttctatatagaaacatagcgaatttaaagggagaaaggcactaaggcacaaacaatctggaataatagtctttaaatcttactacagtatgtaaatatggtcttttgctaataataaaaaaatcataactactgggtaagtccagcagtgtttcccctcaaaaaaaattttgaaatttcatgccgttttcatactgaatagttacagtggttgcttattcgaaactgttgcgcatttgtacttgagggaagaggtttggaaaatctcaacaaaaaaaaacaagcatgtgtcatctcttatgtgtttatgcatttctactgaccaggcatgatgtaaaatcgagtcagctaaagttgagcaagtatgctgacaatagttaataggagatccatcattttttgaataattaaaatggacatatggattgtatggtaactgaggaaaacaaatcaaaagaacaacagataacccgagagtttacctctctgaaatatccaagcatgatagcattatacaggcttacagtggatatatccccagactcttctgcatctgtgagtatacggtaagcaccttcaaactggggagaaaaaggatcagtaaatttcatatgatgcctaaacatagcaggtgacctgcataatgacttacatctttcatctttacacataaatttatcatgtttctgaatgtttcggttttcaatttcatcttgtggcgacgcatcaaatcatatattggatgaacctgaaaaggttagagtgaatacagatgcttagcattgttcccaataagacatatcacatgagaacatgtatagttaatttttaaaatagatgctacctgtgagaccagcaacagtagttcatatatcttatgacttatgatgcgtggcagagacttcctcacaatcaattttatgctttaacaactcaaacaaatgtaaataacagcttattaagatcactagttagttattacattacaacaatgttaacgattgtactagtgctttaataggttgggatgtgttcatactagaaaaggtcatgttctacaagatgcttatgttgttactaaaaacatatgcagtcatgcacaaaaccatacaaagcacttaaatgttgcaaattcttataacctataataccccctaataattaatataaaatgaacacacatctgcactgcaagccacaactaaatatagtcatatagaactgcttaccaagtgaaattcagagccttgttcacaggcctgtattattggatgaaacaattcaactggcatatcggggttggatttacataagcactcagctacatcaagagctaagctgatctgcataaaacattagggaacacagcgcggttataatattgatttgagtggcccagattgataaatccaaacacttcacattgaaactaagattgttgtaccaaaatatgtgtatcacatacaatattgaggcctatttggtttgtaaaaaactttgctataactaattttgggcaacaaaattcacagccatggctgtagaaaaagttaagtgacaatctgagtctatggcatgcatatggcaaagttcaatcacagaaatgagcaagatatttgcctaacaaactgtaccacgcctaaggtttcatagcaaggttactaggttaggcttcaaactaaactccaagctctttgctacacttcagtggtggctacccaaatggtggccacaagttcagcacacatcagccaatatccattaataaaccattccaagtgaccacacatttccactgcatccaaatttaaataagcatttcttcccaacacctaggtggtggtagaagaattttaaataaaaaaaactaccggtggactgatagctacttgaaataatagaccagataggtatgttaggctgttaggcatgacatggactctttaaacgtaaagccggttaagtacccaggccagcagaaaccaaacaacacaaagcaaaaggtatgtatggacatggcatacataaaaaagatcatatattgtttggggaccaaatttctaaaaacatgtattgaattacttaaccattttttttaaaaaaaaagtaccggtggatttgacttacctttgacgatttgcaacaaacagagatgatcttctcagatgcagaaatagagggtgctacctcaaactgctcatgccatctattgaatgatactataacatcttcaaccttcaagaaaatccatttccagtgttcttatcattctgtttagctaaaagggcgctgttaacatgataactaactgcactggttcagatagttatattttttaaataatgtcattcttagattgaacaccacagtttttgtaagcaagtcacgaaaactaagataccccctccatccaaaagtctaagacctatttctttttgcaccaagaccaatgagtaattaattcattcatcatgtgacaaaatcaatgaacatgcaaccaataagtactaaaatggcttcttgggctccgctcaaaaatttaatatagcacatagtgactacaaatatgacttagacttttggaaaagccaaagaatggaataggtcttagacttttggatggagggagtagtatatcagcaaataaacctttccatccacttgggatcaaataaaatgtggtcatattagcaatttgatgaaacatgatttatctttcgatgtacgaataaaaaaaaatggattgtctattcttttgaatcacacagaaataaatttataaattttctatgctagtttagcccaaagcaccatgttttttagccacacaatgtgcattatggaaatgcagaatacttctttcgcacagaataaaaatataatagcaaaattgggtgtgctctctaaagtactgtattacatattccttttttttttaacatcttgctataagaccatttttgcacaggattgaagaacgctacacgtaaagtccactccaagttcatactataattagcggctacgaatattaccagtagtcatcgtaaaagattcctcaccgctatgtttggtatatttgaagcatactcaaatattatcgatgaaaattttccaacaccagattctgaaacagaaacattagcaggtaagaaacgtaacagagggaaatctgatggggtaactgaataacattagaatagaaatatttgtggccaatattcatcatatgtccatcttatttccagcaaatggatatttaaattttttggcaaaacgacagagttattacctttcgacctcatctgctgaagaagcttctcagcatagttcttcaattctaacctacccaaagactggaatatggtcaataagtactttgagcgtaaaattcttgttggatcaagtgactcaagcaagctgatgaaatccagcctcctgtcgctttcagcaaaggccagcatataactttctgtaaagcagtatcttgaataaggtacagttggaagaatgttctgtgtgtcgaataaattgtgcaacattaaacagcgcttttcccatttgtgaatgagtgacaaaggaagattggttgtgattttggttagttacctgccatatcatagtcaccttcttcattgaagtcttcaacagagcggcaaagttcttgaatcttttcttcatcttgagctctaatccataacaacatctcgtaataagctattctcgagctggaccgtggatttgcatccttaaagaacacactgaacatatcaaactcctctgacatccctacatccaccagatacagaaggaatggtccataacaatcttccacaatctgataacccctttctctcatcagctcaaagaggcgatatgccctataaatatgctccactgctgagtcaatatccatgcattcctttgccttgcccaaacaaatcctgatcaaagcattaaactccttagccccagtatccctccccagcttcccaaagaattcaagcgcgggctctgctccaagcttatcggcacacttctgcatcaacctggtgaagcggcggctctctgtgttcttgaatatgtaccgtttcttcttctcccttgccacctccttccgccaggccgccagtgggttgctaggtggtggcgccgcaaaccactccgtgtccagtatcctgttcacgacagactcttcggcatcttcagactcctccggtggcgcttgcgcccccctcaattcttctgcatcatcaggtcctaaacattgaacaagtatatcacgattacaccattagtttccactttggccatcgcaaaatgaccatgagatagtgtcagactgaagtttgatgataccatttaagatggacaggatctccttggtgaaaccgccggaagggttctcgtcctccacagcggctacatctgagcaacacaatcgacaggagtaagcgagaagcgaatgggggaagcggaggagagcagtggtgccggttaccttgggcgtcggggagggtggagggcaggttggtcctcttcgaggaggcggcctgcttgaggcggaggagggcggcgggggagaccgcggtggccggcgtgacggccttgcggcggctggaggaagggtttttccgcgtggcgagctgcgggccagttgcggcggtagcggtagcggcggcggcggccttcttcgtcgtctccagaactctcttccacatcggcggcggcgcgcgcgggggcggcggtcggagcagccgccggcggcggcggggagcagtggtgtggtccgcgccgccgcggcgaaacgaaggaggggattgcggttcggtgtcgtgggctgggccgcacccgagaaacggcccgaaaatagcgcgaggcgaagcaccaggaacttgtttgtaaaaacaaaaaaacgaaggggcgcaaaagaaattacgtgaacagtaacaataaaattgtcgatgcattaaatttagggaccacctatacatttatcgacaatttttctcctaaaaatttgacagatgtaattatagtacaatcgtagtgtaattatacggtaacttgcatgtaactacaatgtaacttgtatgtaagtttcacataattttgaatcgttagatctattacaatatttgttctggtgaggaaaaaaatcacagcacacacatgtgaaatgatttgttcccacgacctccattttaccgaaataacatgttacggagagatttttaaaaattacatacaagttacattatagttacagtgtaattacatgtaagttacaatgtaattacactacgattatactgtaattacatctgttaaatttttaggataaaatttattgacaaatatatagaaaaattgttaaatttattatttctcttataattataattaagcataactagtggcaaggtaaattgcaaacttaaaagtgataagggaaaaaacttaataggtgcgtacaattagatgtaaaagtaaaagctcaaaaattgaacgtaacattccaatatcttgactaggtgaatgcaactgtggttcaaaagaattttttgccacaccattgaccaacctagaagaaaatgccacatcagctatgtcccctttcacacatagtgttaattttacaaaatcatccagctctcattcttactagcttggaatttttttttcctcctttgggatgaatcaataggtgcggtggatttctcacaaatcaaagatgacacgaccataactaccgtcagaacttgggactcgaacgtcgatggatccttataaggacgggcgattgggggtcacacctgttgttagtactcaaagtgagtggcggcgtgacttgaatccgatgtagcacctcgtggcagcgaccgacctcttccgtggctctgtgccgacgggagaaaaaccttaaaatcgctcggcggtgtaggttccctagtttgatactagcatttgttagtacaactacttgcatgacgtgggttggaaggggcagaatcggatcgatggcggcgacaaccttcgttagggggcttggcggcgggggtggcagcgtggacgaggaacgagaagggagcgatagacttgcggcagcttggagcgctgggggtgttgagtaggaagtaagtgagagaagttgttttggagagaacaagagaagtgggcggaggaacaacaacgaacacacgcggaataatgcgatggagcgctatccaaaggactctaaaccattaattgtgtggaaggatccatggatggacttcaaaccttcgatcgtttaggacccaccaccatcactacaatttttttaagtagtataatgaattgatgataaatataatattgaatatattttgataatatgtttgttaattttatgtttgagatattgtggtatttttctataaacttagtcaaatttaaaaagttttaataactaggaaaaaaagtcaaaaataacttaatacctctctatataaaacagaggaaatagttagactaggaagtactgatcatagtatcagtagctagtaacgacgtgtttgtactcaacagaactgtagatagggctcgccgtccggcgggaggtccggcgtgcaagattccaccctgacgaggctctcccggtaggcatgaaaccaacaattggtgtgcccgaaatgtccacagtgtctcggaacaatagtgcgacggtgcgacccaccaccctcctgtccttgttggtgtcgtcgtacagcaacttccaagcccaggtcaccaccaccatctgcacgccgccgccgccggactcgaacgtcgcgacggcgttcttccagctgcccttgctccagtaggcgagtggcgcgggcggcggaggcatctccacccgcagccgccgcacccacctctcatcctcgtccaaggcccagacgtcgaggtgcagctcggtcatcgtccacacggccggcgtgccgtgcatgtcgatcatgtcgaccagttcgtcctcggcgaggctcaccggaggcggcggcagcaggcggaacgcctccgacaccgtgtcgaacgacgatatctgtggcttgccgttctgcaggtaacgggggcggcaccagtacacggtgtcgccgatggtctcgccgacgaacatggtgcagcggtggtagtcagggccgccgccgagctgccgtggctcggcggcgccggtggagaggatgtaggtggtattatctaggagtgggcggtggcacagcacgcggtactcgccggacggccggtggaagtagaagcccagtgtccgcagctcgttatcctttggccgcgacgacggctcagggctcaccggattgacgagctgccgcgtcgccgggttgcagatgagcatgccccccttctgcactcttctgaacatcaggaggccgtcgcaggtagtcaccaggctcaagcagaatctgccgcgttgaagcaaacgccggcagccggcgatgtcgccgccgtcgtcgatgcgtggaacagccgtggctgggagggaggtcaaggtgtagacggaggtaaagtgatcgctggggtccgtgtggccgaggagctgaagcgggcggcggcgggagtaggcggtgatgaagtagtgggcggtggtgatgcggcgccaggtccggcagacggcgcgggagcggaggacggccttcgccggcaaccgcaggaggatctcgctcaccacgtcgtcgttcatcgcggcgcgagctaggcgatcgttcggcttaggtttgccccggttgctacatatatacatggtgtacgttaaaatactgattcatatgtcacctagtgccgatcaaatttgtatgtcgagtttgacatggtgtgagcgaataatccgcttcgaattaggggcttctttaatttcgatgggatttcaaactgtcctgtatttactatatatgttagagtttgggaagtggaattttgtccctcgagtcgatgggacatccccttattttatacatgtcattcaaaaagttataaaaaacattatcaagatagatcaatatatgatatttctttttcaaacatgcgagttaaaatttgatttatataatttgaaacaaaaataataagattgaccgcttgtcgacgtttgatgtcgtgattccggtatttgcatagaatagggatcattagtactaggatatatgtgagattgtaataaaagagatggggacgaggatttttatacaggtccgagcccctgaattgtcaagtaataatcctatttctgttggccaaagccggtcgttactcttattcaccataatcacaccagtacaatatttgaggtagcctatttaactgtggtcgacttggcggtctgaagtgctgactcgtagttgacaacaaggtagacggggtcgacgagagcgagcaggcggcgagagcgagcgatggcaagcgacgaggccggagctgaggcgacaggtgggagggcaggcgagggctggagctgcacctgcgctgggcggcgaaggaagcggcggagacggggtcgacgagaccggtgccgacgccatctcgcccccgctctcatcctcctctgctccactgattcgtagcggcggcgcgcaatgaggatggagggaccaacgcagaggcgggaatagggagtcggatgatgaccgacgattctcctcaagctcaacctcgtttgcgtgtccccgtcgttgctgagccggagaggccggatccacgagcgcaacgttggagtagtcgctgcgatcatccatggacactcgcctccgcttctctgtcgcctctctactcctgctcatcttgctcagctccaactgctgctgcgcaagtgcgatgcgggtgggcaatgcgaaaagcaatagacacgatcgccatgcccgtcgacccattcacgcacgtacgctgtctatagcttcttgctcttgtatttgttcctcttggtgatggatctcccatgttgttgctgatactcgtggattggattggttgcagggcaccggccgagctcctcttcaacagctactcatcagcgcctcatcgcgaggatggatcggatgcgggtgcgggtgcgggcggtggcgggctctaggtcgtcggagagagaggccgcaaccccggccgccgcgacttgttccgctgcaccccgatgccaccggccgccgccgctgccaacgaagaaagagagaatataggaggggaatcactaacaggtgggccccactttatttttttaatttatttgatgactatgatgccacgtagacgccatgtcagcgaaaccgtcctccaaaaccgtcaagggagttaaattgcaccggttttaagagtttgggatcgagatatccggttttgtggtttagggtcacggattaaatttcgatcacttttgagggttacaaagtgaacctattccttctatttttagcggatcaaagaatagttgattctatagatggccatatggcccgaggcccacggcccggcacgaagcccgcaattttggcccggcccaagcacagcccggcccgactagggtcgtgcccgtgccggcccggcccgacagccgggccgtgcctgggctgcaccctcggcacggtgggccggcccggcacggcccgatcaaataaaaaaatacagggacgaaaaatagacttatataatcgtataaggcatggcccaagacaataggtatacaaaatagacttactatccagccatttaaacacagcccacaaagttgaggaaccaaaaatagacttatttccagccatttaaacacagccacagagttgagggaccaaatatagactttttctgtgaggcagcacaatagcccatcataccttctggccggcccggcacggcccgagtggtattgggccgtgcctgggccgtgtatgccgcccgtgggctggcacggcacggcccggtgcgtcggtcgagccgtgccggcccgacaagcctcggcccaggcacggccgggcttgggccgtgccgtgccaggcggcccagatggccatctatagttgattcaagtgtggttatctaaagctacacgtggccttcactcagctacactaacttctctatccaatctagtcgtcatttagaactggagaaacaccttcactcagctagtcagctgcaccagctccatccaactatccaatctagtcgccatctagaactagcaacagtcctctcagccttcactcagctacatcagcttcatccaactgcatcgaagaaaatacaccagctccatccaactatatatccaatctagtcgccatctagaactagcagtaacactcctattagccttcactcagctacatcagctccatccaactgcatcgaagaaaaggagaagtgttaatgactaccattgtgatgacaaatctatatattttttctatatatttgtacccactaactcgtaaagttcaacatgtaagtgtgccacatcatcatccactagcaattattatctcgaatattttacatctcatgcaaatatgacatatcatttgtaattttgttgtatttttagaagttaacatgcaagcaatgtcaaatcaccatctacacatcatttttatattatctaaatatatacatatattatttttataacatataacatgcattcttccatataaagtgtgccatgtttagtgacaaatataagtaagggggtcaccttacaaagcctcagcttgccttcttggatgactgctaattggcctggcgttgttctactccattgagcataaagacatcttgcagcggttgcctcgctaattacctgtaaacggactgactattaatcgtgcaatccaacagttgtgtttgcaacactaagtaggtactcctaaagataatggattcgggagaaccttgttagttttcttgttccagaccaaaatcttgttgttcttggtacacgcaagcagtaagttgggattgtgtgggcaccaagacatagcaacgatacctagcacatatagtaacatgatgttacaatccactactacatacactagcgagtcaaattaagagactaccagcaaagattgtaacatgatggtacagcataaataaaaccgagtaacacggactaccttctgagttactgaaggggatttcaccagcaggattatgatccgtgtttcccatgttcaaaatctgaaacagattaaattatccagttaaattaattatacttgctcaagtttagttaacaagttgatgttcctgtctttccaagcatattcatatgcaacggaaaaaaacagaaaattacctttacagacggtgaatcttcccgtgcaaccagcaacttttctgaatcaggatcaggacaaaagatcacagttgatccgctcttagttttgcaatcaagagtggtactgtaaaaatctcaatacattcattagtgagcaacacaattagagaaaggtgaaatattaaaaaaaaaggtagttaccatccaatgatggtttttgctctggtatcatggaaacctgcattttaatataaaaaataaaataatgattaaatttctaaaaaaatacaaaaagaaaatttagtcatgtaagaagaacttacatattcttccacaagtggttgtagatgctatgacatgaactttataggagttccagcagaggcaagatatttcttcatcaggagaatcacataactgacaaaaaaaaaagagcaaacaataaacatgttaccatctactcctcctaaataggctatatattgtaaataggtgtgttttttttctagtgaagatgaagttagagcaagcaaaccaagtattgatatctgatggcatattgatatcgtgaaaaaaaaaggtcacttagcactcgttaaccaaaacaacacatacttagctaaattgttgcaccaaagtactaaactatcaattttttgtactaaaacacactcacttgtcaaattgttatactcggatgtttacatgtagtatgttgtacccacctaccaagtttttttttatcgttgatgcaatttactcgaacttaaaaatagatgtatttgatattaaggaacttttatgtagaacgttttcgcacgaaacgtactccctaactaacttgtggctatgaatctggacgtggctggatgttggttttttttatgggatagaggaaatatcatatagcagtttgaaaagcgtgctaatgaaaattgaggtatattctacatcttaattagaaaaaaagaaacaacacacaactgtatatcggagggtcaatgacatttacctgaacagggattgtctcagccaaaggatgggcaaggtcatacagcataatccgcccatcagcagcacccgaagccagcagattcggtgcattggggttgaacgacaggcctctaacctgtacaaaacaaaacaacactgctcaaatatttgatcacacagtttgcagtttgttcggttcaggcatggttaaattttcaatcaaaaaggaaaaagcagagcacatctgaaatctttgatcacactatttgcagtttgttcagttcaggcatggttgaaatttcaatcaaaaaggaaaaaaaaggcaggcacatctgaaatctgtgatcacacaatttgctgtttgttcagttcaagcatttttttttatttttttgagaaagagagcaagagctctcccatctcattactgaaatgagctagagcagcaaaaggtaggaaaaaaaacatgacatcactcggacagacactactacaaaccaacttgtcttgaactactggatcaaacacaaaataatgcaggaaactgacgataacagccaacatcttcttgcccctcttttgcaagggatttcttgtgtgacaagttcagccaaatccccaacctcttagttcagttcagttcagttcaagcatggttgaaagttgaatcaaacaggaaaaacgcagagcagtagcagagtaaaaaagcctacgcctgaaacgtgcatgccgccgagaaacgatgaatgcaccatccgagaaccagttccatatctccactttctgtactagaacccaaagcacaccagatcgatcgatcccctcccaaaccccccacagcaaaattaaccactagccagccgatcagacaaacatcactacgctcatttcgatcaacccgaaaccacgagctagctggggaaattaaatccccaaatcgatcgatctgcgcttcagacatgaaaggcacaggaagaatgtaacacaaaccaattcgaataggagtggaactcgtacctttccagtatgtttggcaaacaaagcaacaacgccagagctgctggtgcgacacataatgtcgtcttggtattccaccatcaaatttccagacatttcctgataagtgggggacacttggagatgtagagccctggagtttccatcaacttgaacttggtcgaggtagtcctcgatgacctcgaagtccttgcgaatccaagtttgaacgccatctgggtggggcttgaggatctcctcgtcaggtagataagaaggtagtttcctgcgaaaatcgaaccaaaattagtgcaaacgggaggtagaacagaagcaaaacgacgcggcgcacggcgataaacaagccgaagcgggcgccggcgagaacgagaaggaaacttaggcgcgtgcgcggcgagaacgagcaaattaaggcaagcgcgcgcgcgcgcgcgcgacgagaacgagaacgaaacgaggaggtgtgttcgcagcgagaacgagccgaaaagcgagcgcgcggcggcggcggcgagaacgagctggacgcgtgcccgccgcggccgcgagaacagaacagcgtgcgcgcggcgagagcgggagagaacgaaaccttggcgcatgcgcggcgagaacgcgccaaaggcatgcgcgcgcgccgcgcgagaacgaagacgaaacgaggaggcgcgtgagcggcgagaacgaagctgagatgcgacgcggcgtgcccgcggcggcgcggcgagagcagaaacgagacgaaggcgcgcgcggcgagaacgaagacgaaacgaggaggcgccgtgcgcggcgagaacgaaactgagatgcgacgcggcgtgcccgcggcggcgcggcgagaaggagaacagaggcttggggcggcgcgggactcaccggagcttcaggtccgggttccacatggcgaccatgccgttctcgaggccgcccgcaatgagaccagcctggcacgagaagtcgttggacgcagatggcttcgctcagtcgatgctgcagaatccctccggcgacgggaacgaggccaccatctccagcatcttctcgcctgggcttgtacggaatatactcatcggcgtacgcggcgagatgccgttgtcctgaactacgccgccggcgaggagcgggacatcgccggcgaaggctatgacggaggtgggtattgccttggacttgaggaggaagacagccatggcggtggcgggcgtgatggattgcgtgtgcgagtcgctttctcggtcttattttatagctgtgtgagccgagccgctcggaaggacatcgtataccgtcggatccccagggagtccacgtgtcatccatccaaagcgtttccttgggcttagatgagccggtgcaaaatggaatcgtttggttgcctgtatcacgtgatgactggaatactagtagatgcaatgagaatatgttttggtacggagtatatggtttgagcaggttaggacatgaacttcaaaatcagttgttattgcctattactacttctcaacaattttcttctggtggtaattattcaaacgctctaaagaatttttgtcaagttaaattgctatccactacaactgattctggaaaagggacaagaatcaatacgtggtataaatttgtagggttaattagatacatgccattataaatttaacggatttgaaatatgccattacaatttgtgtggatttgaaatataccattacaatttatgtatttataacaatgcctttacaacttttatatagtttgaaacatgccgctagtatacatattttacccatattggacaaaaatgcccccgtcttcaacctctcgtcgttcatcatcgttgccacctcattgcctcgcaggcttcgggcttccctactccggcccccgtcgtcgctccgggaggacccgctccacgtggttgcaaccaccgccgccgcagccggaatctggaggccgtcggcttgccctctctgtcgcttgctgctacctccaccgccgccggaatctggaggccgccggctcgcccgatgtcatcgtccccaccttgccgccgccggatttgctcgccgggtgaagctcgtgccttccaccgccgtgaaccgccttcgctgacctcgtcgccgtcttatctgctccgcgcaaagctcgtgccagccgccaccgcgagccgccttcgctggtctcgccgccgccttatctcctcgcgagctcgtgtcgctacctcgcaggaggccgccgacggcgtgaggtggagggagacaaggacgtcgtgggtgaaagagcgccggagagggaggagacagcgactgcgatgtccatcaccggccgcacttgccactgctatagatggccatgtgggccgcctggcacggcacggcccaggcccggccgtgcctgggccgaggcttgtcgggccggcacggcccgaccgacgcaccgggccgtaccatgccagcccacgtgccgcactcacggcccaggcacggcccaacacgcctcgggccgtgccgggctggcccgaaggcacgacggcccatcgtgcttttcctcagaataagtctaattttcctccctcctattgggctgtgacatatatagctaaaaaagtatattttacctccctcttctttgggctgtgatatataaatagctaaataagtctatttaagatccctattctttggacaatgacatttatatgtctatttttagtccctatactttgtgtgccgggcctggtctgccggcccatcgtgctaggccgacccgaccgtgccgggccaacccgaccgggccagcccagcgtgtcggaggggaggcccaggtacggccgggccgtgcttgggccgggccaaaaagccatgccattagccgggccttcgggcctcgggccttatggccatctattgccactgccatcgccggtctcctggaatagaggagagggaagaaagaggaagaataaggaaagaagggcaatttggtcaaaaaattattgtaaatgcatctcaatggcatatctcgaatatgtgcaaaattataatagtatggatccaaatacacgaatactaatggcatatttcgaaatcggcatatttataatgtcatgttatctaattaacccaaatttgtaagaggcaaaacaattttcaactacgagttctagaaacaggttcaaggaagttttagggtacagcttgaatgattacagattcaatgtctcaaaagatagaattgcatactacttattcacaaagattgtttcaattttattaattgagacctacacatacaaaacttgtactattgtccaacaacatttaggttgcggtcgcaatatgctgcacacatccacgtacgtatacgtatacgtgtcgcaattgattacgtagcctgggcttctttaattatgtacagtgggttgggcttcttttattttattgcctgggctcgtttcatttttgtgggctggagttcatttattaaagctcggcctgacttgaagaatgtgatctcgagggatatcatctcgtttcgtgcatgtcatctaaatagttatcacaaaatttgcaacataaactaatataaaatatatcactccataaacatgcaagtttaaattcaacttatacaagttataacaaaataacaaatatagccgcgaatgtaccataactatttctagtttaatttgttttttttttcaacttgtatatcgcgctcgtcctccccgtcgtcgccgccgccccggcgaggagccgcccgcgcctctctccctctgcgatggtgagctactcatgtgttttactgtcctatgaaattattaggtagtagggtttatgagctttctggttgattcctggccaataattttatcaccgctagtcactccaaatcgtcgcatgcctctaggattctagtaccactgaaaacctaagtcgatttgcaagtaaaatgctaatatgttagtactgcattatcttaatgtaatctcccctgttcatattatgattatgaatttgtgattcattttcttggatgaacagatataaagaagctatcttctggagatgttcacttgtactgcaaagcatgctcagcaagattggcaaaacagccactaaggtagagcataacagactttgagttgtgaccgccggatcggtgccgacaccgccgtcgttggatccacccgcgacaagccgtcgacatcgcagttgccaccggatccgcccgttgaagccgcagaaggacgccttcgctcacggtgggggagggagccgccattactgcccatgcggagggagggcgccgccaccgtcgttcgcggaagggaaggacgccgccgccaccacccgtgctaagggagggcgccaccgctcacagtgggagagaagaggaatgaatctagggttagggtttcaacaaacaatgttttatctaaatcacggtgatcctagccattcgatcgaattcaatgactctcagcgcacttatgccgactttgtccgtggcctgtcacatgggcccagtgcacttaaaaggtggacacaacgtccttctaattgtgggcctaattgtgttttatttctttcatctgatttaaactatttttcaattaacaaacttagtttaagcactttttgaggcattaaaaattgctgaaatttgatatagtttttcattctttataataaattatttctagctagatggagtcaacgaaatgtaattatttctttgtcatgatatagaattagacatagatttaatttattatttatgtccaggagtatccaatatatataatttctatgaaactataaaataactataatcatcgtaacattagtttttcccatcgcaacgcacggacatcttttctagtccaatattgaaatctagcagctacaatgtatacatgagtatctcacagcaacatgtgaggtacggtgtcatctaatcctattataactcgatctacattctttgtgcatatttttgagacaaactctaagaaataaagcactaggtgatatgaatctgtattttaacgtacatgacgtgtgtgtgtatatatatatatatatatatatatatatatatatatatgtatgtatatgtgtgtgtgtgtgtgtgtgtgtagcaaccgggcacgccaagttggcaaacctaaggccatcgatcgcctagctcgcgccgcgatgaacgacgacgtggtgagcgagatcctcctgcggttaccggcgaaggccgtcctccgctcccgcgccgtctgccggacctggcgccgcatcaccaccgcctactcccgccgccgcccgcttcagctcctcggcaacacggaccccagttattactttacccccttcaacaccttgacctccctcccagccacggccgttccacgcatcgacgacggcggcgacatcgccggctgccggcgtttgctccaccgcgacagattctgcttgggcctggaggctacctgcgacggcttcttgctgttcagaagagtgcagaaggggagcatgctcatctgcaacccggcgacgcggcagctcgtcaatctgccgccggtgagccctgagccgtcgtcgcggccaaatgataacgagctgcgggcactgggcttctacttccaccggccgtccggcgagtaccgcgtgctgtgccaccgcccactcctagatgtagatgccacctacatcctctccaccggcgccgccgagccacggcggctcggcggcggccctgactaccaccgctgcaccatggtcgtcggcgagaccatcggcgacaccgtatactggtgccgcccccgttacctgcacaacggcaagccacagatatcgtcgttcgacacggtgtcggaggcgttccgcctgctgccgccgcctccggtgagcctcgccaaggacgaactggtcgccatgatcgacatgcgcggcacgccggccgtgtggacgatgaccgagctgcacctcgacgtctgggccttggaggaggaggagaggtgggtgcggcggctgcgggtggggatgcctccgccgcccgcgccactcgcctactggagcaagggcagcaggaagaacgccgtggccacgttcgagtccggcgacggcggcgtgcagatggtggtggtgacctgggcttggaagttgctgtacgacgacaccagcaaggacaggagggtggtgggtcgcactattgttccgagacactgtggacatttctggcacaccaattgttggtttcgtgcctaccgggagagcctcgtcagggtggaatcttgcacgccggacctcccgccggacggcgagccctatctacaattctgttgagtacaaacacgtcgttgctagctagtgatactatgattagtagtacttcctagtcctctgtgttttatagagtaattatataagttatttttgacttttttgtttttacaaacaagtccctagtgctagtgcttcgcctcgcgctatttttcgggccgtttctcgggtgcggcccagcccacgacaccgaaccgcaatcaccccctccttcgtttcgccgcggcagcgcggaccacaccactgctccccgctaccgccggcggctgctccgaccgccgccccagcgcacgccgccgccgatgtggaagagagttctggacatgacgaagaaggccaccgccgccgctaccgccgcaactggcccattcatatgcccacccagtgtcatgccatatgccttacacagagcccacatgcgccatgcgccatatgccccaccctcttagcacacgtccgtacgtccaatgacgtgctatatgctatgccaagtgcccgcatactaatccgtatgagcaaccgcgagggtcagctctgatactatttttagaaaaccaacacttatagtatatgtatatatacagatcggcacctatagtaccgatctgtgtatgtgtttttatagtagtgacatatcaacactaagatacatagccaatgcaaattcgttgagctacaaccttcaaaattattaccatagatgggctcatcaataatgctacagatcaacacgataatatggaattcgtatgatttacacaacagttcatatgtataaaatttggagatatttgcaaggtatgtacaaatttaatatttttgtgcacgtgttataagtacacaagcaatcttaaccatctatatttgtgatattcacccagtgcaacgctaagcatatttgctagtaaaataaaagtacttatagcatttctatgagcatgttcaaaggggctgaatctcaagtcagccctaaacccatccatgacatcaagggttgatgcatgagacacgcatacggccgcatattttacactgtcacccataatcacgtcaaaaacaacccatcgaatcaatcctcacctcctctcctctacgagcgcgcgactccacctcctgccgccgccgcgatttactcttaacaacgtcaaaactgcagaattgcagaatatacgcaggtcagctttcaaacttgagccgacaatcagaaaccaatgaaaacaaaatttcattatataaacgctaacaaaggtatatatgattatacaagattgtttcctaggcccactacaagaaaggaaaatgtttcctaggctacattagaagaaaaacaaatgctatcacacatgaaatcagattacaaaactttgcgccacatggctgattctactcacagttagcgcttttgatctctattcatatatatatacagggaaaaatggcatacattatcattgaaatatgaatctgaatcactttgttgtcttcccaaggcaaattatgagcaattgctgtacgccagcagattaagttactcgatccatatcatctttcatgatgatacttcatctcatcattctaagaaacctttgttttggtgggaaactatagatcgagacaatgggtctttacaaatagatatgactaacttctctaaaatcacagcttctgtttcttccaagatgatgacttagtgtcaaaaactatcacatttcttccatgtcgcttcctgatccaggacttagtgtcagatttatcaataggagctggatgctctccaacttcatggaatgttctcttctgcctaaccaagtccctgattcctgtcacatgaagatccttctgtccgctgacaacatggtaaacatgatctgctttcagagctccccgggaatattgtttctcaaaccttgcatcactgccattgctatgacccatatgcattcgcagtgactgattgccttcattccttgctgggcaaacagttgatttgcgattagctggaatgttcaaaggcaaagacctagaagcctctctatcaaagttattgcttagacttcttattgaagagtgcgtatgcctcataacagcgcccaaagagtgtgttatgtgctgattctccatcagagttggagttggcagtggcctgattatcggctgtctctccatcagagttggagttggtggtggcctgatcacctgctgtctctccatcagacttggagttggcggtggcctgatggcaggacccatggagcatgggtttcttcccataaatagctctgtcatttgttggataacagctgcaggtggaataaatcatcagcacgatggaaaatcgatggcactaattgaaaacaaatggcaatggtccgatttaaccctggaaaaaaggctaaaacttcatgaatccatattataaggattgtaccttgtaactgctttggagcaacatcaaactcatgccaccatacttttccatcagaaggaagtctaaaattattaaacttagcagcaaggtagagggaccctgctgctatgtagtgaggtttaaactgcacaaccaaagtagtccgaatcctgcataaacaggacagcagtaccaactcagaaacaacagagttgcaatttcaagaataaacaaataacaaggtgacgcaaagaacttacgcatcatttattagattcaccgcaacttgtttcacttccatctggaaaatgcccagcttcttgagagcgagctttagtggctcgtaaggatgctgtatgttgaaatcaaacctaattgttgaaagcaacagcgtctcccctaccaaaatgagctctttctgcttctcaagaacttcctgcttttagtaagaaaagttatgacaaagaagccggttatatagcaagagtatactaatagaaaaaatggaaagttttaagcaccttctggtagattctgtgagcagcgttacagtctttccggtacatggtttcatatgccacaatgatgacacgttgtaatgggcaaggtgtgtcttcaatcttcgaagcaagaaatacgcagacagttgcaacggtctggaataacagatagtaactatgatttacatgttcaatagtaaaaattgttaaataaacttgcgcatttgtgttagttagtaccatgggcccaaatctaggattaaatttcccatggctagaaataaataagcacctatattggaaaaggcaaatagcaataaagacaagttgttattacttactggtaaatagtactaatagaaagcattgccttcaagtttgataaagtcgctcccaagaatcacgtgtcttgcccaaaattgcaatttttggtgctccgagtaaaattgcttaaagctatacctcacttccagattcattacttaaatgggcgaacttcaagtcgaagtgaaaattttcaacgcttatatttcataaaagacccctcatgggaagtttttatcactccaacgaccagtacaccacataaggaatgatccaatcaacagtgctccaaatgattatacacatttacatcaaaccagcttgtatgtatccatatatccatgccggtgtaattttcttaacaacccacgtgactacactaccctcgactaaccccagaggatggtacatagtcaggtaatgttaggatccaacggataaaaataggaagttttaacttccgaaaacatctacacaagtaagaaatgaagttagttatacgacatggttaaaaaaagtaagtgttaacacctttaccctcaatggagtgcgtagagctttctagcccaagagtttttatggtggcaaatatagattgttttatacatagttatatttttgtggataggagcagtggcagagccacgttatgacctgcggggtcaactaaccccataatttctcatatttgcattgaaactgaaatatataatcttttgatacattctccgcagggttgggattttgatcctggatcggccattgcatctcagtgtgctacaggcacagaacatcgattgcagaaaacacgaaacagttggttaacggatgaaatggcaccactgatttttgctgatgcaaaagcgtttggtcactcgctgttggcaatggcagattagctttaattatcagtgtcactataacctcagaggaagattttcaacattggatagtgccacaactagtgggcaaacaaatgtgcgcatccgtatctgaagaactgcattttttttttacctgccactcgttcttggcgtgagactgtcggagataaaagcgatggcagagcaaggttgccgtcgcgattgtcacctgaggcctgcaaaaaataaaattaaattagcatctttcatcaggaaaaaaacccaaatccaacgcgcccccatcaacagcaaccaaccaacaacatataaatcactctcaacagatttaacgcgcacgccgcgtgcgagaatggatcgaattcgacaaccagatggaaaggaagaaagaagatcgatcttacagctgcagcctgaggccgacgtcgcggatgaaggagcagtaggtcgcccggagctcggcctccttggcggcgccgacgccgtccctcctcgacggcgaacccctctcgacctcatccctcgtgacgtaccacgaccccgccgcgccctcccccatcgccaccgatcacccaaaccaccacaagatcaaatccctcccccccccccccccaattctccaaatcggagcacgaatccttcgttgccaaggcttcgcgggatggaaaccgcgaggaggtggaggtggatggaggcgacgacttgggcgtggactctgatggcggcggcgggcggcgacttggccgccgcggcgaggaggggggttgggaggcggaggagggcgacgcggttgtgttttttttttctcctttttttttctttttctttcttttttttgttgttcgtttcgtggcgtgtggttgtgttctgttttttggtttgggttggggtttggctcgtgggacgcgtgcgttatttggcgtgggggtgacatgtggggcccgcgtggtgtggaagtcggtttcggtgtcgtggcgtggcgtggtgcggatattttggtatgggccgaattgagattgtaaggcccatattatggggtgcgtgtagggtgtgttgagttgggcttggagatgggttgggctgagaggatgttctgaagctctttgtgttttttttctttttcttttttttttgtgtgtgtgtggggtggggggagagaatttttccacataaaattccctatagtagatagtggagtatttgacatttaggggaaaaaaattcagtcgatttttaaaatattttttactggatggagtagaatatttttattttacttcatttcatttataaaaacagctgcctctatcctgttgcattgtactgacaactttgttgtgcacttgtgcaacacccaggaaggaaacaagagatagggatgacatgatttttcttttatgctgaatgtttttcgtgcaatgaaaaatgagcaataattgtttttcttttttgaaaggagggcaaaagctctgcctgtctgcctcaatgggcaataatagtggtacacgaacaaaactgtactgtgaggttaagaggaaacggtgttgtctgaaagctaaccagacgttaggttcaccttccatgcatccataatccatgccctaactacagataatcattagcccaactgttattattattattttttctacaaattatattcaaatcgaccaggcccaaaacggtgtgaacagcgagaagatcattagcgtcgcagatcgatctcaattggagtaccagattagattgcttacaaaaataccagcagagtattattaatgtcaacacggctaggtagccacaaaccttagctgtcttgaagtttaatcaagcgatgattgagctaagctagcttaattagctgcgttccatccgtcgtacggcggctcaccggccggccgccggatttggtccggtccagctcacctcacgcaccggacacgaacacggagcaagtcaacacagattaatgacgaggttgctagctaatcaaacaccaagagcttgttcactttacagccattttcaacgttttgtattaccaaaattttgattaattgataacattaacaagttttaataagattggctaaatatagtgttgtcaaattctccaatcatgaccaatattttggtaacaaactaaatatatcagttttagcaaacagtgatatggtttaaaatgatatgaatatgaagaagccccaaatgatgggctttgattgaccaactaatgcaaaaatccatcatctactttgattaatcaatccgtttaaaccactccagattttggtcttaactggcagcagattaattaggcactggttctgtactagtggtagttttgtacgtacggttcttgcattgcattataagtgaatggcctagctgatgagcctgttgtgcaattcttgactatttataattaactgctgacaaattggcaatttgttcgatcgtctgatttgagaaggtcaagaacgcagtgcagctggagtaattaacaagtagtataggcagtagtctgttttcgtttctgaaaagaatgttgacgagacttaacttgagccagcaacttagaatcataagagacggcgcgattaattgactgtcatgcatgtagttaatacacttaatcataccggtggtatctactcctactgatgttaaacatgtcttacaaacgaatcccaacctggtgagaagttctgccaagacagtactactgttcaaaatttgacagcaactcggagtagcaaattttgctcattgtgacaatatgacagtggtaagaactaggacttctttcgtccaatatttatatcaacatgaaaccgaatatgtcattatagtacaacgaatctaaaaaaatgtcatccagacttcaaattcattataggtactataaaatattctatcggattttaggttgctactatgttaaggattgaaggaactggtatgttcaaaattaattatttggttgtcatactttgccttgtcacactttagttatgccacaatttcttaagtatgtgtttgtttcactatcataattgtgtcataccacacttttttagccttagaacccacatactccctccgtcccataaaaaaccatcatagtactacgaatctggacatacttctgtccataatcgttgtactagaatatgtcacatccaattctaaatttgttttttcggaactgagagagtatcatactcttaaatttggagctaagcatgccatatttatggaccgtggccaactatttctaagccacatatgtgccgccatatctcaaactaactaaacttaatgatgaccaaccaaacattcccctaaatgcgaagccaattaggattaaaacaaaatggtgacaattaggggcatgccaatgcacgaaacagtggcgctactggagcgccacgttctgagccgcagaggcattgcttgcttccttgccttttgcgtgttaactcctagtactactgctgccagcctcgtgctgcagctgccatctgctacctgtatcctgcatttcttgcccctcattgaccatccaatccaacttcatcattcatttcccatcgcatcttcacatgcttcttctcgagtgcctcgagatgcgtgccccgcccaccagcagttgcacagtagcagccgcagagaatcccaggcaggtcacggctactagctgtaactaacggccggctacagggcgagcagcgtctgcggtcgcgccactgacaggtggggcatacgtgccaccggggcccacctgtcagtgacgcagatagggttcttccgctggctgtacccctccgacagaatggacgtgctgttgctgctagtattaccttttgcgttttactccttctaccatggtggctgccatcatggtagaaaccgtacttgctgttctgtcagcccaattgtttactcggttatttgtggaataagccatacggtatactatttataaacaaaaaataatttataaataatatatatatatgtgtgtgtgtgtttttagtgatataaaaataaatgctgaaaaataaattttgataaaaaccttcaaaatcagctataaatttaaggttgaaaaaataaattttagctaataagtataaacataatcgtaaagatgagactgtgtattggacggaattaggatagttcagattcacggtaccggatgtgttaaggtttataattttttttgacggaggaggaagtatatgtgagtgtaaataatgataactatgaggggtacatgaaaaaatgtaactagtcctaggcgcgggcgggccggggcctggagagtgggtcccatggttggcgctccccgcgggcgcgccacgtgcggcaacagccaggtggggcctacctacctctccgcaccgttgctgaattttttggtttttcttttttctctgtatccgctccaattcccacctaaaatttggccgggtcaaaactccggagtccaatatggggggatatttttttttcgctgcgaagtctgggtggattttgtttacatctagacccttatgagagtgtgaaattacttgaacgcaacgatggtcttattccttttataaattatctattttccctttttcttattatgttcatggttatatagatgcatctttcttcgaaggctgggtggatacatctgagaaagagctagtagtatgtgagaaaagctaatcacatactaaacgcgtacctgtgttgttttttaaacaacaatggcatgcaatagagtggtgttacgtcgtcatttgtctaaaaaagacattgttttctggagaaagaaaagggcattgcgttatattatatagaaaagaaaaagacactgccttcttactttatctggcatgtaaagatgtataaaatcacacggcataattaaaaaggttttcgctcatctatcctctttcatctctctcactttgcagttaagtattatccatcttgtttccaatgatcatctacgattcctcactgtctcaatctcattcttgaacaaaatacgagtaataaaattatgggagagagtaaagtagattagaagaatattagtgttgcatccaataaagcaatacgcattctgcaatttgctttcaacaaaatcatgtacttaaatttttatctaaaaacatccttttacaaaaagaaacttatacaactacatctaataaagcctcttttttcaccctaaagcaacccggccgtcactaaggaccgttttagcttttcggacgattagtcacttagcttcatggagaaggcacttaattaagacatgattgtattaaagattaaaaacttgaaaaaaagtagatctattcaaaaattttaagaaaaatatccctacatagttttattttaaaaaattacaaggtttatgcccatgataatctagcggttatattctgaaaagaactaggcctaagaatgagaatctcatgttggttattgctcgacaaatcctagtgcaatatcaaagtagaagagtatcactttatgccaaaaacttcaaagattcacgctctttttcacacgccatgttctttgtcctaagctctaatatatttgcttgtcgtcattcaatgcatttatcacaaacataagcagcatatagcaagaatatttatctaatgctataatactaatataataaccactactatcccaaatttattccaacccaaacaacccatgactctattgatattgcatgaactcaattatatgatattcataacttgccacataaacatcaatgtatacatggttaacgttgatagttatcacgaaaaaccactttgtttcacaaaaccgtcggcagctggtttgtaacatgttttagctgatttttatacggagttcatcagaagtccttgaatatttttgttcggttttgtttggttctcaggtagagcgatttttactcccaaactggtaatcttttcatacatatttttcatggtcttatcaggctttcaacaaaccaacaaagaatgggttttactcccaaaacggcaaaggttaccgaaaatccttgcttttttttttagttttgggtaaacagatatagaacgggtttttactccaagacggttagctaaacccccaccgtacccaacgcctccatcgccacaaatatcagccaacccagggaggacgcgaacgcaaattcccagaaacccgaggggctgaaacggaagcgaatccgaaaccacacaagccgaagcgaagcgcgcaccgaattcccggaggaatcggcatcggctgctcctccttccttcttccacctcgtcgacgtcgcctccttcctcccatcttttccattactttaaagttacctccactactttacctccccactcctctcccccaccacccacccgcctccctctccctctctctcttcttcctcctccgcgacgcctctccccaaaaaattcccctccccgaccgcctcgcctcggattcgattcccgcgccgccgcttcgccggcgccgacgacgacgaccgaccgaggtgggtacatcatcggggggcgagatctccgcggtgctcgaggtagccgcggtggtgagttttttgtttttttgtggggtggagggggctagggtttctgacggggaatgcgggttgcgttgcaggatccggaggtttgggagaggaggaggaggaggaggaggaggctgtgcttgttcgtccgacgacgtccatgtcggggcatctcgatcgcctcgcgcggccatgtgagttggggattttgatttttctctccgttctgttttttggggttttttttgctcgatttttttttcctgggagatttgattgctggggggttatgagattggattggattggctgcattgggatgtctcgccgtgaggattggcctgcactggcgccgcgttagaacccggattaatcacagagactagattagatttaggatttaggcgaatcaagctcgctgcgagttctctcgcttccgtgtgttctggtttggaataagttagggcttagtatccatcgagtcgtaggacggtttgcgtccagtctatgtgtggttcgagtttgaccggttcaatattgtgctgttctggtcttgttgaaggttccatgttctctggttttgatggacgcgtagctcccagaatgtgagtggccaggctaggttggatgctttgacttgtgaagcataaaattcacgggggactttcggtttggtgctggatttttctgtgacaggaaactaacttactatataggcttcaacttgattgaagggagaaaatgtttttgatacaaggagaaggtttcatgtcgatttccgcatagaacactgcattgaccagttcaataacctcaagctccgcacaatcttaaattcatgaattctgaatctggttgactagatggccagaaatttcaacgcagcgtacactaaaagtcacaattaagaacacatatatcatgttgggtaggattttgatgttcatcatcttataaaaaagaattgaataaatcctttttaggtagaaacttgtattgtttgggtatagttgttgacaaaagttacataacatttgttgacaaaagttgacaaaatttccagctgtaaccatttggatacataaggttgttagtattgaattatctagttgtgtaactaagctagtttggtggattcattgttgtgaacaaagctattccaatgcttagattgctgaaaaattgacatcaccttgtcttcttgctagcatgaagagtttagacaaacttaattttatatcttaaataagttgagcggttgtcaaagtttatttatttatttatgtacaagtagctaattgttgtaaatttgcacgattaccgagatttttttccttttctttcttttttggatgtggtggggcatgagcagttcttttgtttagaatgtttagaaatatcaccctttatctgcattctaaaatttccaatgatccaggttttgaagggtcttcaagtaatgatgacaagagagatcacaagtcagacgttgaaaattctgaagatgacaagagaacaagaatgggttctctgaagaaaaaagctatagatgcatcaaccaaaattaggcattccttgaaaaagaagaagaggaggagcggcagtcgggtcctctccgtgtctattgaagatgtgcgtgatctagaggagctgcaagcagttgaagcatttagacaagcactgattttggatgagttgttgcctgcaaggcatgatgactatcatatgatgctgaggtatatataccctattacttaccatcatttttttaacccaactgcaaacatgctgatgacttgactaattgatttgtgtagatttctaaaagcaaggagatttgacattgagaaagcaaagcaaatgtggactgacatgcttaaatggaggaaggagtacggtacagatacaattgttgaggttagtgttcttgcttgtgcctataaaacaatttggattttgtttggctataaataatgcctgtaactacatttctctgtaggattttgattacaatgagttagacgctgttctgcaatattatcctcacggttatcatggagttgacaaagacgggagacctgtttatattgaaaggcttggaaaggttgaccccaataagcttatgcatgtaacaacaatggaccgatatgtaagataccatgtgaaggaatttgaacggagcttcttgatcaagttcccagcatgctctcttgctgcaaaaaggcacattgattcgagcacaacaattcttgatgttcagggtgtggtatgctgctgaagctttaatctccagactgattattctttcttttttttcttttcactcaggcatgtgctaattgagcacattcttttcagggtttgaaaaatttcagcaaaactgcacgtgaattaattgtccgattgcaaaaaattgataatgataactacccagaggtactgtcttctactcaattcgctgataagcacagtactgtgttaattttcttgctaacttttttttcgtggttttatgtgttcagaccctatatcaaatgtttattgtcaatgctggtccggggtttcggctcttatggaacactgtgaagtcctttctggacccaaaaaccacttccaagatacatgtaagtctttattcttactacacttcaacttttgcatgggaaagatacttagtgcctaaggtaattatatatttcttcaggtactcgggaacaaatatcaaagcaagctgctagaagtaattgatgctaggtaagtaatgttcaatgtactcttgttgggacactctttttgtttgttcttcattttctttaatgttccttccattttaataaattaatcagtgaattgccggaattccttggtggcgcttgtacctgtcctgaatatggagggtgtcttaaagctgaaaaaggaccatggaaggaccaaaacatactcaatgtacgtttgatttcttccttactgtttgtctattcattatcagtgcattgctttctatacccttcctcatatgttttaataattttttttatactgataccagatagtccttagtggcgaggctcagtgtgctcgacaaattgtaactgtttccaatggagaggaaaagataatttcttatgccaagtccaagcaccacacagtatgtctcacaactcagtactatttttctattgctttctttgccttgtgctctatgcagaaacctaaatcttgctttattctggattgctagatacgagggagcgatacatccactgctgagtctggatctgaggctgaagatgttacgtctccaaaagtactgagaagttacatctcccatcctaagttgacccctgtccgtgaagaggttggtagttttagttttgttatccagaactgtttcttggttgcaagaatatattctacagtaccgtctgttgtttccttcctccctatgcctatttgttgagagcagggaaggaggcggggcacattaaaactaaaatataacttatgtttctttgttgttttacataaataatttcatctattttatagaaagtgcaaactaagcagtactgaagtgaactagtgatgctggcttgcatcctcttatgttacaaaataaatgctttctcctttaagctctgttattatggattatgccacttaaattaaatcatttccttcttcaggtcaagatggttagagccacgagcttttctactcgcatgcctgaatacgatgttcctgtcgtcgataaggctgtagatgcaacatggaagagagaagtgactcgaaagactgccttctcatccaaaggtttgttggtaatataattgtaagatctgaaatttacctttggttgctgccaaaacctgatgattccctctcttcaatatagactcttctttgacaagcacagaaagttcatccaatggctctttggaccggatcgttgcagttttgctggcagtttttatggcaatcattactttagttcggtcagttaaagatcttgctgcaaagagattgccagataaaaacgagtcagaacagaagtattcaacattatatccagactcgatgccaaaagaggaattccgaccaccttccccaactcctgggtttgttgaagctgaactattttcgtcagtcttgcaaaggctgggagatcttgaagagaagttcctgatgcttcaagataagccttcagagatgccctgcgagaaagaagagttgcttaatgctgctgtccgccgtgtggatgcgctggaagctgaacttattgtaacaaagaaggtaaacaattctgaactgcgaaactttacattatagtatcgtttatcactactttattagggtatgtgaaacatgtcagctgatcatttgcaaaaattttctcaaggccctacatgaggctcttatcaggcaagaggaactactagcctacatcgacagtaaggaggttgccaaggctcagaaaaagaagaaggcgatgttttgctattagcaccagccaaccaggagagggtacaccccctatcttgggattatactttctgacagccaaagacggcgtttgagaattgagatgttgtaatcggcagccccccctgctcgcttccctggttctcctgtaaaatgtgaaacgacagacgtcggatgtaaatcggcaaaattctgacataaataaatgtgtttttttgcaccgagttcttccctgatcccttcccatcgctgcaacttgtgcaaattccctgtgtcatgtgcttgcaagaattattcggcgcctttcgtgttatttcctgcttcctccgtttctattgtagagtttatcctaagcaacacctctccaagtttgtcaagttcatagaaaaaataagttatttaaccagagttctcagctttcataacttaggcgaggagttttaatttgcaagcatattagctgtaagaaaaattctgaagaaaatagatatatacagcctgtacatgtaatatgtttgataaagcacgtgcagcacaacagtggggtacacagttcagtccagtaagcaagaaaaagtttgttttttttccttttgctatacacatataaggccccttttgaaacacaagaagtatgtaacatgaatttcacagaaatcccggaggaaacaactcaactcaactcccgcagaaatagcaaaattttttccgcatttcaaacggggtcagatacagcgacgacgacgcacacaaaacaacacacgagacgcacgaccgagctccatcaccgcttcttgctttaaacccgtccatcaccagcggaatggattctgctgttgaaggcaaaactttaatggaatcagatgatgaaacgagtcaatgagttcttccaaaacgtaatcaagcctatataataagatgaagatcatccaacggaaaagaaaagcaggagccccttaccatccccctcttcttcttcttcttctcgatgtaggccagcacctcctcctgctgccccgacgaagtctccaaaagctgcaaccaaccatggactctcacttgtcagcgacctagcttcttggccatggcaacggcaatggcgagtgtaattatttttagtcaattgcaatttaggttatctatattgttgaagtttcaatttaaactacccttaaatcatctttttttttatttggaccaccccatataatttctcaaacactcgtccatcaacaacctcaatcaaatcggtctcgatacaccattaaacttctccatctatatgtatattatatcttcaccagaacggagggtaggtatgaatagtgaagagaattgtgtggtttaaactgaaaagtagcaaatttaccgagtacaaactgaaaaaaaaaatcggtttaaggatgatataaagtgaaacattgataataaaaagtgacacaaactacaatttactctttgtttaattaccttcttggtggattcgagctcggtctcgagggcctcgacgcgggtgacggcggctttgagcaagtcctccttgtcggcgggcatctcgggagggcgggaggtgagcgccgccaccttctcctcgaggtcgccgagccgcttgatcagcgcttcgtactgcgccgtcgacaccgtcaccgtgtccgggccagggagctgctccagctgccgctgctgctgctgcatcagcttccggttcttggccatcgcctccatcgtcgcgatgcccatcgccgcgtccatggcgcgcttcggcgcgatcttccccacccggaacatcgccaccacccccatcacgaacgccatgaaccccgtcaccacctgccggtccccggcgtcgccgtgcttgtacgcgtccggcagcgacgcgtacatgtctgcattgcatccaccatcaattatgtcagtgacatttggagagacgtctagggatattccggttagcttcacaaggtggtcggttagcctgaccggtctgggttcgaaggctcacctcttctatttatttgatattaggtccttcataatattcgcgttttatatcagtgacatttgtaacacacacacacaatttgaaactgaaattgcaataaaaatttcaacctcgtgcgagtgcgagcttctcggcgctgacttcgccgttccagttgaagtccatgttcttgtccggcatggggaacagatcgtcgtatcgggaagagcttccctcttggccaggaggagcctgcagttaattttctttctctgtcagttcatcagaaagggagatgccacattaggctaaccaagttgcagattggttgtttgcactgggataccatgattgaaaacagaagtaaaattcaccagcaaatttttgaattttggatgattaaattgtggcatgtgaattatgaacaaagtctgcaatcataaactcgtgtctatttaccttgctttctgaagttgacatctcatggagtggtgacatctgcggatgttcaatcttttcgcgtgggatcttgggtgaatcaacggaatcacggcgaattgattcttgcttctgcatatcaaaacacacaaaaaaatgattcagaaatgttacgatgcacaaaaacgagcataaaaaaaacttaatgatagcaattagcaaaactaacgataccttgggaattgccactatgtcatcctcagtgatcatcttctcatcagcctcagtatgacccgagctattaaatccacatcttcccatgccacattggaccatctgaaaaatcagatgaagcatcagaaccaaatcagaaatgttcataacttcatatatagacagcactagggctgagcagttcagttcatggcaaatctccactagctacttagctagcacatgtaagatgcatatatgcactataattttcagataacctttatgatttcaggatctttccatggccctttgtcggagcgcatgcagccgccttcgcaggtgcaagtgccaccaaggaactcaggcaattcgctgtctcgaaataacagggagtgagctcaacacgctgctcaatcttgttctttttaataatgatattagcagatttaatataaatattcaaggtgattccatttgcatttgcatagaagcaggaacgaacaactctagaaggttcatgctcagacctgggatcaatcacttccagcagcttgctctggtacttgttgcctaggacctggttaaaacagggcacataaatgcaaacattatgtaatgtttagttgcaaattgatcaaatgtagcttaattacgaatgatcgatgtgacattgacatcgaaaagattgtggatggattggattacatggatcttggctgtggtcttgggatcgaggaaggacttgacggtgttccagagaagcctgaatccttgaccggcgttgatgatgaacatccggcacagagtctgcatcaatacagacagcaacagatcaacgagtgaacgaacatttggaatcataaacatcgatgaacaaaccaaaatgtccacatttagattcattcagacatcaattaaccgatcaaagagcacacattcggattaaaaatacatcaataaccaatcaaagaacaaacgttcggattaaaaaaaacatcagttaaccaaatctaatactgaacattcagatattcaggcaccaattaaccaatcaaagactgaacatattcagaccaattaaaatcaaatgtggtcattcagattcagatactaccaattaaaaacaaccaaagagtgaacattcagattcagagagagccaatttctgctagctacctctgggtagttgtcaccatcgaccttctggaggcggccgatgagatccctggcggccttgttgaagttcttgtacccctatatcaaccaatcacaattaatattaatggatgtgaagaaggggaaagtgaaatcatcactcaatgagatatctacttgtttcgtgcatgttagtcataagttagattaatatgaaataaattacctcacaaacatgcaagtcaaaattcaacttctacaaattgtaacaaaaataacaaatatatacgcgaatgcacgataactattttcactttaatttgttctttttgttgcaacttgtagaagtcgaatttgatcttgcatgtttgtgaagtgatatatttcatattaatctatgttattattttttttcaaactttttgataactatttagatgttatgtaaataacaagatgatatcccctcgagggatgaaaatccacgtccaagaagaaggcaagaagaagaagaaagaagaggaggaggaggaggaggaggaggcatacaacgccggagacgtcgaggatggtggtgctctggtcgacatggcgcttggcggcgatggagcaggcggggaacttgacggcgaaggcgcgctcgaactcgcggacatggtacttgacgtagcggtccatgctggtgacctggaggagcttggcggtgtcgatcgcgccgagcttctcgatgtagacggggcggccgtcgcggtcgacgccatggtggccctgcgggtagtgctcgagcacctggtccatctcctcgaactggaagtcgtcgaggatggtgtcagatccgaactccttgcgccattgcagcatgtcgctccacatctgcttgctcttgtcgatgtcgaacttgcgggcgcggaggaagcggagcatcatgtggtagtcgtcgtggcgcgccgggaggagctcctccagcaccagcgtctgccggaacgcgtccaccgacttcatctcctccgcgtcgcgcacgtcctcgatcgacaccgacatcaccttgctgctccgctgccgcgccgccgcccccttgctgctcctgctcagcgacgtccggagcagcttcgacgacgcgctcatcgcgcgctgccgcagcgacgacgacgacgacgacagcgcccgcgcccgccgctcgtcctcgccgccacctccctctgccgccgccgccgcggccgctgcgccggcggatgaggagttcatgctcggcgtcggcatcacggcggctgacgacatcgccgctcgccgctcgccttattaataatcaatttcctaaattattcgccgcgccgagcccgagggcctcctgcatccaaaattccaaacaaacacacaaaaatcaaaacctcctcagcaatggctcgccgcgagatcaaatcatctcgtcgatgcgtacctcggattggacgagcggccttgggaggtggagccaggagggggaaggggatggaggaggaagaagaagcgagggcgatggcgatggcatgccagagttggttgctgcatgcatgggcatgggcatggccatggctgggctctgaatctgcatagctgacgtcatctcccccactatttccgccacaatagtagctgcaccgctattccttctcctccatgttactaacccagcagcaaccctctcttaactttaaactactcttactctcttttctaatgcaattatgcatttatatgcgcatgctaatgccattttttcaataatgaaaatcagcaaccatgtctctttaactttttgaaagtgttaactactcttcctctcttctctaatgcaattatgcatttatatgcgcatgctagtgccatatttttttaaaaaaataatgaaaatcatcccggctttgcttcatttttttttgagaattacacagtaaaacgcagacgctcacaacgcacgcatactcacccatatgaacgcacgcacgcatactcaaccatatgaacgcacgcacgcaaaccctaccttctatgagcatctttgaagattgggccggcaaatacttgagagatcgacgaagtcaccacaggcgcctcgctgtcgacgggtacgtcgcctaccactgaaagcacaacgacgttaaatcccgtctttgcttcattgaagctacaaacaattattataaagtttttataggtcgaaagaccgtgaattaaaaattatagctcgatggatataacactagaactacaggacggtttttgattgattttttgcaacttatacatgattaggaatatgatttttgcagactttgtgtgctccctccatgagtcatgatttattctggagatttttaagatgttcaagacatgtcatcatggtaattgaaactgaaattcaatccagttttgttatgttaatgtatcagttggcgatgttttgataatgccccggtgtctggtgaacggtgaccaacatttggtaaaactcgtccatacagggcagatgaaatagaggccaaatgtgcgatggccgaacatacacgggcaactttgagctgaaggcaagcaagatacaaggaattattacatcttttgatctagcaattgacagaagactgcagccggctgaaatagcaaccaacgtcacatggatcaaacggctgaagtacagattcacaaacaattttacagctcatcagcatgtaaacttggatcaaagcccaggatttctgcaaggcagcacataaaaattcaactccgcagtacagctaggctagacaataaattcccattggtagtaagcggtaggttataatgtatacaagaataaatagcgatgttacaaccacgtcgccgatgcatgtaccactgaatacatgtgctatcctaaacagaacataatgataacacaatctacccatcagctgaaacttacaagtccaaaggctaactacatattcacaactagtacaattatccaaccatggaaatagaacatccaggcaaagccagatttcagcctgcttccactacctctacgttagcatctgcctgcagcacaccactggcaaaagcgcatttagtctcagctagcgttgtgtgtctggtcatgctcaatgaagtccagagcttgctcctttgacaccacattgatgtagctaaccctgttcttgtgcgtcacaccatagatcttatcagcaacttttgcaatttctggtcggaatgtcgttgctataaactgagtgtcagccatgtcagctagacggcggatcatatctggagcattagcttaaggaaaaacacatgcaaaagcttgtagcattccaaagatgataacaaacagatggacattatttgatagcacgcaagaaaacgagagggagggaactcagaagaaatataaaggatactgccgacagctgttctgtactgtggatccagagcagcatcgatctcatcaaacagatagaatggggctggatcacaacgctgaatggcaaaaatcagtgtcaatgccaccactgtcttctgtccaccagacaactgtttcatagactgtgtttctcccttgccagtaaaggaaacctgaaacgtgagtgtaccgcttttagaagcttcgacaaagattatgcataatatcaagatcggtataatccaaaatgagtataacaacttagtatcattatttatcatcgtccgatttttcaaagatctattgacatttgctcaatgaacagtatatatgcacaaatacataaaaagcatatgcaaaaagagcataccttgacttttacaccaatgtacttctcaattctcccttcaggatctggttcacgaggcccatcctcatcattatcatcatcatctgcatcaccatcctatcagggaggaaagcataagcattaattttcagaagagatcttaccttcgagacatcaatacatggaaggaaaattcagataactccaggcatatacataggtcataaaatcgaagttcaaaattcaaaaatgtgtcatcttgaattggaaatcaaacttaacatcatctttgcattgaagaatagcccaggtatacaaaacaaaagatacgatctaatgccaattcatggaaagcaacataggtaacagtaataactaatagcagcctgtagtccccagcaaattggagtacactagacatgaaacccaattcaaccaaggtgataggccagcgtaggagaattacaattttaccacaaccaaagagtacatacacactgaataccagggctaaaaggcaaaaagtgtgtgccatggaagcaaggtcggtaggtaaagcaaggaaaatattacctttttcctcatcataaccaaatgtccatggccaccttgcactagttcagagaacacttcacggaagtgccttgcaacacctttaaatgtacgttcgattgattcgtccttcctttggtctaaaactgatattagttctctgattttctgcaatgttattcagcaggttttatgagattctactcataggatacaagcgaaactaaaggcttttaaccaatggaaaatttcacctgatcaccagcatcaagttcagcccgtcttctctgtagttgttcacgttgttcggtgaagttaacatactggtcaagagcttttttgttgacatgactgaactgctgcaattgctcattgcagtcataaagcatcttctgcagctgcttcttatttttccgcttgtacctatagcattggccagacaaataagttaaaatggtattacagcgccacaaaattaatctgcagaataccgctaaacaaaaggtatgcattctggccaattcagccagttttacatggaaacaaaaccaggtagccataaaatacagtacgtttcaaaagcatctgcaggcaatgagcccaagtctcggatcttcttcatacactcctcttgcttagctaaatgcatgctcctgctgctcatgagctgttccaaatccttggcaccatcttgtacggtctgctccaggttagcttctagtgcctgtgtttaaagataagccattacataagaagtcaacaacaaatagggagttcttacaaatagttcatagctatgttcaacttaccttcagatcatctctctgtcttttcagttcctccatcttccttgtgaagttattaatagcatcgacattagctatccaaaagatcatttaggttagacttgcttcactgcttaagaagcataagcatatgcagaaagaaaataaaagtctatcaatgtgtctatacccttcaacattgcagtcaattcatcaagactcctcttcgaactttttagttcttgctctttcgattcagcttcaagaggcaaggtcttagagtctgcagatgaaattattgcttcaagctctttctggcgcctcataagattagttgatagattggtttccagttcttctttccttgtttcaatctacataataatttatagctgcattagagtttgcagaaagaatcgcccgaaacagaagcatgatacaaaatttgctggaacaacctcgatgcgactgtttttacataagagaaacttctcctttagttcagtaatttcagggttcaatcgtgaaagaagatctcgttcttctgaagttaactgatcaataagttcagtgcccatttcatcatttttcattgcaatgccagattggatttgctcaatttggttccggatgttgtcaagtgatttttcctgcaagatagaaactatcagatagagttgcaggactatagcaacataggcatttgatacacagctaatgactttcatattaaatatcaagatagtgaatctcccatgaactgcagtaaaagaaaaggagaaccaagtaccttctttccaagtgccttgtcaagtgataccatttgcttcatagcgctagcgatgtcaaccttaaattgttccaactctgatttggcatggtcacgctcagcatccatttgctgctgtttggtaactaaatctgtaattttcttatctatatgtatggaaagttaaggaaaaaaattgaaggacatataaaattcatctggcataaatagtaaacagcaactcagcaagagccttgagatgccaaatacatatattcaaactactttggaacttggagccaaacaaaacaaacaaacacaaaggaagccatgaactttgataaaattgagaatgggagatttgccatcttgtttcacaaacatgtgactccttgttgcacatgtcatagccacatcaatggcaaatccttgttgccaactattgacagtgactaatccctaaatctgctagttgataggcccaatatgttgaagaaccagtagcattcctaccattttggaagaggttacatgcacgaatgctagatcactacataagattctacaagtatcaaatctacatgatgtgcatgcttatctctaacaattagaagagtggcagaatgagctacggtgcaagcaggaaatattgaatttaatagaaaaccataaactccttatccatcaggtctttagtaagcaggacaagaagtatatctagcagaagtaggtgataacaggatgaaacacacagttgtgtaccggtctcatgtaaacagggagaaatgagtgtagactaaaggatatctcttagcttgcttcccacattctctagatgtgctgcctttttctcaattgcagttttattgtccctaattattttcacaaacttcagttttgagcgtctagagtcatagaaacctcctgtcatgccaccttttctggcaacttgatcacctggaaacatcgactctttatcagtattaaattattaattaatgttaacaatgacaactcaagtgaaaaagttcaagactaccatcaagtgtgatgcaatccagcccattgccgcgtgcaactttggtcgcagtttccaggtctcggcatattactgttctgccaaaaacctaacagaaatataaaagttaagacacaaatatatattacaacggaaggggtgctacttaatctggcccacatataagcatatagcagaaaaaagaccattccaaaaggctgcactaaaagtaaagaaaagtcccacgcaaacatgcgctcttgactccatgcacatataaatacatgggaaggaaaggagatgagcagtgtatgccaaaacataagttacagaagttcataatcatggcccacctagaaaagtaatacattactctcaagattagtttgtgctaaaatacagcgtatgcaagaactgaaagtctggtaggtttgattcatagacataatacaaaacagggtaaaatataatacaacataagatggtctgtcatggctgatgaagcaaagctgggtgtaaaacctccaagcaggcaagggtaagaaaagtatatgcagaactgtagcatgagtaagccagactttgtcatgcaggtgaaaggcaagattgactgacggaaaacctcaattacattaatgaaggtacccaataaaatatgcagagaccaactgaaagaagataacagaagaacgtggacaatacctgttcaaaggcacggcgatgatcggcccgatattttagtttcttcaacaatggaacgaaatcgggactttgggggcaactaacatctggaactttcactctattcagtggtataaaagtcacccgcccacctttttctcgagtcaatacttgaatgattcttgttgatatatcgtcattctcaacaaccacatggaacaaactatttgcaacaaaatagaatggatgtaaagaacaatgaaatagtttaaaaataatctgtaccaatgtcatctatctaaatggcagtttaattcaagacctgttccctgcagtgacctcaacagcagtgaagaacttctcttcacaatcaaccagctctaaaacaggaccaaaaactcctgtaataccatggtccctgatgattctgctaacagaattcaagcctcttctgatatcctgagaaaggaaaagaacaacaacatgcagagatagttcaaccattgttctgacagaaaaatcatgtaatatggcaatagtggcaaagctcaatgtttataggcctatatccttgcattaacagtcaggccaagcacaagcaacattatcagtaaaactctaagaaaagattgatcgaattatcaagaaaattcaaaatcaaactactactaataaatctcaaattttatttacgattttgtcctgctaaggaatagtttgctgatgcttatgtaaggtgcatcagaatcaccatggtaatcctcagaacagtacatagcagtcagttatatgattaacaaaaggtataaaacatggaattttcataccccaggtgttgcatggtccaaactcttttgtgccttcacaagatcatcctttagcctatcaatttcagctgtcacatcagcttcctccttccaaaatgatctggaacattttccttctttaagtatctaatctatagagtaatagatcttccatcaaacaagaaggctgaaatatacatacttcctttcttcttgaagctcatctctctgcttcctcaagtcattgtagtcattgtgtttctttgctagtgcagactctaatttgcttgattcacttttccgggactcaatgtagctattcaagttattgatttcatctttaagcttctggatttcttcttgaagtaaaccttcctagaatagttgcaaggtaggtcagatatatatccacaaatagcacaatgattattaaaaaataacatgatagttcacattaagttaaaaataaatcttaacataaaaggggatgtattaaccaagctaaaacataatataatatagtttatgaaatgacgcatgtagaagaaaaaagcgtaatataaaatagtaaatgaaaacagaggtccagaatgtcaatataaaattgcaagaatcaaactggccactgaaataaactcttatctcttacctgctttcgatttgataaaagcacacgctcaagatcatcaatttccttttgaagccacttatctctggcagctttgtttgcgaattgggttgccctcccctgcttttggtacaatatacttaaccgcttctcacggtccattatgctatccccacaaaatgaaaacgtcaaacggagtaaacataaaaacataataaaattaatcaaaaacatatttttacctttttgatatttcttcctcttcctttaatttggcttgatgcaccttactaatttcagctaattcggactttgacttttcactctccatcctcacgctttgtaaatccttcgcagcttcatcctagcagtagattcttttaagtttggcaatcaaactgaattagcaaaaagttcatgagaaatatcaaatatgaaccataacatacctttgcccgtttctcgttcaagattctgtcttttatgtctctcaaatcaagctcaatctgagcaactaccttcagtgcttctgtacgcttcttctctacaccttccttttgagccttggtatcatttatccccttagttgagtattttatttctttgtcaaaagtcttcaccttctcacgtacatctaccacttcattatccgcatgggacattctttcagaaatttttcttcggttatcatccatctaacaataggagaaatcaaagcaggcagtaaaacaattggaccattcaatataaagatgaaacatgagctcatcgttctctcattttcaccaactgatgaagaaataaataactttttaactgctgcacaggtactgagtagtagtgttagtggtacagcgggtaattacagattaagccgtaaataatgtgatttttttgtctgatgcggaagagcaaaattccatatctcaatgcagttcctataatgtaaatatggtggttgcattgagggaggaccttaattcaaaagttattttccatcaggacagaagaacaccaaaaaataatactttgacttcaatacgaaatgctaaacttaatggtttgttctgcaaacttgtccaaaggcccttgttctttttttttttagttgaactaatccaactagcatggcaggaaaaatgtatccagaaagtaagcatacacaacaaaaaatggtaaatcataccgaagctaattcgttcctagcctcatttagttcatggtccagtatggtatactcaagtgatcttctttgtttgtccagctgctggtacttcttcagttcttctttctcttcatcaagttctctcaacctttcctccaagtagtggacaacttgatcaatctgctttcttttgttggctgttaataatgcatgaatgaatgtccactcacaagaggtctcccctagaaatatataaaaatttacgataacttaaacttgcctgtttcctgcatgattttcaaactctcgcgtcgtctatcttcataaacgcgcgtaccaccgatctctttgaggagatccagccgttcggaatctttcattagggtaagggatgcaatctacaaataacaattttcattacattatggccgaacagatcatgggaacaataaggtgaataattattacctttccctgctggacaacgtagtatggattagagcgagaaaatccagcactctctagcagattcatgacttcagttttactgaacaacatataattaaaagtgggtgtgagcaagcaatgccgatgtaacatggttggtcctgtttagggatgtatgaaatacctaacatgcttcccatccaagtagtattcatccttctttgaagcaactgtcctgcgcaggcgtacctcctctttgtcaacctgcagcaaagtattttttttggcttacaatcagatttacgactaacatgccatacaaagttaaccaaagaagaaagcacctaacacacagttaactctgaaatatgctgataaataattagctcactgttgactagtaccttgcatgatcacctaaaaagcaacccacgcaggcccaatactacatgcatgcactgtcatgggcatgaggccaagggccatggcgcatgtgggggacacggggagtgggatcctcaaccagacacatgaggcagttaggcagggaattattagttcccaattagttgggtttccctctttatagatatataccctatccattagatatgaaaacgatttagtagggatcaggtcgtgccatccctataaaagtgatgctgcccagctatcctctggcagtatctacccttcatgaattcagaccacgacatatgttcatatggaagatctaagagttgatgtatttttcataaaaagaatatgcagctcgagagtggctagataattgaattaaaatgaattaaagattaacgagttaaaggacttactggaatacggttgtctgaattatcaaacactatctcaacaaaagccgagacaaccgagtgaccagcaccttcctgaaatggttattattgtcacataacaaacacatgtttcaagtttaaactatctatcaagatcactcagagagagggaggatgcgtacatgaagaagagcgcccctgtcttcactgcgcaggttttgaaacatgtcactgaggacaaaccgtatagctggaggattataatgaccgagtgaggagaaaagtatcatataaggcagcataacaacaataacctagctagcagcaccacatatctaaaaacatattaccatggaagaaatttgatttgccagatccatttgccccaactgtaataaacatgcgaagttgcgttagttcatataaaattaaaatctgccaggattactatattcatcagatatcgcaattcactcccctgcaactccacgcagacaaggtaagtgcaggtaactgcaggacaagccgcacagcactttaaactaacacgcacaagatgacaaagtaaaacacaccaaacttttactaccctctagtcatgctagtcaaaaggggaagtggaaattaccaactacattaactttggggctgaaaggttctgttgagatctcctccctgtagctcttaaatccttctatcacaacctgcgcagacagacagcttctgagtcggcgcaaaccatatataccatcaaagccagcactgagctactcgcttggtagcagaacttactttctttatatacatggttgagacagggtgagctcaatccaccatgaaatcctacaaaaggaaggtcaaatgagtcaccagcacacaaatcaaaactccataagagacacgcacagtcaaatcgacacgaactaaaccacgagcccatcccacttcactcctgcgccctctcgtacctcactcacgactcacgagccgaaacgaagtccaccgcgctgagaatcatacctcgaaacgaacaaaccctaccccccaggccccaaccccaaccccgcgggctcacagaaccaccaccacccaccgagcgaaccaccctacaaaccctagcagcacacgacacgagagcgcaggaatcggggggaaaagacggagaaaccctagaatcgcgcgcgaggctactaccgcgcgcgcgcgagcaccccgagaacccccgactccgccgagggagaggggaagaggaatttacctcgacgaaatggggggagagagagacgacgacgacgacgcactccactccgctgcgagggcgagcgcgagcgcgagctaggggagcagtggagtagctagccgaggagcgagagagagagagagagagagagggggggagacgcggcagaggcagcaaggcgtcccgatccgacgacgaagcgtgtgcgtgcgggggatggcccagaggaaagaagcccacgcgcgtacgacgcgtggcgcacgattgggccttctctcccgcggcccctgcgacattgactgggccggatgggtagacgaggcccaacaagcctgtgttcaggtgccacggttgcagtacttgtatactaaagtggttatgtataattaatggtggtcaatagttattatttctatacaatattatatcattgtgctttgcgtgaaatatatttgatatatgatatgaatcaaatttctctattgcacaaatcataggaaatagcttttcctaacatgaaatttcaaaaaataaaaaataaaaataattgcactgtagcgttcgcactaacatattactagtgatagtaatatatccgtgcatcgcaacgggctagatacattacttaggatggaaggaggataactcggcttttaaaatagtagagaaaaaaccatatgaactagtatacctttcgttgttagccttcgtgtttcttgattgtatgatgctgactatttttgttcttcgtcggcaaagttgggatggtacagcgacaaaaactgacatgttatgcaacatactagatgcactagactaagttagtgaaagatggttaattaggtgagaccgtattgactttgtgctctttatatatcatcaaatagcataccgagtgttttttcttcgtgtttttatttagtcatttatagtcgttacattgtaagaacattttcaggtgaatccaaaaggcggatctatgttagaactttaagtttgttgcgtgttgcttacaattatcaaattatttgcctcatgccatagcttgaggtgtgtcaaattatttgtagttcttctgcaaaaccacaaaacaaaacagaaaacataactactctacacagttatcctagataataaatttccattggtggtaatagtcatagtttcgctgttgatatagggataaacagaaatgtaacaacaacacgtcataaataatagatgcatgcgccactgaatacatgtgacaccaaaaaatgttgctcttcttagtgacttgaaagtcaatgctgaaaataaaataatggtaaaaaattcaaaaaattaactctaaaattaacattttaaattaaaattttggctatggtcgataagccagaaagcaaacaatggctctgaaagcttaacattatctatccatcagctgagaacaaatccaaaaactgcatattcacaactagtccaactgtccaaccatgtaaataagacatccagccaaagcgagacatgcatcagccttctccacggaaaaaagaaacaatgtatgttggtagcgtaaaattgcaactaagatgatgttgtcaggcttgagtgtcaagagaagcaaaccattggcacaagcatatttggtctcaaatagcattctgtgtctggtcatgcccaatgaaatccagagcctgctcctttgacaccacattgatgtagctcaccctgttcttgtatgtcacaccatagattttatcagcaacttttacaatttccggtctgaatgttgtcgctataaattgagtgtcagccatgtccgaaagacggcggatcatatctgaaacatagcttaaggaaaacagatgtaaaattatgcttgtaatgttcaaagattcttttgtaacgggcacgagagagatagagggaagaaatacaaaggatactgccaacagcagttctgtactgtgtatccagagcagcatcaatctcatcgaaaagatagaacggagctggatcacaacgctggatggcaaaaatcagtgtcaatgccaccactgtcttctgcccaccagacaattgtttcatagattgggtttcaccctggccagtaaaggaaacctgaaactcgagtacctctcttagaaacttcaggaaatattttatacataatataattcagaaggaatataacaactcgccagcattatctaacatcacttgatttttttggttgaatgaatagtatacaagcgcagatacgtaaaaaagcatatgcaaataggacatgccttgacttttacaccaatgtacttctccattctatcttcagaatctggttcacgaggcccatcctcgtcattatcaatatcctcgtcgcctgcatcaccatcctaccagaaagaaaagcataagcattaactttcaagaagagatatcactttcgaaatagcacgcatggaaggaactttaagagaactccaggcaaaggcaataaaacaaagcccttgtttagttccaaactttttctttaaacttccaacttttccatcacatcaaaactttcctacacacataaacttccaacttttccgtcacatcgttccaatttcaaccaaacttccaattttggcgtgaactaaacacacccaaagttggaaattctaaaatgtgtcgatttgcactgtattcaaacttggcgctagctttgcattgaagaataacccagattttcaaaacaaaatataagaccggagtaatgccaattcatggaaataggtgagatagcataggttagccaatgaaggtgacaacaatatcagcttttagtccccagaaaattgtggtaggctatagatgaaatccaagtaaacccagtgaaggtgaattgtgaatttagcacaactaaaagcacattactgggtaatagggctaaaagcctaaaagtgcatgccatggaagcaagatcagtcggaaagcaaggaaaatatacttttttcttcatcataaccaaatgtccatggccaccttgcactagttcagaaaatacttctcggaagtgcctcgcaactcccttaaatgtacgttcaattgattcatccttcctttggtctaaaattgacacgagttccctgattttctgcattttttatgagatacagtgtttaggattcaagcgaaacaaaaggcagctgtaccaggggaaaatttcacctgatcaccagcatcaagttcagcccttcttctctctagttgttcacgttgttctgtgaagttcacacagtcaagaggttttttcttaacatgtctgaactgctgcaactgttcattgcagtcgtaaagcatcttctgcagctgcctcttatttttctgtctgtacctgtagcattggccatacaaataggattggtatgcattctggactgttcagccagttcactcatttatatggaaacaaaactaggtagccatgaaaaatgcaatacgtctcaaaagcgtcagtaggcaatggtgttaggcaatagaatatgccgtctgtggatatcccagctgctatagatagcagatgtaaatcagggattagctactatagatagcagatgtaaatcaagggaattatccttgccttgtacagcaggccagccggccctatataacagaaggcgccccctcccattgaggtgtggccaattgccccctaatccaattctctacatggtatcagagctccgggtcccgatccccatctaacctcgagatcctctcctccagcgccgcccccttcctccctccctccccatgggaacccaatcggacctcctctctgccactagcggcgcccttggggccgattctgcccctgtgatctgccccttcgccaccatcaacatcaagctccacgtccccatgaccctcgagttgaagccctccaacttcaccaagtggtcaacagcgttccaggccacgtgtgggaagttcgggctgctgcatcatctcgccaccgcctccacctcgcgccccaccgacgaggcctggaaacaggctgacttctgcgtccgcggatggatgtacagcaccgtctccgacgccgtcctcaaccttgccatgaccgacgacacgcagacagcgagcgttctttggacggccatcggcggggtgttccaggcaaacaaagctcctcgcgccatcttcctgaatcacgagtttcactcgatgactcagggggacctgtccattgacgcctactgcattcgcatgaaggagaaggccgacgaactgcgcgacgtcgggcagcccgtatctgagcccaacctcgtcctcaacctcctgcgcggactcaacgaggtctactccggcgtcgccgacaacatcgccggacagcagcccctcaccctcgccaccgcacgccatcagctcctcctcaaggagctgcggctgcaaaacgacgagaagacgcgtgctgccgccgccctcctggctgctgcctcctctaatggcggtttccagcagccgcagcagcagggtggccggcgccctaacaccaaaaagggcgcccaacagcccttcccaaactcctccggcggcttctccaacaactccggcagccccggcaccaacaaacgcattccctggggcttcaatccctggaccggcgaacgtgtggcccctggagagcgcgtcaccccccctggacagcgccgcaagggaggttctggcgcccctggaggtcctggtgccccggctgggcgcaaccagggcatcctcgggccttccccgcaggcccacaccgcctttgctccactccaggcgtcctccagcggctccaacacctccaccagcacctgggatgcagccggcctcatcgctgccctgcagaacatgcaactgcatggcaactcgccctgggtcgttgactccggcgcctctacgcacatgacgtcctcggatggtatgcttacccaacgccttcccccctccatctcctcaataacagtaggtaatggcactagtattcctgttacgtctagaggtcattccatccttcctacacctaccacaaatttcgctcttaataatattcttgtcgcaccatccatagtccgcaacctgttatccgttcgccaattcacttgcgacaatagttgttcctttgaatttgacgcccatggtttttctgttaaggatctcaggacgggacgcgtgattctccgctgtaactgcgacggggacctatacaccatgcctccctccacacctggcgccccacctcatgctctcctggctgcttcgtcgactctgtggcatcaacgtctcggtcatccagcccccgccgcattagagcgtcttaataaacttcatgctgtttcctgtcataaagtagaccactcgctatgtcactcatgtcagataggcaagcatacgcatctacccttcagttcttcgcattccataactcatgcaccctttgaacttgttcactgtgatgtatggacttcccccatcaatagtctgtctggtttttcctattacctggtctgtttggatgatttcactcactactgttgggtttttccgctccgaaaaaaatctgatgcccaccaacacttagttgagtttgctgcctttgccaaaacacaattcagcctccccgtcaaaagttttcaggctgataacggcactgaattcgtaaacaccgccaccatcaaattcctcgctgctcaaggtactcaccttcgcctctcctgcccctacacatcaccccaaaatggcaaggctgaacgcatcatccgcacactcaacaattccattcgtaccatgctcctccatgcctccctgccacccacatattgggccgaggggctcatgaccgcctgctacctccataataggcacccatcctcctccattcagcatgaaattccctacactcgtctgcacaaccagccgccaacctatagccatctgcgtgtttttgggtgcctctgttaccccaacatgcaagcaacctccaaacataagctcgcccctcgctccacggcatgcgtcttcctcggatatcccccctcgcacaaaggttaccgctgccttgacctatcgacccgtcgcatcatcatctctcgccacgttacatttgacgaaaccacctttcccttttcagccaccttagccgcctcaccctcctccgcttccctagacttcctcctcgacgacgatatggtttcggtgccttgtcctactgttgttgcaggtgggcttccatcctcgacgcccgtggtcgctccatcccactcggatgttgagcagccgccctcagatgctgcggcctcacacggatcgccttcttcgacaccgggcgggcgcggtcccgtgcccccgcctggacccagcgtggtccccttcccacgagtctacgtccgccgctcccgtacggcgtctacgtccgagccggcaactgccccagcagcccctgtggctcctgacgccccggcgccacctacgacgcccacaccagcaccggcggcattccccgttccggcaccgccaccgccgccaccgccgcgcgccactcgcaccatgacgggtgtcattcctcgcgtcagctataaagggttggcggccacaacgtcatcctcaccgtcgccagtaccgacgaactaccgcagtgccctggccgacgccaactggcgtgccgcgatgatggatgagtaccaggccctcgtcgacaacaacacctggcagctcgttccgcggccccctggagccaacgtcgtgatggggaagtggatcttccggcacaagtttcatgccgatgggtccctcgcccgccacaaggctcgctgggttgtccgcggcttctcccagcgcgagggcgtcgactacgacgagaccttcagcccggttgtcaaaccggccaccattcggtctgtactcaccatcgccgcgtcccgcgcctggcccattcaccagctggacgtgaagaacgcctttcttcacggccacctcgaggagaccgtctactgccagcagccgccaggattcatcgaccctggcgccccagagcatgtctgccgactgcagaagtccttgtatggactgaagcaggctccgcgggcctggtaccagcgcttcgccaccttcgtccggaagcttggcttcgtcgcctccacctccgacacgtcccttttcattttacgagaggggatgagtctcgcctacctactgctgtacgtcgacgacatcgttctcaccgcctcgtcctcggccctcctacagcgcatcatgactcggctgagctccgagttcgccatgacagaccttggcgctcttcaccacttcctcggcatcgctgtcacgcgctcctccgatggtctcttcctctcccagcgacagtacgccgtcgagcttctccagcgcgcgggcatggctgagtgtcatccgacatcgacacctgttgacactcacgccaagctatccgcgaccgactgggatctactgtcagaaaaggatgcatctgagtacaggagcttggcgggagctctccagtacctgacgctgactcgtcctgatctggcatacgctgttcaacaagtgtgcctcttcatgcacgccccacgcgagcctcaccgtgcgctcatcaagcgcatcctacgcttcgtccaggggactctctcctcgggtcttcacattggcaccgggtctgtcgacaaactgactgcctactctgatgctgactgggcaggatgcccagactctcgacgatccacctccggcttctgcgtctatctcggcgacactctggtttcctggtcttccaagcgccagaccacggtgtcccgctccagcgccgaggcagagtatcgggctgtggctcacgttgtggctgagtgctgctggcttcgacagttactccaggagctccacatccagctgccctccgccaccgttgtcttctgcgacaatgtcagcgccgtctacatgacgaccaaccccgtccaccacaagcgaacgaagcacatcgagatcgacattcacttcgttcgcgaaaaggtggcccttggtgagattcgggttctccatgtgccctcctctcaccagttcgccgacatcatgactaaagggcttccgacagcactctttcgagaatttcgatccagcctttgcgtccgggagcctcccgctgcgactgcgggcgggtgttaggcaatagaatatgccgtctgtggatatcccagctgctatagatagcagatgtaaatcagggattagctactatagatagcagatgtaaatcaagggaattatccttgccttgtacagcaggccagccggccctatataacagaaggcgccccctcccattgaggcgtggccaattgccccctaatccaattctctacaaatgggcccaagtctcggatcttcttcatacactcttcttgcttagctaaatgcatgctcctgctgctcatgagctgttccaaatccttggcaccatctcgcacagtctggtccaggttagcttcaagtgtctgtattcaaagataaaccgttacacaagtcaacgtgagttctttcaaaaatacgtccatatagctatattcaacttaccttcagattatccctttgtcttttcagttcctctatctttatcgtaaagttattgatagcatcgacattagctaccaaaaagatcatttgagttagcttaacacttggccccttaggaagcattaagcataatgcagaagggaactaaaagtctatcagtgcgtctatacctttcagcatcgcagtcaaatcatcaagactgctcttagagctatttaattcttgctcttttgattcagcttcaagagacaaggttttagaatctgcggatgaaattactgcttcaaactctttctggcgcctcatgagattagttgatagattagctttcaattcttctttccttgtttctatctacataaaaaattgtaactgcattagaacagagagaatcttcaggggaaaaaagatggttgctaattttcttgaacaacctcaatgcgtctgtttctacataagacaaacttcccctttagttcagttaattcagtgttcaattgcaaaagaagatctctttcttctgaagttaattggtcaataatttcagttcccatttcattatatttcattgcaatgccagattggatttgcacaatttggttctggatgttgtcgagagatttttcctgcaaggtagaagctattagatagagttgcaggagtatagcaaaatagacattttatacacaactttcatattgaatatcaagacagtggatctcccatgaactgcagtaaaagaaaaggagaaccaccttctttcctagtgccttctcaagtgatcctatttgcttcatagtgctagcaatgccaaccttaaagtgttccaactctgattttgcatgatcactttcagcatccatttgctgctgtttggtaactaaatctgtcattttcttatctatatgtatggaaagttaaggagagaaaattcaaagatataaattttgtcttgcacataagtagtagtagtaatcagcaactcagctgtctcagcaagaggcttttaatgtttcaatcacatatccaaactactttgaacttgaaaccaaacaaagcaaacaaacatgagggacgccttgccatcctccctcacaaacatgtggcttctggtcccatatgtcatagtcacaacagcaaatcctcattgccaactattaacagtgactaatacttaaattttgctagtttgttggcccaacatgttgaagacccagcactccagcagtattcttatttcttaccatcataataatagtctgtatgctttggcatactccctaaaaaaataaagttatgtatgctttggagaaggttattgtgcatgcttatttccaaccatcagagtaatggccaaatgagctacggtgcaagcaggaaacattaaatttaatagtaaactgttaactccttatccatcaggtcaggtcatgacagaacgagcatcttctataccagcgtcatgtaaacaaggagaaaggatatcacttagattcctttcaacattctttagatgttcctccttttcctcaattgccttcatattgttcttaattgtttttacaaacttcagttttgagcatctatagtcatggaaacctcctgtcatatgaccttttctggcaacttgatcacctgataacgactcttattaatattacaccattaattaatgctgctaatgacaagtgaaaaagtttgaaactaccatcaagcgtgatgcaatttagcccgttatcgcgtgcaactttggtcgcagtttccaggtctttgcatattactgtcctgccaaaaacctaacagaaatacaaaacttagactaaagtaaaatatatgacaacagaagagatgctatgcaatctagcccagataagcatataacagcgaaacgaccactctaaaaagatgcactcaaagtaaagaaatgttccatgcacacatacactctgaccccacgcacgtatgaaagcatgggaaggaaaggataggcgatgcatgtcaatacataagttatagatgttcataatcatgaatttatgacccacctaagaacccgttactctaagattagtctcagctaaaaatacagggtatgctctagtctggttagtatgattcatagacttaatacaacacagtgccaaaaaataatacattatttgatggtctgccatggctactgaacccaagctgatgttgctgggtgtaaacctccaagcagacaaaaggcaagatgtatacatgcagaactgaagcatgagtaagacagtgcagatgaagggcatgatagaacgaaaacatcaattaaatttaccaaggtagccaataaaatatgtagatgtcaattgaaagagcatgacagaaaaatgtgggctaccatcggttggccaattacggataatacgtcaatcggcgtattagcgacaaaaaaataatttatagttaaaacttttacctatgtgttcttaacgaattaaatgtcaatgttgaaaaagaaattacgataaaaaaactcaaaatcaactccaaaattaatttttaaaatttaaattttgacattgtcatatacgttatagggcaaaagatgtggcccatggattaatacctgttcaaaagcacggcgatgattggccttattacattctaatctctctaacaatggaacaaaatcgtcacttcgtggataactaacatctggaactttcactctattcagtggaataaatgtcacccgtccgcctttttctcgagtcaatacttgaatgattttcgttgatatgtcgtcattctcaacaactacatggaacaggctactcacaacagaatagaatacatcatttactaaagaaacagtgaaatagttaaaaaaaaatctggatcatgtcagatgtattaaatagcaatttaattcaagacctattccctgcagtgacctcaacagcagtgaaaagcttctcatcacaatcaatcagctctagtataggaccaacaactcctgtaataccatgttccatggtaattctgctaacacaatttaagcctcttatgatatcctgaggaaggaaaaaaaatcacaacatgcaaataaagtttcaagcattttcctgacagaaaaataatataatatggcaatagttggcaaaactcgatgtttatagggctactatatcctttcaagaacaatcataccaagcagaagaaatatttaacaataaacaaagcaaacatttgtcaaattatcaatcaaaaataaaaatcaaactagtagtatcattttttaatgattatgtaagtttgttgatactgccactatatttaaatatatgacactgttcactttatttggtcttcggcgtgcaactttgaccactattcttctattagaatagaacgataatatcttctttttttataatgtagaattacttacaaagaaaatatacccatagcagtcagtaatatgaacaaaaaggtgtgaaaaaaatgtagcatttccataccccaggtgttgcattgcccagcttctcctttgcattcacaagattttccttgagcctatctttttcagctgtcacattagcttcctccatccaaaacgatctaggacatttttcattatcagagtatgtaatgtataaagtaatagatcttccattaaatcaaaaggccatgactgttaagaaatatacgtaattcctttcttcttgaagcttgtctctctgcttcctcaagtcattgtaatcactgtgcttctttgcaagtgcggactctaatttgtttgattcactttcgtagaactcaaaatagctattcaagttattaattttgtctttaagcttctggatttcttcttggagtaaacctccctggagtagttgcaaggcaggtaagttggatataaattcatcaaacagcagaagggtgattaaaaaatcacatgactggtcaagttgagagcaaaaaatacagcttaacataatacataatgtattaaccaagctaaaatataatacaacataacctgctttcggtttgataaaagcacacactcaagatcatcaatttccttttgaagccacttatctctggcagctttgtttgcaaattgggttgccctcccctgcttttggtacaatatacttaactgcttctgacggtccattatgctatccccacaaagtgcaagtgtcaaaacgagctatcataaagaaaagattatacatggaaattattctaaactctcgaggggacatcccctcattgtttgcatgtcctctaaatggttatgaaaaaattgaaaaaaatgaaaaagatagattagtatgtgataaatcactccacaaacatgcaatgtcaaatttaacttctaaaagttgcaacaaaaaaaattgactgtgaatatacattaacaggccatagtttttttttgttgcaacttgtagaagttgaattttaacttgcatgtttgtggagtgatctatcacattaatatctatcttgataaattttttcaaatattttcataacaatttggataacatgcaaacaatgaggggatgtcctctcgagagtttagaatccactcccagattatacatcaacatattttttacctttttgatatttcttcctcttccctcagtttggtttgatgcaccttactagtctcagctaattcagactttgacctttcactctccatcctcacactttgtgaatccctcgcagcttcatcctagaaatagattttttttaagtgtagcaaagaaaaaaacaaaaaaaatcatgagaaatatcaaatatgaactatggcatacctttgccaatttttcattcaaaattctatcttttatatctctcaaatcaagctcaatttgagcaactaccttaagcacctctgtacacttcttctctacatcttccttttgagccttgttctcatttatccccttggttgagaattttatttctttctcaaaactcctgatcttctcacgtacatctaccacttcattatccgcatgggacattctttcagaaatttttcttcggttatcatccatctaacaacaagaggaatcaaagcaggcagtaaaacaattgatccattggctataatgattaaaaatgaactcttgtcactctcgttttcaccaaccaatgaagaaacaaacatttttttttaactgctgcccggatccagagcagtagggttagtggtatagtgggtggttactgatgaagccataaatactgtgttttctttggtttttttaagagtgaattttacatatcacatcgcagtttgtataatgcaaatatggttgatgcattgagggaacgccttaattcaaaagtttcttccatcacaaccaaaaaaatatgacatcacagtgagtaggaaatgctaaattttaaaggtttgtttgccaaacttgttgcaatggtcattcatttcttttagtttgaatattccaacttgcatggcaggaaaaatgcatcttgaaactaaacgtacacaacaaaaatggtagaatcttaccaaagctaattcgttcctagtatcatttagttcatggtccagtatggtatactcaagtgatcttctttgtttgtccagctgctggtacttcttcatttcttctttctcttcatcaagttctctcaacctttcctccaagtagtggacaacttgatcaatctgctttcttttgttggctgctaataaatcatgaatcaatgtccacttacaagaggtcccctacaaatatataaacatttatgataacttaaacatgcctgtttcctgcatgattttcaaactctgtcgccgtctatcttcataaacgcgcgtaccaccgatctctttcaggagttccagtcgttcagaatctttcattagggtaagggctgcaatctactcataacaattttcattacattatagctgaacagcacatggcaacaatcaggtgaaaaaatattacctttccctgctggacaacgtaatatggatttgagcgagaaaatccagcattctctaacagattcatgacttcagttttactgaacaacatagaattaaaagggggtacaagcaagcaacactgctgtaacatggttggcctgtttaggggtttatgaaatacctgatatgcttcccatccaagtagtattcatccttctttgaagctactgtcctgcgcaagcgtaccacctttttctcgacctagagcaaagtagttttttttctttcactcacaatcaggagcatgaataacatgccatacattgttcagcaaagcaaaaggcacctaatacacagttcttgctgaaatatgctgataaataactagcagtacactgttgactaccttgcatgatcacctacaaagcaacttattagtttccttaatagttgggatccctctttatagatatatcctatgcattagagataaagtcagtttcttaggtatcatgtcaggtcatccctataaaagagtggcatatctatccattttcaattacacaatgataaagactaatctctagtctctctccaatgatctttaccgcagtctaagttcccttatcatccctagcagccgatgatgcccagctttcctccagctggtgttcaccgtcaagaattcataacatgactgaatagcatgcactcacatttttcgggaatacgcaaggagcgcattttttccattaagagaaataaaagttatttacatttgaaagagaaaaacagcacgggactgatacaggacaataacagacaatcctaggtctatctctcgcgctgattttggcgaccaaactccctcctgaattgcagcgcagggatcgtcgggtttgctttatgccaaagagaggcttcgtccaccatccctctagccacatccacccaagatctacactgctgattgaagatccgaccgttccgttccttccatattgtccatgctaccaatgtcaccaccgtgtcgaagcctcgacgatgtgactcacttagcaccattctgctatcgcacatccattggtgaaaagaagcttcattcactggcaggcagttggggtggccgattgctctcaaagtccaccaccaaagctgccttgattctgggcagccgactaggatatgatcaatgctctcatcttgctgatcacagagaatgcagcggtcgggatgcggcaatccccgactccgcagtcggtcggctgtccagcatctgttcaacgcgaccagccagaggaagaaacgacagcgaggtggggccaacgagttccagatcggcgtggattcaaaggcaattcacccaaggaacaaagctcggtaggcagattttgaagtgtatttgcctgagctttcccacttccaggagagtgagtcgggctctgcggaagaacaatcaactgactgaatcagcgaccaaagtttgaggtattcgagtattgcctgagtcccaagcgcgccacttatgtccttgatccatctacggttagacaacgcttcagccaccgtccggcgcttccgaatacgagtagagacatgatcgtagatggagagtgcaatagctcggatggttcctccttgcaaccaattgtcctcccagaaaaggattgtttgcccgttacctagctgacagacggtggaggcggcgacaaggtgaagttctttctgtgagcaagggatttccaatccctgccaaggcttggtcagagaggtcctttgcatccacgtccagcgggaacgtagtgcaatgcccatgagcttcaagtttggcacaccaagacctccataatccttgggggagcatactttggtccaggctacccggcagcatccaccattcacttgcgccttacccgcccaaagaaaaccacgccgtaccttatcaatacctttgatcacccacttgggtgcatcaattgcgaccaatagatagattggtatggcgctcaagacagcattgaccatggttacacgaccgatcgacgacatctgattagatttccatgtgggcagccatcgggcaaccttgtcaacaagaggctgtaggtcctcttttttcagcttgaagatgaatagcatgcactcacatgaaagatctcatagttgttgatgcattttcataaatagaatgtgcatctggagagctagataatttaaatcaaatgaattttgatcaacgaattagaggacctactcccggtaaaaaaaaatattagaggacttactggaatacggttgtctgaattatcaaacactatctcaacgaaagccgaaagaactgagatgtcagcaccttcctgaaatggttattgttatcaaatagcaaacacctatctcaactaaatcaaagagagaggatgcgtacatgaagaagggctcccctgtcttcactgcgcaggttctgaaacatgtcactaaggacaaaccgtatagctggagcattagaatgcccaagttaggagaaaagtatcacataagcataagaataataacctactagctagcaacatcacatatctaaaaaatattaccatggaagaagtttgatttgccagatccatttgcaccgactgtgataaacatgcagatttatgttagtttgtatacaattaacgcatacaaagattactatagtcatcaaatattgcaattatctcccctgcacccccaagaaaacaaggcaagtgcaggaaactgcaggacaatccgaacagcgccttaaactagccatgcacaagctggcaaaaactcatggacatgttggttagatggggaggaagaaattaccaacgacattaacttttgggctgaaaggttctgttgagatctcctccctgtagctcttaaatccttctaccacaacctgcacagacagacagcttctgagtcgacacggaccaacatgtcatcaaaatcagaacagcagaacataccttctttatatacatggttgagacagggagggatcaaacggtcaccatgaaatcctacaaaatgaagggcaaatcggtaggctccatctagacgaactaaatctccatacatggcagcaagcatgcatatgcacacagtggaaattgatcttttgtgctgaatggtcgaatgaatgatttgtgataattattctattgtacaaacgaaaaaattaactattattataaagttgaaagacggacttaaaacaatattctatgacattcatatatagaattgtttcagaaaaaaaggaccatttagaagttcggaaagcatgcccattaattcagttatccattccttcaaaaagaaagggtctaaagatcccaatccgtacaatactacgatcctaccaaaccaaaatggtcctaagccaactttcgtagtatcccaatcctaaataagagttccatacgatcccttggtaacggtagagcttacgtaggatcccgatcctacataaggattatttaaaatcaaggtgggttaaaaataatgtgagtaagtccacacaagtttctaaagaagtcgattaaatttatcaaaatcaatattataagctttaatatttttttcagaaataagcattggatttgtgtatcgttgaattaagattgaggtgtgatacatacaacacaacggacacaagctttaatttttgcaatgtattacaaatcttatattttaatatacacttatataaaatctgataggatcccaatcccaatcctacgatcaatatatcataaaaaaaaaagaaacgattctaccgagtatctcgatcctaacaagtggcaacctcggtaggcacgaggccgagacgaaaagaccaacgcgtgagagtcacagctcgaagcaaacaaacactagtgtacactacccaacccgcgctcatggaaatcacctggcgaaccacccaaaaaccctagcaggggaatggggggacaaaccctggactccgcctccccaaccgcgaccgctggcgagcaaatccggaaaccccagatgaaacgaactccaccaccgagcaagaggggaggaagaatcaaaatcacctcgtcggaatgggggggagaccgggccggaatcgatcccgaaccgggaggaggacgaataactgaagaagacactccccggcgacggcgagcgagcgagcgagcgcgcgagaggagggagcagttgccgtgggggtaggagatgagggttaaatagacgtcgtttcgttcggcggcccacgtcacacggcccatctgttgcctgtttagtcacatcacatcacatttcccaaaataaaaaatttcacgctgtcacgttgaatatttgaacaatatataaagtattaaatgtaataaaaaaaatcaattactcagattgtgtgtaaattgcgagacgaatcttttaagtaactgcgttatgatttgataatgtggtgttacagtaaacatttgcaaatgacggattaattagacttaataaattcgtctcgcagtttcttggcaaaatttataatttattttgttattatactacatttaatactttaaatgtaggtacatatattcgatgtaataactaaacccaaaatttttttccaactaaataaggtcttagtaattggtatcattaatatatatctcattatttttatggttattattataatgtttaaaataagagtagatattaagatgtaccacactagtgcaaaatcctagtagtacttttttatcaaccatgccaattttttctcctcacatctattttaccctattattctttttgcttgtggtcaagctataagcttaaagctttcttttttgcaattactgttgtgtggtttctattcacaacgtacactgtattgcccctatgacattttcttatggtcatattgtgttttccctaacaataacatcaattcatagcctaaaatattatacttcaattctcttgtattttaaaacggagccagtactagttcgtattaccatttttttctttaccgcacacgtacctataaataacataaatatttttttgttttatctattctaaaatataactacatattatttatctgttttttctaaataatagacggattaaaaaaaacaacatagatcatttatatgtttgacatgcatttcattatttaggggtttagtttttatagaaactttttcgggtattttttttatcgaaactgatatatcttcagaaaatactttcaaatataaggaagaaaatatttttagaatattgtatagctactcccgtctcttccgaatacacgctactgcgcctttcctgggccaaagcccaatttgcttccacagaaatcggcccaaaacatttttgccttgccaaggaggaaaggaaaacaagtcacaagtggaccccacatgcgctgcctcaccactctcactgacgggtggaccccgcataaacactctcactgacgtgtgggccccgcagaaaccctccaccatcctcctcctcctccccatcttggagtccaagaagaacaccaccgcaaaccaacccaacaaaagcagggcacacgcatacacatcgcaagccgcccaaaccctacacaatcttcgaatccccaccgaatcgcgcgagagagaaatccaaggcgaggacgaggaggaggagaaggaagcttcgagaatgttccggaaccagtacgacaccgacgtgacgacgtggagcccggcggggcggctgttccaggtggagtacgccatggaggccgtgaagcagggctccgcctgcgtcggcctccgctcccgcacccacgccgtcctcgccgccgcgaacaaggccgcctccgagctctcctcccaccagcggaaggtcttccgcgtcgcagaccacgccggggtcgcgctcgccggcctcaccgccgacggccgcgtcctctcccgattcctccgctccgagtgcatcaaccacgccttcgtctacgacgcgcccctccccgtctccaggctcgcgctccgccttgccgacaaggcgcaggtccgtctcggttcccaatctccccccctttccctcttctcccctctctcccccacttgatctcttcgggtgcggttggtcctgctgctggattgcttgatctgctcgtgtacttagggtttcgtggtagggggatcagatctaaagcgctaactggggtttcgtgcttggggtgtttccccggccgggattttggttgttgattagggttacgatggcaggtatcgctgggagcgcgtgcttcgatgatcgacaactgatttgatggattggctagtggcgcctatttatgattgcaatttaggagtatcagtgcttaggtgattgtgcttaggcgattggattacatctgttggcatgtagaagtttgcagcactactgaaaattagaaattcagtacaaagatctcctgatgagtctcactccccagcttcttcttaaaagaacagtacaaaattaagttgccatcttcatatcatacttgacatgccgatgtgatttcagccgaggatggtgtgtaaagatggtcgcgaatccaggtttacctgcccttttatttaactattggcatcagctagacaaatatgtgtaagcgctgtagtagtagactttgcaagcgaaatgcacactcttggatctccgcttgttaagatgcacaatctgataggatacgagtatatgatcaaaaaacatatggagtaattatcttttaatagttgacatatgtgcttcttcattgtatggttctgactattttatcctgcatcaattcatgcacacagcaaaaggctgtgatattatgcaacatacctagatagtttcataacataacacttataaatcaccaaaaaatctagtgaaacatacatacatagtagtgaaagaccgtattgaccttgacaccttgttccttttagatataatcgagtagcacattgactgagttatttgcagtttactggaaacaagcgagagctagcatttatttgtcacgtttttaatcatttattatagtcattatatggaacatttcctgtaatcccaaatgttgagtttaagtttgtattatacatgtgtttatgtgttgcttctagtgatcaaattatttgtttcatggtgtaacatgagattttggtatgctcagacactcgttgaggcattttcctaataagacaacaattttcaatttggtgcacctgtttatcagcttgatttcttttatttttaaatttctgcaagccttctcctttaatgtccatatggatggatggaagctactagggaattagattgtgttgtcgtcttcagaaaaaaaatgtatggttatagataataaaagtattcactgttgcaaacttgaaattgctgctttaagatgtctttgacttgatctctcactgcaccagttagatttataaatatctagacgggttagcatatgcagtttggaagcaaaccagcacagcatgattcaactgtcaaaccatgagaacgcagatggattttgtaagtctgctccatgagttgatgattatctgcatcattgtaaacatgtttgaaaattagaaggtattttttagggaaaagcatctctgcgttgtgaatagctactcagatttagtacattaacaagctataatctatgactctccatgtgcattgtgatttcattgctttttagtatgctaccttctttcatgcatatattttatttttgttgaatctggaaaatcgtttttcagatattaaagattgcaaagctatcagtggaggtttctttttcttgcctggctactataacttggaaaaaacgccatacatcaattgcattctcatgttcttgtacatctagctttgtttcctgttatctccagcatgacaattaatctgttaatcttaatccattaccttatcattgatttagagtgtagttgttgcttacagcatcagttttcaagctgtgctcagtgcgcatctgcatcatctcaacgtcactttttctgtagcagctattgcttcattctccccttcgattgccatcatacttgagcgtgcacctttatttccgtagtgtgcctattctggggagcagttcatcggataagctgcatctatttccccatggccatcaagtttacttttgctttcgtgattctactctgcaactgttttaattgaacctgttcaccttatgctgatgtggttgttagttgtaaacgattgatgtggttgctggctgtattataaatgatttcagccagatatgtatattttcggaattaccatttgtcccaccacgttcctgtggataatgtctgtttctttgatggtgttgcaggtttgcacacagcgatcatggaagaggccatatggtgttggcctccttgttgctggattagatgagtctggagcccatctatactataactgccccagcggcaactattttgagtaccaggcatttgctattggctctcgctctcaagccgccaagactttccttgagcgcagattcgagggctacaacgactacaccccagagcaacttatcaaagatgccctctccgccataaaggagacgctgcaaggtgagaagctaaccagctccaactgcaccgttgctattgttggcagaaaggacgatggcaccgttgagccatttgagatgatcgacgtgaagaggatccaagaaataatcgattccatggaggctgccgaggaggcaccagcggcagaggctgagtcgagctcgatgcaggaggaggacaagggcacggacgccgcgcccatggacatctaggcccaagatacatcttatctcctcccttacaccgtgtctgagtttccaaaagactactgttttagaaagctgtgactgttgtgtaccctttcttcagtactacaactttgcgacggtctctttgatcaacatcgattgtgttttggaccgattatttacatgtgatgcggacagaaaatctctttggtttcggggaccagattacgtttgcttatcattcgttctgatgccattctgatgcttggaatgtttaatgttcacatggttagggctctgtgctagcaatcgctgctagctgcacgtccgtttgatgtaccaatgcgcatgaagctgctgttgtaaattctcttcgttttaaatgcggcttggtaggacgatgcgtcgatgcccttcgtcccagtttaaatttaacccacttcaaatcttttttttttacgggggcaaatcttaagcagaagtgagcagacgtcattgtgtgctgctgtagtaaattcatttcgctaataatttacatctgctcgagtaatcagacgcctttgttgtagaaaaggcgcacatcactgtactacgggcttgctggctgctgctacacaagtactcaacacatgcaatatccttgatgtcatagctgtttgctcttcgtgcttataaatgacataactatgcaatttaggtcgattttaatgtgaatttaggtccattttgattctgaaaaaaaatatactgatacacaagcattcagcaaattttggagtgaaaaacactgacactgacaaccctggcccaccgtcacacgccgtggccccgagacgtcagtggagttttagtacttcccaaatcataaggacacgtcataaaaacgagagctcgcctagttctctttcttcccaatcaccaccacctcgtctccactctccacgctcccgcatccatggcggcctcctccgcccgcctcctcgccgccgcagcgcgcggccgtgccgccaccaccttccgccatgctcctaccgtctcctcctccctctcattccctcccaacccgcaccaccgcccgtccctccgcggccgcgctggcatctccttctcctccacctccatctccctcccctcgggctccccgcacggcgcctccgcccccttcaacctcttccctcccgactccgatcccttcatacagtgggaccctccccctcccgacgccgcctcgccgctcggcgccggcgccgccggccgcgaggcgcccggggacctcacgctggtcgtgctcctcgggtggctcggcgcgcggcagaagcacctgcggaggtacgccgacctctaccgcgaccgcggggtcgggtcggtgcggttcgtggtgcccgtgcgggagctcctcgggctcgacctcggccgccgcgtcgagcgcagggtcgccgacctcgccgccgagatcgccgcctggtgcgacgccgaccaccggcgcacgctcctcttccacacgttcagcaacaccggatggctcgcgtacggaaataaaaccttcatttttcgttatttactcgcttctcccaataatgtgctattactgttcttccctgaacaccggatggttgaaattgaagtgtttcaaaccggacaagaagttgataggttggaattattacatgcgcatggtttgcacatgcgattgcacggcctcaattaaattgggcaatgtgttgcatctttgcggcaggatagaattgatacacgcacatgcatgtttatgctgtgacacattggttgttgcataggtttggttgataaaaacgtggttgatagaggtacgaaagaaatccaaatggtttggacagcatgttctgggaaagctcgtcatcttctgtctagagtatactgtggataatggagctactccatgatattccaatggtcaagataatgagaaatggagtgcgataagaacttagcaaaggtgatcggttgaagagcacaacagatatccatttgtgagtgcatagattgagtaaacagcgtggataacagcatgatctatgtggagttgttaggccaccttgattgtgctagattagtaccatggtaaaatatttttttcaggcatttttacctcataatgagaatcactagcaacggcgtccagtcactgacagtctcatataggtgaatcacattcatggttgatatggctgctgttgttaaggactacctaattgaaaaaacatggtgtgttttgtttttctaatagtttctagtggaaatttcttgtggtgcagtgaaagataattttccatttctgccttgcctagaagtcagaaatcccctagtggaggttttatttgataattcggtgatctgtggtcatgccattcacatggctatatatgagaacttcgctatcaaatttctttccagatatggtgctatacttgagaatctacaatcaagagctgatataattgagaggatacggggatgcattgtagattctgcaccagttctggagataagaccagaggtctggacactatctttttgctgcattacatatacctgaaataagcttttaactggtagcagtaaattcttgttcaaatacattttagtatgttggatttgttttttcatcttgaactgtcgtaagatcctattactatagctagaatggtttgtgctattatctggaagtttccctatgcaaacaaatctgtttaccaggaagctcatatataaacttaactcaggtctgggctgctggattctctgctgccatgttgaagaaaagcagttccatgacaggaccttcagttgaatctcctgatggatatacttcaaatggcaccttgaacaaccttagctctgatgtgacgagaccaacatggggtgaaaatattcttctatctactctacagaaattcttcgagattgtccttcatctacctgatgtaaacaagtaagtccttaccatgttcaatcagttctggttacgtgttttgaagcatggacagctcacaccgttgtactcagaagttaacttgggttttatagattggaattaaacaatgctgtatacttcaattactacttcattcacactgccatgcaaaactcattgttttaggcaccttttctatgaagattgtaggttgactgccctcaatgagtaggtgtcatatttagcaaatggaagagtagtgggggtataaaaaagagagacagggttgagaaaagattttggagatattgatttatctcttgcttgctcagttgccctaaagatttattgaatggtcatttggtcccttttatagggaagggcatatgcctagttgacttggcagctactgctccaacctggactcttttcctaaccaagttttataacctacaaattctatcatggactctcctgatgttgctgactaatcttgctgagtacgtaaattaacaaaactcctgatgaacatataatctaggacttgccctatgccatcttctgtctctaaaaggcttactgacgtcctctttgtgattggaaggtcgcaacattcataaaagaatttcgtagcatattcaatttaacagaagagcagcagtatgcatgggtgcctcttttcattatatttctccatgtggactgaactttaggttactgggctcgatgcataaatacattgttgttttctttcattgcacccgcaaaaaaaaagtattataccatgtctatgggcagttagacactgaatttcactttcagttgatttgcacagtagatcaaatggacctttcaacgtgtcatgtttgcaatgcattaattatgtaattttggcaaagcaaatcatgatggttcattgtacagctcataattactgtgagtgactacagtttatttagtcagacttaggtaacttctcctccagttttctccaaacatgacttatttacgttatttctgttccatagattcagcatgatcagttattcccaaatcataccatagagtgatagagattcacctgatggctctttctgttacctgacatttttttctctccgatcgtcatgatgttcaggaggctagaaaaggttcactcggttctttcagagaagcagcctacctgcccccagttttatctgtacagctcagcagatcgagtaatacctgctgaatgcgtcgagcgcttcatcgacatgcagaaatccctagggcagagcgtattcgcccacaattttgtgtcatcgccacatgtggaccactacaggagcttccctcatgtctacgcagcaaagatcgacgagttcctgaagatttgctccatagctagagtatgaccagtttttgaccaacaggtattctttcgagacataggtattgctctattaccttgagaggtatatgaatcatggaatatttacccattagagttcctgaaatgatgtgtactcgttcatgaaaaatatgaaatcttgaaaagtgacgctgaaagctgaactcttagatgcacattggagccacgaatttctgctgttatttgcttcgatagccttagacagttagacactagttgcagcgtaatctgttggcgattttcagatcgcctcaagttttattcaattgtacttgtctagtgacaatggcatgagcctgtgtattctagttccatccaagatgggaacagcctgttgttgtgatactcctagtctctgtcacgccgtgcttgtgagttgttaatattctttctcgccttaatcatgttgtgagtacagtaacaattgtcttgtaagcttattgttcgactcgatttcttgatgtgcgcgcaagtgcaaaactctaattttgggtcggttaggtatacacaaaagtatgtactctcgttcatacatatgattagacaaaataattctgaatgtattttaggtactataccctgagaattagcttgattactatgggtcagtttggaagacctttttttttcgcaactcgattactatagaagtgatatcactgaatgtgcacaagtacaagcatgtacagtccaatataaggtcccacagtagcaatgccaattattctctgacggtttgatctacaattgataagccgtaaaagaaaaaacactaagcaaccaaaaacaatttatggttattagtattagttaaacttctatatcagtgtacttagcgattcaaaaatcacttgtgaaaataaattataaaaaaaactttaaattttttcccaacgtataattgaattttaaaagttaacttttagcaaccataagcagagacaatgaagacctgtttagggtaaacttttagtatctaaagattcttctagaaactgcagctgtcagaaatttcctaaacagtctactttttacttagattctgaaaatagaatcttgaaagaaacagttttgaaattctcactactcacccgctgcttatccgaatcttaacctctccaaacatagagcctatttattttgatgctattttcaaccttactaaattttagtaaaagttacaaaaaaaaaagtggctacatttagtttgctgccaaattttggtaactatataagaaatactgtcaaaattttggcaagttaccaaaacttttataactatgtcaaaattttgacattgacaaaatttagttttttttttttgcaataaagtaaacatgcccatagccttaagagtggtgcaccctgcaactgcaccaaccccctggttgccggtcaaagtcaccaccaccaacacgacccaaatcaagcgcagcactgcagcacgcaggcatcgtctcttcaatttttggtattttagccgcagcttgggctctctctccccctccacaccccacgcgcgcaacctaccccccctactcctctccattccttccacgcgaccctcgctcgcgtcatggtggtgctcgtggaagcatcgccgcgcggcggcgccggtgatcatccggcctcctgcgagctcgacgccggcggcgatgtcggcagcggcgggaggcagtacgcggccgtcgtcgtcgggggcaccttcgatcggctgcaccagggacaccacctcttcctcaaggttaaactaatcaatcagcaactgctctcttcttctcctctcgagatagtactaaattccacgaatggtgttctattgattggattgattcggaaggcttaattactctgattattctttcgcctcttcgttaacttcatcttgctgtcgttgttcttgatttctcattgacttgacgatgatgcctcttcgttaacttcatcttgctgtttcttgttcttgatttctcattggcttgacgatgtgaaagcattaatgttgattggaatttttaccgtctttttgacaggcggcggcggagttcgcgagggagaggatcgtgatcggcatctgcgacggccctatgctcgccaagaaacaggccagtatctgcaccgctaaatttcttccacttctactcctactcctctcgaatcttaaactgatccatcaactaatcatgcaattacttaagcattaattactctactggtagtaatcatcatttgggatctggcttttctttgtcatgacatggactatggtaggaggctggtgctgctgtctctgcagctgatctgatgccacagcggcatcaaacttttaaagttttttttaaagtttcagacgtgagacatctcaactcataacccaaccttaaaccatctgatacatgcatgctaattagcagctcgtagtactaatggtggtttacattacatgacacttttattgaccatgcaccaacttcctcctttgctaaattgtcctcatcgaatattactactcgataccagccaatagccatctttatcaatgtgatgcaaagaagatgaaagaataaattgttggccattcttttgctagtggaataaattgtcacccactattttgctgatcagcgtgatgcaaagaagatgaaagaataaattgttagccattcttttgttgatcaacgtgatgcaaattaagaagatgagagaataaaatcggtcgtgtttttacacactgccaacgaccaataagcaaatgtattaagcctggtttccagtgcactgagagacggcaccactcacaggaaggggtcggtgtcaaaggcttaaacacgtcatttgacaggaattaataagtaggtgagcaattctgttgtccagtagtagtagcagcagcacaccgtcgtactatgactaacaaccagaacacaagttcattgaatgtggacggatcctcaaactgcatattccctgttaagaaaacatttctgaagttgacatatggtgtatgtttgtctgctctttttctcaataagatatactccctccgttccaaaaaaatctaatcctaacttcccaatgtaaaattagtggagagtgggaataactaaagtgcccttaattattgaaaaaagtagtaagagtaataggtagttaaaggatatttatgtgataaaacctctcgttttatgtgctgatggtaggtaggatggtagaaattgattttttgtgggacaaaatttaaactctagtggtaggtaggatggtagaagttgattttttgtgggacaaaatttaaactctagaagttgagtttttttttgggacggagggagtagattttacctcgcttccgttagcacgtcttttaaactattaaacggtacgttccgtgtaaaaactttctacgtagaagttgatttaaaacatcaaatatatatatttgtcaagtttgtaataattaaaactttattaataatacactaatagcttttttattttacgtgcgctaacttaaattttgaaacatgtatgcatctgatgaacatcttttatgcttcttttgtattgcattattgcagtatgcttacctgatacagccaatcgaaaagcgaatggaaaatgttaaggagtatatcaaggtaccgacacattgcccatcaccctcccattctagtaatattctcgaactgtttctgaatattctcgaactgtcctgaatatgaagttgttaatattatctgacctaattggtttcacaaggttcgtaatccagatttcaagtagaattgccctgaaacggtgatttacaaacttaagtgcaaacttatctatataagtagctgtacatatcagttgcaagttaccagtttaccactataccgaataaatgcttcgaaacgactcttgtacagtaaaaagtccacacgaatggactatcaagatttttagtaactcttgtattacaaataacagagatcacgaactgttaatatgtggtaacaatcactcactcaggacaattgtctggaccattcttccgttagtgatcttaaggatcttgtcatcttgctacatatctggtactccgtactatttattaggcaatgatcgcctcttaccatttccagtccatcaagcctgatcttgaagttcatgtcgagccaatcgtggacccctttggcccctccattgttgacgaagctttagaagcaatcatcgtcaggttaggcttctctgtcctacagtcacttggtacactactattatcgtcttaataggatcaatagtttgcctacaactgaaacctggtactcctatgtaatattcatcgcctcaacagtggacaataaggagtaagcaatacatggaaaaaatcatttttaagctgatgttatctgtgtttaactcttggagcagtaaggagactttgccaggagggcttgctgtcaacaggaagagagctgagagaggcctcgcacaacttgaggttcagtcacaattcccatcaatggttttttttattggcacataaaagatttgcaattgcgtgataactttattttgttgcaatgctgcagattgaagtggtggaactggtgccggagaagtctacagggaacaagataagctctacagcattcaggaagaaggaagccgagagggaattgcacaagcagcagcaggaggcaccacatgaacaagcagttgaacttgagtgcagaatataaacagatacaccatcatatggtggagtacatgacaaagtgcactatgaattgtgctatatagttttgtgtcaccaatgctagtttttttctccaaactttttacaactttacatacagaagtatatagctcaagaatgctgctgccagctttgtaaaaattaaaagaaagagaaccaacattgcagcaagtacattcagttgtaagttgtttgcaggttaagttcataaacccactccttaaaatcgacccatttctgatcaatggattatgcacccctccaagacaagatagaccattcatatgctccttggtgttcaaacttgaaccatctgaaatgttagctgagagcaatattcgtgaaagtgaacagaaattttggtgagaaaatcatacatagtgcacacaccaaatcaaacacttaaagaatttataggtgtacaacaagcctcttaatttgtacccaaaactttcttctataaatgcacaagagatgctcagaggtgagaaatgagagatggcatgaggagagctcagacaattgctatactctgctcaacgaagagcttctctgggagaagcacttctcatacaagaggtgtcagaagaaagcaatgctcatcacagctgctcctactctaccaaagtatacataacaaaccaataacaagtactagaatatgttcaccaatggtatgttccccacattacacactccactacagctatgtcgaacaaaacgcctaaatttagaacacgttaatacgttatagtatcgcattacaaataatgacaggtgattccagaaaaataatgctacaaatgagtttgagagtagctgaaaaaaaaagaggagctcagagggttgctaaatctgctcaaggaagggaggcccttctcatacaagaggtgtcagaagtaagcaaatgctcatcacagcaagtagctagtctaacaaaaactaatcttagcacaaaaatcctaacacaaactcatcacagaaagtaatcataacaaaaaataatctcatctttttaatgagcgaggatgcgtgtgctcagatatatttgctacaatctgctcagcgaagtgctcctcctcatccccaaggaagaggaaagaacaacttctcatacaagaggtgtcagaaataagcgagcaatcatcacggcacaatccaccaaaaccacaaaaacaaaaatcattcgaaggggctaaaaattcgaacaagatcaccgtgcttgctgattcgacgcaaacatcaatcagaccagcagcctatccctgttcctcgcggcaccggatcagaatccaaatcagaaaaagaaaaaaaaatcaaacgcaagatgcaggcaacgcccgcggcggcggcggcggcgattgaaccctagcggaggtgaggcgagcacagagaattgaagcgtttatagaggcggaggtccaaggtttagatgggccgtgtgggcctttctgtttaattagtgatgggccttgaaaatttaatgggccggcctgcttgatctctctcgaagctgaaatggttgacctttttaggttgaccgttgactctgttcatgaaggagttttctcccagcaacataaaggaatctggatcaagtctaaccctctgaagaaagttaaaacttgaaacttatctccaactccaacctgtttaaacagcacactttctagaagataacttatgtataagctcgatcaattcaacttttaaagtagggaattgactgtttcaatacggacgccactgcttcattgggagtatttcaaaagcccagccgcaacagagatgcagcagccagcagcagcatgagaagaggaccggaatccggaaattgaactagttttatacacccttcgagaatagtcacgccacaccagacaccacacgccgtccggtcaataccatgttcggctaaagttcgtttggtttgaatagttttggatttaataaatggaaatttaatcttttttattcatgatcgtaattttcttgatttcgaaagaattaaaccacctgatatacttacagcctcattggttgccctattaaatcaaagtcaaagtcaaaatttaaatttttaaatttaattttaaagttagttttaagatatgtctcacgtagtttcttttgaacattaactttttatttattaagaatacatatataaaagttatatatgcaaattaatttttattcggattcttaattaagcagtagcggctaaccttactatagctagtatttactacagaattctatctcaatttttcttaattacatggaattttagtggattatccgctgacttgcccgaggtcgtcgggcgatgcatccgccgctgtagttaagggaatatgggcaaccatgcactagaatgaaaaaacacagatcaaccttaaaattgaattttgcaattcaaaatttggttgtggccgatgagataacaaacacatgtagattaacatctccagattaatttagtaaccaaaatccagattaatttagcaaccaaaagctgttcaaagataagggacgcgcttttgcatacgctggggtgtggagtattcctatttacgcatgtgtgaataggctgcaaatgcctgtgctcaatggaagtttcccatggtcgaccggtctttttcctcgtgcgcggccgcgaaatttcgtctgatccaccacctcacgaaccaaaccagatccaccatgattaacaaacaattcagcaaagtgacaaaaataatcgctaatagtaccagtagtacattgcgtatgcagccagcagctgatgctttgacagattctgagacaaaatcatctctcaaatttcattcctctctttttccatttatgtacatgataaggttctagtacaaacgagaaatctcgactcgaatttcgccgaaaattttgaacacttttacaacaaaacaattaatttaacaacaactaccactagtaatcagttggtttggttattgaccaagtgattaaactaataggcggtgtggtgttgcgaccggccgagcgcgaagaggccgctgaacgccggtcggtacgtcaggtacgaggcttgctgcggccgccggtcgccgccggcgctggccttgctgtagaagagcctgtgcgcggtggccatgtccatctcggtgaccacgcccttcttcgccgccggcttcgtcttcacggcgctctgcttcttctgctgtggttgttgagggggaggaggagtcttcagtttggatgatggcggcgcggcggcgtggtggtgcaggaaggcgaacttgtccttgccgtcgctgcgggagcggccgccggcgccgacgaggtcgcgcaggcgccagcgccgcgatgacgacgacgactctccgccggtggacgcgctcttggggaacctgtcgcggccgggcgagcccggcgccgagcgcggcgtccacgcgcagtaggtgtcggcggagggcgccgccgtggaggcgtcgccgggcgagaggtcgaggaggctgcggtcgaacaccgggtacgccggcacgatgcggccgtgcgcgaagatgtcgtcggccggcgccagctcggccgccgacaccggcggcgcgaacgcgaagtcgaggtcgagcccggcgccctccgcgtcaccaacgtcgaccgacgcgggcgtggcctcatcgtcgtcgacgccgtcggcgccgcggccgaagctgatcagcgtgtggaggctgcgcggcgactgcgccatcgcggctgcggcggcggcgctgggtggcatcacgtcgtcttcgccggagacgagaggagaggagatcgcggggtggagtggagtggattggattcgactcgacgcgctcgatgttggtgtggtgtggtgtgtgagacaaggtggttggagtttgaggtttataaagggaagggaatggtggattcacgcgtgacgtgacgcggcgcgggagtggggagcaagaaactactacaccctcggtttcaccgtatattctatatcaaacgtttaatcatcatatcttatttaaatctatttaataattaatatttttattgttattagataataaaatatacgtagtattttatgcatagcttatctttttaaagttttttttatatattttttaaaatcaaacggatgattaaacattagatatataaacttttaaataaatttattttagaacagatagcgtagattatagaatagaaaaagtgcgagctatggaattggattcgatgggtggctagtactagtactagtagtctgagttgccttgcaagggaagaaggcaagggcgacgcgagcacgcacgcacgcacgcacgcgtgacgggtcgcccctcgacgcggggacgcggtctcttccctcttccctcggtagctggctgtcgtcaaggcggccggcaccggtagctaacggcatgagtttgttcttctcttctggattaaccacgcgtgcgctcgtgcgcgtcaaggcataaaaccagcgtaaaacatgttctcactgctgctgccctgtcccaaaataagttcaattttactcgtcgtgattcaaattgacctgaagagaaaaaagatcagcgtctctttccaaaaggaacacggccagcgtttacatatgtacgtgcacactaacaccccatctttttaataagctcttctaagaaactagcatgacatatctaattgacatatcattgtggacggatatatcgtctagcactgaaaaaattagctgtaaatacgagcaactataccaagtatttgtgagtttgtagtcaagggatattactttatggatcaggatagataaagggttataaataacgttattttggaacaaatatcagtctacaaatgaacttattttaggaggagtgcgtactttaaccgtcttatattataatacgatttaaccttttatataacttctttaaattttgatcaaaattacataaaaatataaaaaaagtttaatgccgaataaacacacttgggtttaacaaaactatttttatcttataagagttttacattttttctataaatttaatcgaacttatagaaattgactttttaaaaataggttgacggagctcgtggcccctcaccgggagaccgcgcaggcccccctttgccggttcggccgggggctcagggtgagatctcaagctctctctgtagatgacggcaagatcgctccctctcaagagaacatgaaacacaagcgatgtatacaggttcgggccgctgagaagcgtaataccctactcctgtgtttttgtggatctgtgtatgaaggagctacaaagtgtgagccgacctctccctccttctaggcactcaatctggaaaagaatcaaaagatcccctttctatgggcaaggtcctccttttatacttcaaggggataccacatgcacccttctctttccaaactggacttttcttctttacataaatggacggagatttgcacggttgccttccgaacgtccttctgatgggacggcacatacctacctctacttctgccgggggcaggcgcgtcgtgggaacgtggctgtgtgccgacgacatgagcagtgtcagaccggtcacaaatcggtcattcttgtccaccacgcgtcagcttagcaacgtgcatgtttgcccttcttcacacaacatcttgcctgtaatggttaggatgaagcctggtatatatcgatcggggctaacgtgccatctctgggatgtaacacgctagctccagctggggacgagtgcctagaagctcacatcttgacgggatggggcaaagcgtgcgtcagaccgcctgtcgccacctaacccgcgatttgaccggtctgtgactggtcacagaccggataatcgagtgcactgcactgcacttcgtgcggcgtgacacgcttagccgaggcgcaataaatgcggttaggtgagccctgctgtgctcacccaacctatgtacatagtgcaaaccccacagggggtcggggcacctcggccctcggggccggggcaggaccaacccgaccccccctcggggaaatcaggaggagggcggacacctcaccctcgggcccgacgtccccgaaggtgccaagccacgtgggcgattccatctgcctcaagcctccgggcgcaatactcccggtcccatatcaccgacagtagcccccggcgttatgtcagggcaatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgcagattcgtttcgtctggagatatggtaacgtcgcttcggtcggcgagcgtaattaacgcacacacgatacgatctatctcgactgccacaaccgcatatccacctcatgcgccacaagcgggcgaatggaattagtggaagcgtgggcgcgagaaacgagggagcgagatagcgagtaacgagggagcgagatagtgggcatgagaaacgaggagccgggctcagcgatggcaagggtataaagccatcgaggaaaggacttgctcccttcctttcgccactattcccctttccttcgccgtttgcgccctaaactctctctttgctgcgcctcaccttcgccacacacactcgttctcaaccctctctttctccgacgacatggcacggggctccgctctgctcgacggtagcgtactaccaccttcccgcattgtgagcgagaggcaggctgggctgccgcgccgcttcatgccggaatccgccaccggccgggagatagtgatgctgggcgaggcgcgcccagcaccagattacccggggcggtccatcttcttcctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccggtgttgaaccgctacatcccctgcgccctccgcaagaagtgggacgattggaaaagcgactggttctacaccccccttgccaacgaagcgcgcctccgactcccaaaccagcccccggcgccggtctccagctggcgggcgccagtagatctgggggatgactatgacgccgtcctcgaccgcctggcgggcctgcgatctcaggggctcacaggggccatggtgtacggcgactacctccgtcgccggattgcgccgcttcagcggcgcgcccggagcgcatgggagtacgccgggtccgaggactacatgaggacccaccggggagtcagatgggattgggctcccgatgacttcaagatcgtggtccaaagggtgctgaatctcagctccgtggaggcgtctcttattcctcaaggactcctccccctctgctgcgatccagaccgcgcctccattctgaccatcatgatgggggtcggggcctcagaggaggtggctcctaagggccacgatggcgccggcgggagccgccaggaagaatcaaccccaggagggggccgtgcttctgggccccgcgacgggggctcggggagcaactgccctgccgccgcccgggggaagaggaaacagggaggaacacctcccccatctcctccccgagggggctgggcggtgcgtgccagcagcaggcgcccggagggggccgcgccgacatcacggcccgagacggagcgcaagaagaagcggctccgcaagacgggggagacggaaccatcccggggaaacctgatttcccctctaaggtggtcgttcaaccgaccccctcgcaggttcgtttcacgcctttcacaaccatcttccctttatcccaatcagcaagttttctcttatccatcctgtttgtcttccggtttttttcttctgcttcagcgatgtcccgtcgcgttcctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccggggtcgccaagccgaagaagctgctcgggaggaggccgcccgggctcgtcaggctgaagaagccactcgggaggaaaccgcccgggctcgccaggctgaggcgatggcgtcttccgaggcggttcacgacaagaccgccggcgcgtcgctcgggcccactccctcgggtgacgctcaggcgacaacctccggggcggctcgcgacaaggccgtgggcgcatcgcctgggcccactccctcgggcgacgcccaggaccaaacgggtccgggggacatccccgagctcagtgcgtcttcaggcgggccgagccgcgtcgcattttctccaaggcggctcttctcctcgtcttctgccgccccactgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgcccttatcgccaccaccgcgatgattgaggcgcaggactccctccgccttcaacacgggagctgggaggcggagctaaagaaaaagctcgacgccgcccagggggtccttgacgccgccgctgcccgagagcagcgagcaacggaggctgaagcggcgtcccggcggcgcgaagaggcccttgaggcccgtgccatggcgctggaagatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccgcgacacaacggctggcggacagcctgtccctccgcgaggcagcgcaggaggagcaggcgcgccgcaatctggaatgcgtccgcgccgagagagccgcgctggagcagcgggctgctaacctcgaggcgcgagaaaaggagctggacgcgagggagcgcagcggcggggcggctacgggcgaaagcgacttagtcgcccgcctcgcagctgccgaacacaccgtcgcggacatgcagcgcgccctggactcatccaccggggaagccgaggccctccgcttgtcgggtgagatagggcccggcatgctttgggatgcagtctcccggctggatcgcgccggtcgggaagcgagcctctggaaaggccagacaatttcgcgctccaccaatctggaaggtctcgccccgcaccttaggaggatggcctgggctgtccaacaactccccgaggaactcgagaagaccatcaagtcatcctcgagggacctcgcccaaggagcggtggaactcgtgttagcgagttaccaggctagggaccccggcttctccccatggatggtgctggaggagttccctcccgggaccgaggacgatgcgcgcgcacgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcgcattggaatgagcccccaggcccccaccaatctccaattttttctttttctttcttcttttcgtatagatcaacttaatctgcaatcaaaaatgatgaaaaatttctatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaatgtaaggctgtgcatgtgtggtagcccccggctaaccctgcacacccgaggggggtgcggggttagcccgagcccgaaacctgacacccgacccccccccccctcccctcaggggtagaagcgacgaaggtgttcgatgttccacgggtttggcagctcagtgccgtcgcccgtggccagccgtacggagcccggccgggggacgccgatcactcgatacagaccctcccacattggtgagagcttgctcagtccagcacgcgtttggacgcgacgtaggacgaggtcgtcgacgcagagtgatcgggcccggacgtggcgctgatggtagcgccgcaggctctgctggtagcgcgcggctcggagggccgcgcgccaccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcaatagtcgccgaagagttcactagtgaattgggtgccattatccgtaataatacggttaggcactccaaaacgggccgtgatgcccttaatgaatttaagagcagagtgtttatcgatcttgacgaccggataagcctcgggccacttagtgaacttgtcgatcgcgacatacagatactcaaacccgcccggggcccgcttgaacggtcccaggatatcaagcccccagatagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcattcgccttcatggatatcggcaagaagctcaacgccttgttcctgaggaatgcatttcaggaggattccgttagccgcgcgccgatagagggtcccttctatcagcacatagcgtttggaaatgcgttggacgcgttcactcccttcgcggtcctcaggtagagtcttatctgtgaggtatgcttggatctcagagatccaagcaatcaatctaagggtgcttggagcgctcccttcgggtcccgagacctggactccggcgggcctcgggggccggtcaggcgcatccgtctcccctaaggggtcgggtcgcgccgacggctgggtaagcctttcttcaaaggcgcccggtggggtttgggctcgcgaggacgcgagccgtgagagttcgtcggcaaccatgttatcccgtctgggtacatgccgaagctctatcccgtcaaaatggcgctccatacgccgtacttggcgtacataagcgtccatctgtgggtcagagcaccggtattccttacagacctggttaacgaccagctgggagtcgcctaacaccaagaggcggcggatccccagtccagctgccaccctgagtccggcaaggagtccctcgtactctgccatattattagtcgctcgaaagtcgagacggaccaggtatctgaggacgtctccgtttggggaggtcaacgtgacccccgcaccggcgccctggagagacagagaaccgtcgaactgcatcacccagtgggtggtgcgaggcagctgagaggggtccgtgctagcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacccttcggtggggccgatcctttctgctaggggccgtatccccagggcgttcttcgttcaagtggcctttcggggcgcacttgtcttctgtgccgatgacctcggggtcggaggatgaaaggggcggccttccctcagtggcctcggggccgtcctgggggtcgggggctcctggcatcgtcggacaagtgggcaaagggccaactccggtcgtcaggggcctctggcctccgttcggctcgggggcctcttctccctgctttctcccgggtcgagtcagcacagggttagcctcggggccaaagggcgataggtgcggccttcccgcagtggcctcggggccctcctgagggtcgggggcacctagcaccgtctgacaagcgggcagagggtcgactccggtcgtcaggggccgtaggccaccgtccgactcgggggcctctcctccccgctcgctcccgggccaagttagcacagaatgggggtgcacgaaatgaggattgtcttcatcgcgctccacaaccaacgctgcactaactacttggggggtcgccgctaagtaaagtagcagggactcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttgacctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgacgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacacgtcgcctcatgagtaggggccgcggccagaagctctcgcttcatagccttgaagctccggcgagagatgtgagcacacgctcccccatcgacagtggcaatggtggccccaggttcttggaaacctaggtcatcatcaccgtcatcgacgtcaacagcgggggccttctgtttggcctcacttcgccgtttgccggaaggaaccgccggggacttaccttcccggcgctcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatagactgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgtcgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggactgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggtcctcacgtccatgtcgaggtgacaccctggacgaagaggcaccctccgttgcgcggggagcacgccgatcactacgtcggcgttcgatgtgaaggcgggcatccggctcttcatgctgatcctcccgagtcggaggcgccgacgagggagtggtagccgaatggcgtgcagcagccgccgctcgccgcgccctccgccttgatgacacagagccggtggtggcggcggcggaggtcctggtggtggcggaccgttcaccagcacccaggcgctgctgtgccgtcatgaccaagttggccacgtcgtccagccatcgctgggctggagactccgggtcagggacgacgggcgggtgacgtaggagcgcgccagcagcctgaagcgctccctggggcgtgctgccgtcaccgtagacgaggaggcgacgctccccgtctcgccgctctcctgcatcacctgcgactggtgatgctgtgggtttttcgaccctctcgagcgcctccccccgcttaggactttggcgtggaggaggtgggggagtacgagctcgacggcgcgggtttggctccccgtcgtcgccgctcacactcggagagaggtcgtgcgcctttgcttgctcggccattaggctgaacaagggaaacttggtgcacacggaagagtatgagagctcagaaaacacacgctgagccccctacctggcgcgccagatgacggagctcgtggcccctcaccgggagaccgcgcaggcccccctttgccggttcggccgggggctcagggtgagatctcaagctctctctgtagatgacggcaagatcgctccctctcaagagaacatgaaacacaagcgatgtatacaggttcgggccgctgagaagcgtaataccctactcctgtgtttttgtggatctgtgtatgaaggagctacaaagtgtgagccgacctctccctccttctaggcactcaatctggaaaagaatcaaaagatcccctttctatgggcaaggtcctccttttatacttcaaggggataccacatgcacccttctctttccaaactggacttttcttctttacataaatggacggagatttgcacggttgccctccgaacgtccttctgatgggacggcacatacctacctctacttctgccgggggcaggcacgtcgtgggaacgtggctgtgtgccgacgacatgagcagtgtcagaccggtcacaaatcggtcattcttgtccaccacgcgtcagcttagcaacgtgcatgtttgcccttcttcacacaacatcttgcctgtaatggttaggatgaagcctggtatatatcgatcggggctaacgtgccatctctgggatgtaacacgctagctccagctggggacgagtgcctagaagctcacatcttgacgggatggggcaaagcgtgcgtcagaccgcctgtcgccacctaacccgcgatttgaccggtctgtgactggtcacagaccggataatcgagtgcactgcactgcacttcgtgcggcgtgacacgcttagccgaggcgcaataaatgcggttaggtgagccctgctgtgctcacccaacctatgtacatagtgcaaaccccacagggggtcggggcacctcggccctcggggccggggcaggaccaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacataggtggagcatcctgtaacctgaaatggagggaataaggcccccaacatttggcgacatatttacaaatgaaaagtaatttgtgaatagaacttttttatacatgttcttagcgatcaaaatatatatttgtctttttatctttttgtgtgggggttatttttgtaaatacatgctatctcactaagtcagatccgtttgcccgcatcgagtcagaaactaaatccgctcggctcgcatgggcgatcaccgccactggcttctatcggcagcgcccctaccgccgacagccacaatcgccaccccaccgagagccaaaattggtgtcgccgccatcggaaattgattcgagagacaaggcgccggggacgcgggagacgacgggtgcgtggaggatcggcttctcccggcgccggaggaatcgggagcgaggtgcgccgggaggctccgtcgccagggatgccagacgaaacaaaaaaaagaagcgctaccctattcgtgacgatatccacaacagaaaaaacacgggcaatataatccctattcgtgattaaaaaaacaaaaacaatctcttttttaaatttccaaacaacccttttcagaattttaacaaataccaaatctaccctcatatatactgacgatatatacttatagtagaatgtaccgtaaaagtcttcaatgaaaaactcccaaatcaactctgaatttataaattatgactgataagtataagcataagcataagcgaaaatacgatgatactgatgatatgaagatctcgtttttggttttggaagttcaaaacgatcgatctaatccgatgacgtggtggtcttgaaaattcattactctaaaactctgaagcaatgtgaggagaaaaatacaaaacagaggggacgcagcgttgatggcgaattgacagaggcggaggacatcggacactgggaaaagtgatctgatcttccaacgcgtgatgtactgtatatgaagtttgccagggttccctgcactagacacccatctgtgattgtgaccatcaatcaacttaccaacaggtcgaagctgcactcaattgccatttgccaatccatcgaatccacacgaaattacgcactaccagttggcgcgttgccgcttggctcggctagcttgatgcccaggccgaccgtccatacgtgaacgcgtctttttcagtggacactatggtttctgcacagtgccatcgattccatcctagttgtatcatacaaatccacaccacaaataccaacattgcacatgccacacacgacggaacaaaataccgaagatactagagtttgttcaggcacgacgacatgttaattggacagtacagttgaatagctgatgcatcatgatcctactctgttatactgcaccactatccaacttccaaagctttactctcacatgtacagtacagtgccatcgattacagcctagttgcatcacgcaaatccacactacaatagcattgttgtatttgtacatgccatgacttataaacgacggaacaaaatactaaagatactagagttcttgttcaggcacgaccacggcatgttaaatgtacaggacaagttgaatagctgatgcaccactatccaactcacaaagctaaaactgtgtcactactctcagatgctattttagactaccaggtatgccccattgtaaggtaaggttcactgacacgggtaacagtaccacatcactctacatcaacactgttttgcacagcattcaggcaactcgttttatggaacaagcgccaacggaccactattcttcttcgtcgtagcggtagcggctggcattgtcatcttcatagtggttggcgttgtcctcctcagggttgttcacgcgctcgcattcgtcgatccattcgctgtatctgcgatgaagaagttcgatgagtttcggggtgtgtccaccaacagttcatctgcacgagcctaaatagatggttctcaagactcaagagcaaacttacatgtcgatgggttcagtcagagctgcagaaaggaggaaaaaaaatggtcaagtcagcattattttgttcagatatcaaatggtaagcatttacagaggcaattgcatcaggcgtattgtcttcctaaacaaacctaatcttggacaaacagaaggaaatttctgcaattttagtaagcaactaagagggaattgcgttatacatactgcctacatagtcttgtggagttcttatattatggttatttcttttccaaaaggactagcgaggatgttgcctatcattaactaggaagggagacatgaactcaaatgacaggtttggagggcccacaaaatctagcctgcaggcccagctaactgaacaaagaaagcactaacgacacgtaggcaaatttatactcctgccccaatgcagcagtgcaatactagtacaaagcatgaaaaacagttatcaactataaatggctaagataatcaaaaggtgttggaacttggaagcacagatgctgaaagttaagacctgattccccaaccttttcattttggttttgcagaggcataagttatctacagatgattaaatcttattccaatttattataaagaaatgtaagcatgacgccaacagtaactaaccaaataacctaaagagagaacacaaagcacaattatgctcgattgcaaagttcacaacaggaaaaggggtcacttcaaatactaaaccactgatccaaaacgaatggccacatggttccagagcatattaccattaacagatgtgctaaaagtttccaaacaaattctgcatgaggcctcgccgattaagttctttagatcactgcgaaacacagaagaaggtgtcactgcactgccaaaaactagcacggacagagaaattcaagagaaacaaaaagccaggtatgtgaatggtcacaaaacatacttacatgcgacactcaacactacttccgtggttgcaaaatggacagcaaaagacagtatcaagcttgtccattctcttcttgggaggtggttttgctttggacttcctcttgcccatgattcaacgcttatttttcccgccttttgcacgtagttcaaaaatagtaacaattgaattatattgatgctgtcatatttttgcgccacaaagagacaaagtctccactctcaaaagttacagcatgaaggaaacacatagaagtaaatgatactcaacattgagcacacaatagagatgcaaatcagcacatgcaatttgagatatctcaacattgagcactaatatgcagaacaaacatcatcctatagatttgcaatatttttcaatcaaatcacaaggtgttgttggttcaatgcaacaatttagcatctatacaggcctcctaaagtcacaatctaagttgttggctcaaaatttcaaatgcacagcatatgcccagccaaatgataatagaagcggcaattaagcatctatacaaaccccctcaaaatcacaaccgaagtcaccttttaagaaacctcacaatctaagcatctaacaacagcctatctgcttagcttcgattatcaacttcttctcttttttttttcttaaagaattcactaaaattccatcaagcggttgcacttaaaatagctctgaccgtacccaaaacccccaaaaaccctctgctctgaaattccctaatcaaccccagcgatttcatgcaccgtgagtaaaatcactacaaaattctagcagcctaagcacaaacgaacagcaaaatcacaaatactacctcgcgactcatccgcatctacaagcatacctaacctaaaaacctaaaccccttaaaaaacaaaattccccaggacaatcgatcgatcaaagcgaaacactcagctcactagcgcagcagcatccaagcactccaccccacatcaccgaagagtaaacgagatagatagcgagcaggagagcaaatcctagctacgcgggagggagaggaggcgggtggcttgggttacctcggcgagcggcggagacggagacggagacggaggcaaaacggacgacgaaaccggagtccagaatgatcgcgaccgacccgaccgcaacccgcaccgcctgatttatagacgctgcagctagcagtatgggaggcccattgcttagtgggccttgggcccatgagtgcctggttcgtataaggccgcaattgtggtccgtacacgcgtatgggctggtgtttcggcccatcgtaacggagatggaagcccatgctgactcggtcttattgggccgagatggaaataaatgggcccattacgtcgttcatttgatactgcacgaaacggcgcctcgtgagaaagcgaacagtacgtgatagcgataagtacagtgtcatactcatttatttggatataataaaaaaattggcgtttttctttaaagaaactatggctaattactcatagcttaattacagagattagagacgaaatactgcgaattatcatagcttaattaaaagcaataaagccacttaggctatctacccaaggacacagaataaaaccacgatctatatgtttacagtcattgctttacagtgttatactcctaacttacaatcccaggagtatcagagtagtctgtggtgcccggtagtggtaggtaagtgtgttgttctttagcatttttctatttttcctcttcacactttatttggtcaacgataacgaaaaggctaatactagaatcctaacgacatgatatggctagtatctagcttgatgtactgttgcaatcacagaatataatttggaaccaacccaatcaaatcaatcatacagaatcctatcccctgagttttttttatttgccatttgagtgtttttaatatgcatgtttgatcattatttcttcatgggatcgttactttttaaactaaaatattcataaaatctattaatgcggagtattatttttacctatcaaattcacatccacttttaaaagtttgagtcgatcttgttttaaatgacaaatatttatattcggacgaactaaacggatccatgatcatatgtgttttggttataagatactccctccattccaaaatataatggatttgaggtggatacgacatatcctaataaatcaagtttcaggccctgtttgtttcctctaaaattagaggataaacttttggattaaaatgacacgcttttcaaactgctaaacggttatttcgtgcaaaaactttctgtatgaaagttgttctaaaatatcagattaatacatttttcaagtttgtaataattaaaactcaattaatcacacgttattaccaccacattttccatgaaacacttaattttcatcttcatctttaggagattcaaacatcaccttagagcgagcaggtaaaatagcagactataagtcagctgtaaacatattttaagaagataaaagaggagagataaaagtggcgggctacagatttgtagccagctgtatcacggacttaagacgcatgtgtgtatgataggtgggaccagatattgattgtgtaatatatttttataggtaactattgtatggattggctattaaattgactatatatgatttgaagtcaacaattggctatattaatagtatagccaactactagctctaattcatctatagctaatctaataactcattcatataataattacatactacactattaatacctggtccccctgtcatccacacacttcgtcttggaattcgtgctacagctggttacaaatatgtagcccgctgcttctcttttttctcatttatctttttaaaatatatttacagctggcttatagcctcctattatatccgatgttagtctcctcctgatagaacataaacacaagctcagaattcaataaatccaatcgtgctgctgcctgctggtcaagatacggtgggtggtgcatttccattccaatttccattccactggcgcgcgaggaggtgggtgggacctacccatgattctctgggacccgccgatgagccgccgggagaaatgcgccggccggcgtcacctgatctgatcttcccttttcgtggtgcgagtgggaagcgtccaaatctgatcctggaatcttccgcttttccgctccattacatcacgacggccgccgcagcagtcaaagaccacttctttttttttcctctttgtattttcttttacgaagaaaaaaagaagccgccgccgcagtaggaactaggtagaggatgaccacgaattccaactgcagacggaaatgcagacaccatggtggaaataactgtgtaacctctgtattaacactgttgatttttttttgagtattcatatattttttacatgtaaaaaggtttaagtcacactgtactttaaaaatgtttaatgataaatcaagtcataataaaaataaataataattacataaatattttaagataaaccaaaggctaaaacatattatagtccatagtgtagtaagtatacggcctcatttttttcgtttatatttatgtttatcagccaaaaattaaattttcaatcttaaatttaaaattatatttaatattttctcattaaagtttattttctagcctttgattttagactaagaatgcatatataaattttatttataaattattatttttaaatatgccggatctatagtctaccggcggcggcgatgtggcgcctcggggtgcgaggaattttcctcgcctttccttttctttccaaggcgaagagcactttttggcttcttttttttacccacccttcctcttcttctcttctctcgcccaaccaatcgccttctcggattctcctcctccgcaagcccagccctgacgttgtctcggacacccaaaggctgtgtttgatctccgcccgccacctgtcttcctcctcctgctgcgcgcgcgcctgcttcttcttcccgttgagccagagagcggttcttggtgcaggtgaggcaccaagatctccctcttcttcctcctgcgattcagcgaaatctttaggtaggtaggagtaactccaagtcaatgtttttctttccctttttttgttgttgttgttggaattttcacatgtgtttggcatgatctcgaaacagcagcgatctttgtatgatctccatgtttgttgggatttggtgatgtgatattgtgatgtgattcatcgggatcttctcctcctttttcgtctggtttagatgctgcatctgcatgcgtgctcgctgagaaatcccccgtttgttttcgctcatcttgatctgtgtctgttgctttcgtctcgtcttgtgcagagccggggatggcggctctgatgaacggctttgggagcctccaatgcaaggcgacggtgcatgtcgagaaagggcacatgcaagcatcggggatggccttcttctctcccgtcaacagatgcgcccaggttcatatctccaggtgatcttgattcttgcagctctcagattgtctttgtgtgtgcttgtttccaaatgttcatcagctttatttttggtaggaagcacaacacttcggttttgctgcttacaagaatttaccttttgaaaagctgatgttttaaagtcctcatccttctttgaccctgaattttgcctaaagaagttctcttggggtgggtggggggaatggacgctgatgcttcaaaaatgggaagaacatgattcagctaggagactgagaagtcatgtgaaaattcgtcagtttgtttttactgtcaattttaacagtgtcacctatggcaaattgcaagctttgatggaagattctgaaactgttgtattgtttaaagctgatgacactgtactgattgcgcttactgattctgtagtattcctcatttcatcggcgcgaagtctgttagtgcttcccaacttcgaatgaggcacaaggtcgggtccatcagagcctctgcagcctcgtgcttgcaagatgaaacaacaaaatatttcgattttgtggtcattggcagcggtgttgctggcctaaggtatgctctggaagtgtctaagtacggctctgtcgccatcattaccaaagcagagcctcatgagagcaacacgaactacgcacaaggcggtgtcagcgcggttctatgcccctcagattctgtagagagccacatgcaagacaccattgtcgcgggggcttatctgtgtgatgaagagactgtcagggtaagttcagcatccatcatgaaggcaatggttgatttgtcatctagagcaatatgatcaatgcgtatttccgttgtcctttcctgttataaaaatcacaatactggattagtacattccattttatatttcaggtagtatgcacagaaggaccggagcgtgtgaaggagctcattgccatgggagcttcatttgaccatggcgaggacggaaggctgcaccttgcaagggaaggtggacattctcacaacagaatagttcattctgctgatatgactggaagagagatcgagagagcactgcttcaagcagttgataatgatgataacatatctttgtttggccaccactttgccattgatttactcacctgtcaggttggttaattgacatgttacctcttgcttcattcttgagtgtcctgcgttatagtccttttttttgtggacaatacttttgttgatcctgcataacaacaaaattcaatatataacttgcttgaagtaatgaccctagcttctattagtttggacctaaaaaaatagtctaatggaaactgaactagaagcgacagggaactcgtgataactggcactatcactgtcggcttcctaactcttgtcggtagctgcctcttaatcgtggcgtttaacgtttgactaactactgatagagtcaaatctggaattatctttaataagctgcacgtgttacatttatcttttctagattatccttgtctccactcctattttttaattacaatgtctcaatcacattatgatttcaacattttttacttaatctattcctgagagtacgataagagtatgaacaaattgaaacgtttatattccataaatgaaaatgcatgcgctacataccataaccaaatttgcacatcctattagtagactggaatgacttgactaacaggaggttttctgttgcagagtaatggtgaaatatattgctatggtgtggattcattggacgctgaaactcagaaggtacatcagctgtaattttgcttacatttcctcctgccagatttgtcatgcaatttttacattttctcttgtcatatttttcatcttgaaaccatttatgaaccagctttgtaaatatatgtcctatgtgatatccaggcaattcgtttcatctcgaaagtaacattgcttgcatctggaggagttggtcatatatacccctcaacgaccaatccaccggtatatgatacatcaccctcacaatctttaatatttttttcgtataatggattatttgaaggcattagctctaccttctgttctatatcatgctcattttttgctttgaaacgacaaatatcgtagatgaacaaccaaatacgatgcaccatgtagtttattatttgatggacaataagttgctgatgtaatgcttagtacgatatttcttagactctttgaatccaaacatttcaggtagctactggggatggaattgcaatgtctcatcgtgcgcaggctgtaatatctaatatggagtgagtatttctttcctgagtacacaccgttgacctttgttctcaaaacaaaattgaggatctcctcatccatcagctttcaattcatagcaatagctaccttagaaatcacttttccttctaacttcccttcgtaagttttgaaactttcatctcgtatctgggaaatataaatgacattgacacatcccaaacaatgacaggtttgtgcagttccacccaactgcactatcagatgagggtctcccaataaaaccagctacaagaagagagaatgcattcctcataacagaagcagtcagaggagatggaggaattctttataatcagtccatggagaggtttatgacttcgtatgatgaccgtgcagagttagcaccgagagatgtggtcgcaagaagcatagatgaccaactgaagaagaggggagaaaagtatgtcctcctggatatcagtcacaagccaagggaaaaggttcttgcccattttccaaacattgcagctgaatgcctgcgccacggtctcgacatcacacaacagccgatacctgttgttcctgcagctcattacatgtgtgggggtgtccgggctgggttgcagggggagacaaatgtgaaaggcctgtatgttgctggtgaggttgcatgcactggattgcacggtgctaatcggcttgcaagcaactcactgcttgaagcactggtgtttgctcggagagcagtgcagccttcaatagatcatatggtcgatgcagatgtcgatccttctttcgcgaagaaatgggctcgtcctgtgctgtctgtctcccttagggacagtatactatctgatatcattgagaagacaaagcaggccaggatggagcttcagtcaataatgtgggagtatgtcgggatagtgcggtcgacgaaccgcctgaagcacgcggaatggaagatcagtgatctggagtcagaatgggaggagttcttgttcaggagggggtggaagcctacaatggtgggggttgagacctgtgaaatgaggaacctcttctgctgcgcaaagctggttgtgaaaagtgctcttgcaaggcacgagagccgaggcttgcacttcaccgaagacttcccttacctggaggagagcaagaggaagcctacagtgatcttccctactcatatccaggagctgacatggagctcaaagccattgcagaagcagctgcagtgcaagtagatggcacacccatacaaattacaaagggagtttgggattgcagattccattaatttattaaaattaggctgaaccagcctgctatttgacaataaacacatgaattcaacctggaattgtgagaagttcattggctacaagcctacaattaggcttgaagtagcatgtatttaacaactgtttgttctaccgttctcatatgattcagctgttgtaagatgtaaacgaggttgtgttctgatctacagagattgtagtattttttttttctaaaagaattggcaggaatcaatttgtagtataggatcaaagatggttgtataaatcgattcgattgaagggatagactcccaactcaatcacctgataaatcttggttgttcactggatatttactgtttttatttccatcaatatttcgtatctggcatgtcgtcccagtggtgatcttaaaactcatatacggaatactgtctttgaagttatgtaagtttctacgcaattcagtttctctgattgtaactgtggggattatatttaccgcagaagcacaagagctgatatgcgtgtatgagttttcataattgtacgcatccttactgatttgatccaacatcctcataatctgtcatgtcttcatgctgagagcaattcacatgttacagagtaactagaagctgaaactttgttcatcacagaaacgtgcaacagcccaaaagcattaagttgttctttttataacctagaagttgttcatcacagaaacgtgcaacaagccaatatatattggatataacctagaagttgttccttttttttctctgaagactgaactccaatggttggcccatgattacatatacatgtgcaacacaagaatggctgcaccgaaaaacttagtctaagataggaaaaaggtaacatgctggttgctgctaagagcagctaaatatctcgccggaagagattgtaagcagagatgagggcactgatagcaaaaaccaagaatgccatgaatgaaatggcgatggagctgttcgccatcttcgggaaagggtcgcttccccagttgtcgatccaatcgcctactcgtgcagttgctgatgacgacgaagatatcagaaggtatgccagcacctggagaaatagtagcaaaaaataattcagcatcattctttacttccacagatcgaacaactaaaaatttacctttcagaaaaaaaaaactaataaaaagtcataacatgttgggaaagtgtaaatacctccagcaatagaaaaagaaacaaataaaaagctaactaatattccgtttgcaatttgttcgaaacaagcacacgggaaagatctgacaaactaaaataagaagaagtgtaaactgtggactgtggagcttgtcaaataaaatggtttaacggtgataagaagaatatattttatctcagccatgtattagtctgcaagagggaaaagagaagaactccatcatggaattcatgtgattttggagactgttaatctgagttgcccacccaaacggccaaaccatatgcatacagatgaatttctcttgtgaagaattagatacgatgtgacaatgtactcaaaagtaaaaaatcaggcatagatatatgacctcaaatatagagcaaatgaaggtaaattcagattgtctaggaggcggcacaaacctagaggctatatagtaaaatcaatatgaaggtgctacatacagatattctggccatataacactcaatataagacatgaaaacatgaagcaccaaactaatagaacctctagtcctcaacttcccctcattactaaagatctgtttggacttcagagcataatctttaatggcagaatatgccaaagccccacttatttttcatcatataggagaagatagtatgcatgcagcatgcaacgcctaatcagatgagtccacactgatttgaatgatacaagctcaattcaactactttcctcctgaattactctgcccaacctccaacaaatattagttcaaaatcatactgcttcatgcagattacatgtttggaactgggaaacataatttataattccagtgtaagttaaggcaacctgaatctatacattcggattcatatcaagacaatgagggcataacccatgccaacagtaattgcagaatcaaatgaagcacaaagtagcaaaacagtaatcacaagaaagaaatcttcacaagcttataaagcttatactttgcttcatgacgatgccttcacatctcttctgcatccttttgttcacatcacatcgcatgactcacagttgcacaatcctaaagaaacctatggaaaaaaaaaagagaggaagcaaatggctccgaatcagacacaaacctgatccatgaagaagtcgaagtaatctcctttgcgccgcggattcaaatgcttgttcctcctcatgagatctgcgagcacaaagaactggagcaccgagtacacgaacccaatcacgttcaccgcctcagagtacctaaaccgcacaatcgcattaagcaaatcactaattcaagaaccctaagaagaaaaaattgtaaaatatttcttggaaaattttcgcgtaccgcaactggctgtagttgctgtaggagtcaagggcgaaacccttgcggctgtcggcggcgagcaccgcgagcgccgcgaggcagagcagcgcggccgcaacccgcgccaccagcgcggtgcgctgcagaacagccgtgcgccgcttgcgcaacaggatgtcgggcaccacccggtggtcgtgctcgaccgccctagccggcactctcggtgccggagccggagccggcctcggtgcgggagcaggcggaggcaccagcacaggcgccgctggcgctggaggaggaggaggcggggatggatcccatgcccgcggcggctgcgggggtggctggaattgcggcttcttcctcggcggcggcggggggcgatacggtttggcggtgcggccgccgttccacgagtaccatgagcggccatccccgccgccgacgtggcccgcggcgctcgggggcacgtacttggcggccgccgcgtgcgtctgggaggagacgacgatggccgcggagtgcgggggagaggcggaggaggactgcggcggggtggggggcctcttctcctcggccgcccactcgtcgcccgccgcgctgtgcatcggcgtcaccggcggatcccccgccgcgcccgcgccgcccgccgccgcctccggcgagcggcggggcgacggcgacggggagggctgcgcctcgagtgccattgatttggggggagaagtgagtggtgcggtgtttgctttgcttttgcttggcctactagtagtagtagttgcaagggagcttttcaaaaacttgggcattaagattcgcccaaattcctctgaattcctgggaatttagcagtttttcatgaatttcatgtattctggatttctgttcgtattcatgtagatcgtgtgtacggaggaattttgtgtgttctttttgcagattgtttatatatagtaatgttgggagtatctttttaaaaccaaatgtaagtgtcaaagaatacacgagaatatggggtcatcttttcacaaaacctgctgactatccttgtccgaggaatcaaaatatttgtaatcaccacgacgttaatctaatcgattggacactacacttgagcataagtatagttattctgtactccatttatcagtcgcaactatttctttattttagaacttaatatttatagtgagtttctttatatatttctattacagtttaatttttagcattgattttcaagtcactaaaaatatatttataaaagttttatccataatttattttttattgttaataagtttttcagcttacattcagttatagatgaaacgatgagattgcttttctttttaataaagaataaaacgcacttcaacatttgcatggagttggttgcttggaaacatcaatgttctccccctttgcaactttttgacagtagtgctcaacacggtggacgggcaggacgaacgaggcttttcgatggtttcattctaatcttcttcggtttcatgtcagcaatcagtgtccttctctgcatatatatgttatcatgtgccatacactcacgcttgcattccatcattaaagatgttagttgatattactactaattaatcatctctacataggcaagattaacagatatcgcctccatttgagatttgaccaatctgtcgagctacagtactacacgtctcatctctctctgttttgctccctttcagtttcaattactgtaaagactctccgagggctcctttgaaacaaataaaaattgaacgaatttttgagggttaaattcatagaggaaaaaaaatcctatttgactctttaaaacaaataaatagtttaaaaaattcattcaaaattcctatggaataaaccattttccatgggatttctggaagaacaggtttcgctcgcttgtgttggaaaaaataccctatctcatcatttaccttaactaacactttaccccctccaacacatctcatgatccaatcactaaacactagggaagccttttgcttccagcatctgccatagaaatggccattttattttatcataggacttctcaaagtccaccttaaacagaactcctgattgcttttcatatgaacactagttaaaacttcatgcaatatcactactccctccatgatgttttttttatttaagaaaagtagtttgtgttttctcaattaagtcacctatgacataggttagcctctttatcagtgttcttgttatgattttgaaactaacattaaggagacatattggcctaaacttctaaatttgtgctgcatctttgcatttaggaattaaggatataaccccataattcagtcttttgatatccaaaatcatctgatgaaaatcatcaatcatagctttcagatcattttttatcaccactcaaaagtgtttataaaaataagcagggaaaccaacaggcctaggtgccttttacattccatttcaaacacaaccttcttcacctagtaaagggtttcaacaattccttcttttgatcttcagacaattgtcccatctttttcacctcttccaaagtaaagggtttcaacaattccttcttttgatcatcagacaattgtcccatctccaaattttgtaatcttatattagatctttcaggtggcccaaatagatctttataaaaatatgctattgacggagcgtggggctcctcaccgggagaccgtgcaggcctccctttgccggttcggccggggagcctgggtgaagttctaagctcttggtatgtggaaggttcgcgagagtggaaacacacaagacacgggcgatgtatacaggttcgggccgctgagaagcgtaataccctactcctgtgttttggtggatcgtgtatgaagaagctacaaagtgcgagccagcccccgatcgttctgggatcgtttttttgtttctccctctcccccctctctaagtgggcaaggtcctccttttatatctcaaggggataccacatgcaccatctctccctttccaaactggacttgccttctcttcattaatggacggagatttgtatggttgccgtccgaatgaccttctgatgggacggcccatacctacctccacttccgccggaagcaggcgcgacgtgggaaaatggctgtctgctgacgacatgaccagtgtcagaccggtcacaaatcggtcatttttgtccaccacgcgtcagtttaacaatctgcatgttcgcccttcttcatacaatatcttgcttgtaatggttaggatgaagcctggcatatatctggccggggccaacgtgccatctccaggagataacacgccggctccggctagggacgagtgcttggaggctctcatcctgacgggatggggcgaggcgtgtgtcagaccgcctattgccacctaacccacgatctgaccggtctgtgaccggtcacagaccggataaacgagcgcgctgcacggcgttacatgcggcgtgacgcgcttcgtccaaaccgcaataaatgcggtcaggtgagccccgctgcgctcacctaacctatacacgcggcgcacaaccttcaaggggtcggggcgcctcagccctcggggccgaaacgggagcggtccgacccctcggggagacaaggagggggggcggccacatcaccctcgggcccgacccccccccccccccgccccgagggggtcaggcctcgtgggtgattgctcctgcccaagcctctagttatgatactcccggtcccatgtcaccgacagctataaaactcagcaactgctcttgcccagctatcaacacattctcctgtttcaaacaaaaaaacatatctttcctccttctcccattagctttggcatgatattatttagtgttattatcacctctaacacatctctctccttgcatctttgtaaccattttagcatctccttcctcgtagtaaacctcggttgatcctatctccctctctcttctatgctcacatacaccatgattcttacaccatttatttaactcttctaactccctcactaatttctcctttttctctcttatactttcctttccaattcatattccaacccttaagagctttccttaaatttctaagattttttttaccatttttctatacttaagagaccctccttactatttcataggcttttctcaccacatcatgtatatttctctcaacatcaaactatttttaaacttaaaaggcttttctcaccgcattatgtacatcttccctcaacatccaactattttcaaacttctttttttggtaattgatatgtatccaatggaatatgtacatgatcagaataaatcctctttagacttcttactattattgtaattagataattactctcccagctgttagcgactaagcttctcacactgtattcattagttattataccatgtgataacacacatactcaacttattttgatcaacaattgcattgaacagaaaactctatttattataacctcccttcttatttttctcactttattttctaattatattaaattcacaccccaacactattggataggactgttttttggcaaattaaaacaagttttaaaaactcatcattttttagtagaaccataaaccactatcaaattccaagtaaaaccatcagatttattcattaacagaacccttactaaaaatttctcacaatcttcttctctaacttcaaaagtaaaaccatcagatttattcattaacagaacccttactaaatatttctcacactcttcatctataacttcaaaaactatttcacatccttcatctttaagattcaagaactatctcattgtagtactcaaactatttattttaaaaggtgatattagattcttgtcttatttcattgcttcataaccaccaattatacgatgaacttataatgtagagaatgagaagggtggaaaagtggtcagcaatacaacatgtgtgtagttaaaatattttaacaagaaatcatcacaaataaacgcctctaattgaaaagataagataaatctccgtgactttgcctatctccgtgtgcggtgaatcaattatgttagaaactgttttctgtgaatccttctaatatcccaacctaagctaatttggatgtagatgttccttctccatactcaccaagtccagatatagaagacccaacctaaaatccattgtgtaactacttggcatggtttaatctctcggtccgaaattatataattttatgaataaaatttgatcaattttgaacaaaatattaccaaattcacgaaaaaatgaaataaaaataaaaatttcggccgaaataatatcgtattgggttctaataatgtgaaccctggtcaccactggtggatacttgcacatattaaatgcattttcaactggcaccatagtctcatcgtgtattgtgacttcagtaccaacaaatacaatcccagcacactttaacatatgactcaacattggtatcattctatgactaacccccataacaattgttactaagtgttttgccaaagaatcgatactgaggcaaattgacattttctaactgcaaaccaaacatcggaaatcgggatgtgtgagtcttctttatagttccagaaatgcggatagtaaactgtacaagagttttccttatcgtctatcataaacaaacctattgaaattcaaaattgtactgagatgaaatcacggggatatcaaaattatattaccttgtaacaatacaatgatctaactatacaaacagtagatacacttcatagaattttacttactacataaagacggagttagaaaattataaagagtagtgttgaacttgactatgcacatgactatatctttatatgaatttaggagaccggagaccagcctagggctcaaggtctagttgtcctcttgtctccagttagactgaccaattaatgtgcaaactctagactattacagataagaataaatgatcacatgaaaaccagtacggagcttatgatccttgaagatgacaaatcctagtaaaagtattttatgacatacttatgtaacgatacaccaaacaagatttttatgcaatttcgtaatgccttacgagcaactaatcaaacaaggtgagctaagtagttaatcatccaatagaatgattagaaaacgtgcattggtgcataaaatgtatagtttgtaagatgatacgaatgcacccgtacccatttcactatctccattttatgttcagattatgaatttgaagtgacatgtagagaatcaactggaagaatcaaccgtagttgagaatggtcatgattcaaaaagacagaaaaactggggtgtttagcgaaggaaattaggtgaagtactatgttttggtttttatactcgtacagttagactattacatagtggaatgttagctgattaaacaaaatggatgttatttggccagtaaaatattgataactgccaacctatttataagtgaatgtatcaaatgcacagttgtttttgaacaactgctagtagcatctgtagggtttattccaagtttaaatcaaccataaagagcagctcgagcatatgcttaatgtgtataagttaacaagagtatgttgtgagattatactgttttctctcatgaatgcgcaatttagttccttttttgggtgaaaaatatatatagttactccatccatcccataatatagcaacctggtaccggatgtgacatctcataatacaatgcagattcattgtattatgagatgttccatccagtactaggttgttatactatgggactatgggacggagggagtttttttttttctctattgctcacaggcagcatgctagtgtcaggtttgacatgtagagtagcattactattgtccagtagtgttgaattgttctaattttcgaataatatttctttctagcttggtaggtgtacacctaagtttcttctactgacgctctatagtttctttctagctctagtagtactgttgaattgttctaacttttccattttcttaaataagaatttaatcattttagtagtacagagaacaagtgagattttgggaggatcgctgggtgggtgacaactcctttgataagttgtatccctcactctatttactaacaagaaataagcatgcgagagtgagcgaagtactgggcaatgttcctctaaatgtgtcctttagaagggcgttggtgggggtaacctgaatgcatggtacaaactggtagccaaggtggccttgtttaacttatctaatagtccagattttttttaagatgggaatccaatgggaggggagtcttctcgatgggttctatgtataaggctcttatgtaacataatgtggtaccaagatctttaatctgaaagctcagaattccacttaggattaagattttcctttggtatatcaaagaaagagtactcttaacaaaagacaatttggttaaaaggagatggaaaggaagtactaaagaatcttgattgtcatgttgcacagttggtttggaatgctcttttcatggtcctaggaatacaagtgcctacttctgctgctaatcttctaggaatacaagtgcctacttctgctgctaatcttctaggtggttggtcaaggggcttagtacctaaccttagagatcaactcttcgtgggagttgcagctatctcttgggcactttgacttgctaggaatgatgtagtcttcaatggctaaaatattaactctctcttgcaggttatttttagggcgacacactgggctcgctagtggtctttgcttcttaaagaaggtgatgaggaagccgtgaagattgggtgccaaaaattgaaagttatcgttatagaattctactcaaaatctgggtggaattggagaggaagattgaattgttagttgaaatcttttgttgtgagacttgttctgatgtctttgtcgtccgcctgcctcctatggtggcgtttgcctttgaacttgtttgtaagcctaagtgattgacgatgtaatactggggtgatgctaataggcgcgtacgcgctgcgaagcaaagtcgcagacgcgcagatgctgccagtcccgcacgagcaccttccgagccttccactaatatctgtgttagtgctaatctttagcggtttacactaattgatttttgtaatgaaatgataaataaaatagttgggttgaaaattttaaaatacgaattgaaagtttagttgaaagttttcaaatttgagtgtaaagttttcgaatttgagttgaaagttttcaaattttgacttgaaagtttttgatcttgagttgaaaattttcaaatcttgacttaaaagttttaaattttcaattgaaagttttcacatttgagttgaaaattttcaaatcttgactgaaagtttttaaatttaagttgaaagttttcaaatcttgacttaaaagttttcaaatttaaattgaaagttttaaattttcagtataaagttcattcgaatttcaattttttttcatacactgtgtatataaaatgatatgaagctaatcacgtgagatagaaaagagagacaaaaacaagtcagacgtgcttgcttccgcttctgtgggccggcgtgggcttagccccatgcaccgataagcatctcgcgcatacgcggatgagaatgtgggcctcgcgcgagttgtgttgatggcgcgtgcgcgcccattagcaatttcggtaaaatactgtggttgtgtacattcttcaggatgtagaggctgggttttatttaatccattatcaaaaaaatgagaataatcatggaatattgtttgttttttatcacagacgaatggagtactagccatgtcgacctatgaagctaaagcttagccaccagaatcaccagcagtgatcttgaactggttgtgaattttgtgatctcgaagttactctgcttgcccctgggtgaacagatcaatgaactaccgatcgtgttggagaattagtttgttttgtttctactcctgatttcatcgtgccgcgtgacgcttacaagtcgctagaactgctatttacctctacttacaatttctgaatgttgtcagtgtacgtgtacatacgactttagattgaccttggattttcataaattcccaacacccatgtacttgtagcaaacttagctagtagaaatgaaattttgatttaaggataaggatccatattatccattaattgggtgttacagcataaataactaaactcgacattttacttatttcttcaacatgtagcaatttcaggcgttgtagcagatgctgacgggcggtcgtcacttcctagttcttctccttgtaactgttgcagctatcgacacaagctgcaacatcagcatctgttgcccgtgctgctagccataataacccaaaaaaaaaaagttaagatgcaaacacatgcgagatcgcatgaacacacgttcataactatgagtttgcaacattatcatatattaatatatatggaggagcctgtcaattagtaatttagtattacttttatttttttaatagataacaccattagcttttttcatatgtttgattatttgtcttattaaaaaatttatgtaattataattaattttgttgtgaattgttttatcacacaaaaatattttaagtatgatttatattctactatatatttacataaatttttcctataaaacaaatgattataaatttttcctataaaacgaatgattaaacacatacttaaaaatcaaccgtgtcacttattaaaaccccgaggtaggactaagtctgcagactaatgaaggaccgcataatcttacattctccggttgccgcatccccgatcgacgacgtgcagagctccctgcagcctgcatctccggcgaacaccggcgccgccgccgccgccgtcgactcgccgcctcgggtacagttgtgaatcggcttcaagacgcagcaggtgaagcagaagagcttgcagccagctcgagaactgccttgctcgcagtcaggcaagcagtcatcgtagcatctgccgatctcggactccgctgacgccagctgcagctggcctgacgtcagcaggatgagcagcaagatgcaggcagcagcagtagctgccaccactccattcctccccattgattctttggtcttgttcagtcctgatgcaaagccagaggcagagattggattaagtgtaaaaaaactgaacaaattgctagctcacatgaactgagaagaagaccttggtgaagcttgctgaataattgttgttctactgctgagatagaacctgagacattttatactagcattgagggcttgaagaagtaaatgttctttggagaagttttctccaaatattactgtgataactgatctatcatcctgattagcctagttccacaagaagcattgcttctttgttgcaactgcatgcgcccccaaattccgttctggaaattctgtttctcacctgaccatacttggaacaatgtccagtacttcacatgcttgccagattccaaacatgaactgaattacaaattcagagaaactgcctgacaaatataactcgaaaccattggttcattggttgcagggaactacacgcatcaaccattccccgtttcgagtttgcatactgttgataattaacagaaaccttattttaccatccatagaaataggaagtagctgcaatccacattgaaatacgagtgttgcattttattctaggaaaatttaagcctgggaagcaataattcaacatgcatactactccctccgtcccacaatgtaagtgattttcagtttttacttgtaacgtttgaccactcgtcttattcaaatttttttataaatataaaaaacaaatagttgtgcttaaaatactgtagataataaagtaagtcacaaataaaattattaatagtttcaaaaaattttgaataagacgagtggtcatacgttgcaagcaaaaactcaaaatcccttatattatgggacggagggagtacaaaatatgagtagcatttacttatatcttgagtacaaacaatcgggtaggtacgtatatttagccgtataaaatgggtgaaggaaaaaaaaaagtttgactagtcaaccatcctatccgaccccatgctcgtctgccacgtggcccagtaactaaatgggccgtacaagtttcacttatccaccgcgacatcgaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgcccttcgcgagggcgattttctactgtgcggggggccgcctgcaaatgggcggcgagggggggcatggaattttgcaggcggcccccttgccgccctccgcgagggcgattttgtactgtgcggggggccgcctgcaaatgggcggcgagggggcatggaattttgcaggcggcccccttgccgccctgggggagggcgatttttgcctcccccctataaagcccagcccctcccctgtgaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgttagattttgtaatgacatctaagggcatcgataggcctgcggagagaacatttgagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagaacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagaatgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggctttcgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctataagcaattcaagaacaagcatcttatggatctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgctgatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttgaactcaactttgctttgttttgcacttatgtttgaagtttgctctatacaggttgcgtgtggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacatgcttatttgcgaccggatgagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactactttgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgagcagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccagtttcgcatggtacagttcagcccagatattagttcatttttgtttcagcttttgcacgaatgtgtcaccatgttttaactacacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcggtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccagtcttggagattttaatcttgtatagttttcaatataaaaagatttgataactattgatatttatataaaaaaaatatagagcacagtacaaaatcgccctcccccagagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgttaattttcaaaatggaaaattatttttgtaaaacttttaataaaaaaaattataaataaaaaaaattccgcgacatcggccaatacggcccacataaaagcccaagcttcgtgcatgcggcggcccacagcagaaagtacgtctgacacctccggcgatcgaccaccgggttccgctcgccggcaaagtcgccgttccacgttcccgccgccggcgccgccaccgccggccgtaagttgaatctgcctccgaaattcatcggctcgatctgttttaactgttttagagattatctccattattattgttatttttttccgtttttgtttctgagcatttcttcctcagttcagagctaaccgtgtcacagttactagacaagctgaacgaactcaattttgaatttctagttactcgaggataatctgattaccgagtgataatccacggtatatacatcattatctctccttccgaatcgcatgttagagtagaggatagtgctaattaactagaggatgagataagccgttggacacattcctgcatgcaatgcaaacgcaaagcaagtgtgatccatccatgcgtgaggatcggagtacgtgtttatctgatggaatccgcagattcctccggaatcagcagcgatttctccctccctcccgatgaatcgccgccatactctcctcccctctatataaaccccacccgcgggactacgtcatcatcctgccactctacaaagagcttaattagctagctagtctcttcgatctgcttctctctttggtttccatggcttcttctcgggttgtcgtcgcggtggcgctgctcgtggcggcggtgctcgccgcgttcggtgcgctggcgccggcgtgcgagggcgcgagggtgatgcgcgagggcgccgccgtcgtcggcaagatgtcgagctaccagccgccggtgaggcataagcctcccgtcccgccgtcggggccgtcgcacaggcacaacaagagggcgacagtcccgaggaagaggaagcacttcccgccgtcgggcccgtcgtaccacgatccgcacagctgagctccggcgatcgtcgtgcgcggccatggaaagacggccggccagtcagcatctctctctgcagtagcttcattaattaattgatttaattagttaggaattataataataatagcaggagagattatctagcttaattgttatttccttcttttgattagtttggtaggttaatttgaggtgtaatgcaggtattgttaattagcatttcgtatagaaatgcgcatgatacatgcatgccatttagtttaatttttagatgtttctctacgaattattcattttcttaaataaagttactttgcttattaattagttattaattgggttaaatctctactatcttaaaaatggagtcgttcttcttccattctctcatcctacatagcacatactaattacacatggaggtgagaaaaacattataggtgctgattttaactgtttcggcacctatagtgttgatctctatatatattttagtagtagtagtgacgttacacggaatactggtaatattataaaaatctcatttacgatttaattatttgccctcgtaatattgaaacactaattcatacgctaattcatgtatctttggagacgatttctgccgaccgttgctactcttaattaaaatgggttttctaattgcatctgaacaaaattcactcagcctcaagattaatttctttagtgaaatgttcacttaaataagggtttattttattttcatcactagcaaaaataatagatgaaacaaattatataacaatccgtgacaaatcttttaaaatgttagaggattaatttttatggaaactgaactaattcttatgaaaatcatataacccaaatatttctttcccaactagcaaaatacccaagctctgctacagataaaatatattatattataatatgtaatagacaaaataaaaatatcaaatatattattatcacttatatgcatgtttgaatatatggtattcacgtgttttaactaaatatttaaactattccataatattagaaaatatcaatggtaaatttgtaaaaagttataaacagtgctggcgtgacagacttttaaatgagcatagatgtgacacgatccaaacatttttttaaaaaaaataaaataaatacacccacaccgccacacgaggtcttgtgcacgtactagcctgcaagctgctatataaatataccacaaggaagcaaagagaactgaggcgcgtctcgcactcttgctcccttctccctcctcgactgatcactgatcgatcgatcgatcgccatggctcctccttgccgccgtccgtacgccgtcgttgtgccagcggtgcgggtcgccgtgcttgtcgtcgtcgtcgtcgtcgtcttgctcgtgctgctctgcggaccatgcgacggcggcgcgaggcacatgctgcaggaggagagtggtggcgcgtgggcgcggcggtcgccggagcccggcgccgccggcgtcctgcaccgccggacgtccgacttcctcccgccgtccggcccgtcggagcggcacaacgctcgcctcgacgccgacgtcgccgagcgcggccagagctcgccgccggcgtcgccctgacgatcgaccatgtgtgcaagctgctcatgaatattaatctactctctcctcttctcttctgattcagtgaaagtttggaaatatatgtgtgaattatttcagatgttttctatcccgagtgtgataattcagctggattctactctgtcatctgtccattgaaagatgtatatatatttgcagagattcagagaccaagaatgtctggctttctgaaacttcaaagatgtttattcttggcagagataagactgtatttggttgatattttgttcatctagcatgcttgcatagttgcatgaaactatggaacatttgttagtttaattctgtcctattaagttgttggcattattgtagacttgctgcacatggtggagtggttgttcagttatgtgatacatattcaagtaagctagatatcagcaggtgactaggtcttccctgtgcatcatctagtcatgctgctctaatgattctatcctgaactagatagatagatttgatatgcttaaatgatgctcaatgatgatgtaactgttgcataatgcatatatacttgcagttgtattagttaaaaaaatgctaaaatgttgtggattaggctctgcatgtagatcgtgttggtgtgtcactggccagagcttgcaacagatttacctgctcccactcaccacttttgcacttcacaccagtatgctgcatgtaacctgtatgcatgcagctagccagttccccccaactgaatgctagaaatgatatgaaattgcacatgcaattctgggataatatggcatgcattgacataatttaccaattaccattgagatctgttgattttgttctgaaacggtaatatggtactaaggtaaaaaagtgccagattgttcatatggcagatagagtcatcacacactgccaggctatgaggaaaatgcatgtacaacaagccgagttgccaaatttggcctcgaattgacaaagacaactcatttctccaagcttgatgcttttggaagatgatcaataggtgatataagctaagagcctagagtatcagctcatagatataggcaaggatccatgatactgatggtataaacagttattggaatttggaattgcatcaagatcatggccggctgaacgctggttactgatgccctaggagagcatcctggtcacattatctgacaactcatagacaacctcttccatgtcctcagagataccattctccttcagagtgaaaaaaaaaaaggcaaagtgaaacagagtaaaacttagtcagacccacaaaaacaaagatacgagggaaaaaatgcactgataatttactcataagatttaccaagtgtcaggctaaaatttaagcactgtcatcatactggcagtaggcaaataccttcgggcctttattccctctaatgatgcacgttgaagcactgatactagcactctttaaatagatcttaggattggagtttagattgattatgccatttggataagcagatgcacgattcttgcccttttcttgtgatcttgggggacttatcatagttcgggcaatagaagatatcgctctcctctcttcattgtcagagtcttgattattgctatctactgatgagcatactctttccctgtcacatgattttttttgtaaagaagcaagcagaacaagaaccacataagattctctgttcagataaaaaaaaggattttaggcaattttaagtttcaggagctagtgaattccagctatataccttggcaaagacgcatgctgtctccgcaagggggtacttctttctcctctgctgtagttctcctcaagatgagcaaactgccgtttgaaacgatcaaccccactgtaaggagttagtattagcaaaagagacatggataagggtgttggttatatcacctgccagcactatcagcatgaaaatatatacaaattatgttttttcactatcgtaaaacaatcatattccccggagagtagaaaataaagcaaaccagctaggtatgaagaaataaagcaccaccgaatgaacaatactttttttaaagcacgccagcaaactagatttaaaaactaatttgctcaccttggatagaggaagctaatttgttctccacctctgatgtactcctgaagcatttggggatggtactctaatatctgtttactttcagaaaataaaaaagtaattttgagtgagatggatttatcagccagcccataacataaaatggagcggtagctttgtacctctcgatatatcatttctcttacatcatcctttgtcagtttccttcgctcaaattcaaactcaaattttgaaactggcagtcttgaaggctcccggctcaacttagaaattcctctaaaatatggatcagctaaagcctaaagtaagtaggaaaggttatgcttactcatcagaaatcacttgtgaaattaattggacataaaataagagggaaaattggaaccatgccattataattttgtaaaatttgagatatgccatcctgacccacacgtcattgactcatgtgggtcttacatgttattgagataccgatggcatatctcaaactttacaaaattataatggcatggttccaatttacccaaaccttttccaccaaaagaaaatacctcttcagcagtaggtcgatctttaggatcaaatgcaagtaaacgctctagcaggcgcaaagcgagaggatcagcattatgaaacttatgagaaaaggggataggatgtttcctctgcatgccagttaaatatcccctggcattctcattacgaatctgcaggtgttatattaaatattaaagaaatcattgcatgaatactcatgtgtctctgcaagacatgtgattagaatagcagaaatcacaattacattactagacaggaaataatttactgtgtctcagactttgcaatcaaatattgatgaacaaggaattctgtggcataatatctacaaagagggaagtctgtgctggtgaagttcttctatgtcacaagtagtagagcaccaggaattgcatttcattgccagcaatagcacagaaggtaatatgtctcgcatgggaaacaatggaaaatagcaaactcataagtaatatttctccttcttgtgattgcgtgataagctggcatacccgtgataaagtttcagatgatggagttccaagtagatctgttattagatctaactggtgcacaacattcctcccaggaaataatggtcttccggtgagaatttcagcaaaaatgcaccctatactccaaatatcaattgcaggggtgtactgtacaaacaaaatcaactgtcttcatgaatatgaaaatatgggaatatatctttctcatcagttttgtaaaaaacaaatatgacagcgcccaatgcaagaaggtaaatttagcacttctcattaagggaaatgggtgatactgtactgataaaagcctaaatacgtctttgtatcttgacacaagaagttgtatttggagaatttgcaactttttaagaaaaaattatatacaaatctgaaggacttgcacatttcaggaatgcacaatgtgttacagaatgaccagcttactttggagaaaaaagaaccacataattcaggagctcggtaccaccttgttgccacataatccttcaaattgcaaaccacagtataagtctatgaaaatcttacaggggaaattatgttatagagaaaataaagtcgtacggtccaaaaaattgttgaaggtgaatcattaaatgctacacgtgcaagtccaaaatcacaaatcttcagtttgcagtctgaattggccagtatgttctttggctttaagtcacgatgaaatacattagctgagacaagttaaaccatatatcagaaactcagtaatgattaatggttgaaatataacttccacaaagtatacagatttggaatgaagtggctgttggtgacaaggttaattagatgctaatttcatcactaacctgaatgtatgtacttgagagcacaaagaagttggtacaagaaaaaacggtgatgctctgggctaaggtcatgatttgcttcgataacttgatgtagatctgactccatgagttcaaaaacaacataaatatccctgaactcccttcgggtaggagggagcatgatgtgcttgatcacaacaatgtctgggtggcggagaagccgaagaactttgatttcccgcagaatgcggatggcatctgaaacatgctcaaaaacatcattgatcttcttgattgcaactctctccccagtgtgagtatctactgcagcagcaactactccatagcttcccttgccaacgacctcttgaatctgatattggcttgcctccccgtattccgtaaagaactccatgtccgatgttctctaaaacatcacaatttcccaaaatcatatagaccatcacagaatagaaaaaatgtgtatagagcatgtgagggaacattttaggagtcctcaacaatccagtaaaataagacaatcaaaaggaccaaaaagaaagcaaagcagcattgcaaattaatcgaagttgacataaaataaactgaaccagaacaactgataatttggaaactgtaatggcacacatcaatatggcaaaagtagcttcaagcaaatgacatgcataatcaaaacataaaaacaggaaaggaaaaatgttattgatcgatgtcaatggtcaagatcagtaacaaacatagttaaatcagagcaatgcagttaagtcaaagcaaaaaaagatctacatatagatgaattgtgttcacaagctattacaaaataaggcaactagaatcaggtggaaagagaacgagaacgagttcagaccaacgatcgaagatgtaataaggtgattcgaattaggtgggtcgtcagtgttccaaggccaaaaatgctgtccggcaccgcaggaagcaaaatctgatttgggaagaaaaaacaggggtcggatttctaggtataacaggtagctgcggtcgtaggagaggggggattcgaagattatcgaagaatgaagaaactaggttaggagttcggagagtggggaaaggggagggataggcaaaagggatggatttgtccaaaaataatgtgggcccacatcaatttttccctcaccagtatgttgtgcacccttctacgctactagctccttgcaccatattgatggagaactaattaaattaaacttgcagcttagataaatgaaaaagagtaaatgtaacgtaagagggatgtatctttcatcagaagaagacatgtagcataaaaaagatttggcgaacacacgttgatccaaagaaccctaagtgcctaaccattgcacaattccattggttcatatcatctctagcctccatgttagagtcattagacctaaacaagaatttgaataaaattctaaaatatttcgacattttacattggatagttttgcaaaatgtttcagtttgtaccaatcaagactggatttctttgaagatgtgtctacaaagagactgcatgcattgattcaacatccatacagtggtcaggatgcactatttctagctacaacaaaatgtggaagattaagtaattttaatttgtaatgttataacaatcaactctgttccacatgaacataaaatcaatatcatagttatcaccatgtaattatcgtgcaaaaaagaaaatcaaacaattggcagatcattattaagagtgcatcaaaacctttaaagaacatcaaggctaaattgaaattaattgctcaatctgggttttctaatacatctatataaggattttatgcaatatcctcgatactaatattagaattttgaactttgctaatccaaacagttagcatgagtatgcaatttatcactagcccactgtaccgcccaaaaattatgcttttcttcacaattttcattcatggtccaaaattctcgtggttattttggcgaattcaaagttataatagacagatacttgcactcaagtggacaagcactacgccactacctactattgcatcatccccctgaaaagtcatgtgttgccttttcatttatcttagatatctactatgaactaaggggcaaacatccattcttgatgcaaagaaactggcaggtgcattattcctaactatcgtcctttccttatttacatccaactctgcaaccatatctcacctatcatgaacaaatatctcatctttcatgaagctcctaagttcccaggtcctaaccccctacacggagacacaacagcaaatgctgtttcttgttgctgccaaagcagagaacactacaccctgattaccaactaagcaatagtcatccaatcagattgcagcagagagtcaccacccccttccacaaagcttcgatgtggcatatgaacaattgaaacaggatgcattcctcatccacaggaagggagatgatttgagcatgttaagctccacagcttagaaggttgtgagcataaaaatcaaaacacatttgatgcagtgatttataaggtaaccaatttacatatatgtaaggaaatggagatcagagttgcttaaaaagaacaaattaactagtcgaaatagcgtgaaggcaataacacaagagaagtaactagtatataccttgctcaataacaaatgagccccacatgaaggatcattagagaaaggaagtacacgattagagttttgaactgcatcgatcaaaagtaatacaactgcccaagcatttcaggaaagtggctgaggtaccttctgaatgctcatggtatcaacagaaagataaacagcagagcaagtaaaaatagcaaaggccagcatctatgctcttctccttataattatcatgggcagagtgataaagtcagatttcagccaaacaaaaatgctataccctcaaggtcaaacttaataaattaagaagttggatccaaggtgcaatcaagatttgctatcagtagaatctgtcactgccaacgacatcagaaagacaaggacaccagagcttctgccgaactatccaagcaaaaaactaaatggaacgtgtacggaaggaacttagaacacatgagataaatttgacctaatgaattaatataataaaaagggacacaaaggtttgagctccaaacaagaaataggagaagtgcaccttcgtgaagcaagcaacagctaaaacctatcctgtgaaattgcatggtcagaatagccatagcccaccacaattgacaattctacagaataattcttttgccatggcacggtaagaatatattcaagcacttggaaagcacaagcagagcgggagaaaagatcatcctgttgcaaaataccaacaccagaagccacctaacagacagaaccaccaggaagcaaaattggaataaagcatcaaccaaatccacttgaaggcgagtgtttttatataaaaaataagagcaattctacggtccttgaggaccatgagatactaaaattttagtgtaaaatttggtatctcatggtaccttatagtacctaggtaccaagaggtaccaaatttacaatagaaaaaaggtacctcatggtatctcttcaaggaccgtaaaattgctcataaaataaacaaagagaaattttggataagaatagagctgcgcgatccttgtatccaagaatgaaaaacagtgtggcttttagcgaagaaacacacaagacaactattcttcgaaccaagaacccatcaaaatcataccggaaataagctttgcacattgtgaatgggaaagtgcatattttccctacaaggcccactaccacatcatgctacaaattgctcgagctagaaggggttgctccaattgctaatagcatcaaagaaaagctaaggttcttacttgctaccactgaatttgaaggaattgttctgctgtgccaccaccaccacctagaccaagggaggacacatggtaggaactaaaacaagcagacagattgccgtggaacttgaccaacggaagaaacatggctggcactaaatcaaacagtcagattgccttggaacttggaggcaatgccacacgtcatttttttaccgaaatttcagagcaaaagcggggaagctttagaccgagtaaactcccggcgcgaccaactgaacacacaccctacaagtcaaattcgatcgagttcacacccttcaaccactcaatcgcatcgaattctcgtgaaaaaaaaggccagaagaatccatgaaaatggcagagacgtgagcttccacccatcgtacagcctgtcaattgatcaacccggaatccgagaaacacgcgagggttaacagcatcaccagttcaccaccacacaactgacacgaggcgggcaggtgtgaacacgaacctcgttcctgagctgggcgtcgggcggcggcggcgagttgcgcgcagggacgcggatggcggcggggagcgcgaaggggcccgggaccacctcgagcccaccgtcgccgccagggtggcgcgccagggaagacgagcgcaagggctgataggcggaggcggtgcggccgcggcggcggcggagccatctgcggacgccgtcgacgacccctcccccggccatggtggtggcgctgctccggcgacgccaagcggcattgcggaggcggcggcggctgctcctcccccggggttttgtacgccgccgcggcggggaggaccgcgccggcgtctcgcgccctcgtcgtcgtgagaatcgactgattgactgacgagtcgtcgctgcggaaaaaatcggacggttttgggcgagtattaggctcatggacggatgcgattgacggagatgcctttctattatttttcttttttttaagaattatacggtataacgagacactcataacacacgcacactcgttcctatgaacgcacgcatgtaaactctaccactatgagtatctacgaatactagaccggtaaatccttaagattaacgaagtaaccacagacacttgctagatcaaagaaaaaaacatatttctaaaattaaacacaatttatgaatatagacatgcaaatgtgcaattgcaagcatgaaagacgtataatgatgtcatttacttctacatagataaataaatagacaacataatagcatctacttctgcacacaacgaacggacatacaaaatcctctggttaaacgaacagacaacggttagacgatcatcaatttgataatacctcaaaaatctcaagggataatcaaattggaatggagggaatttttttttctccatcacacaaaagaggtatggcacacttaccactagacatataacaccgcaccctttttttaaccaagcatgcaacattattagtttttattttgtatatgaaaagaaaatgattccctcgtttttatacgaagttaaatatttttgttttcaccaccaacttttagaaatttgtgcattaaaaaacatttcttatggccttatgatattaaactatatgattttctaaaatggatagtcaaatatataaatatttgacacgaaacaaatttagaatgacaagtaatttatagcaaggggaagtacatttttacttttttcttttacattcttattatgatccgcacaagttttaaatttgataggttatcttcgtaaacaaaaggttgtcaaatcttgagttagacttgatctaaagacaaatatcatccactgaaacttgattagcagacacaccactcagtaattctccataacaaatcgcattcaagcagactagcacgcacaaatccaaaggaaaataagccacgactaggagtcgggcgtgcatagaacggcagatgcccccatccttcaatcacaaactcagaacacgccaaaaacgtcaggggagccaaagccacttgggcacttggcttgacaatatccataacttacaaacattgctcgaattcctggcaaagaaatcgaatcaatgcttggtgttcatattgcctatacaaaatcagatcagggcaaaagcactagtgcacggaatctgcctatctggagacaagtagttcacccttggggagtttctcttggtggatgtacaaaattggcagcagctgattgggttgacacagcttcacgctgccgggatctgatgggtgcagcggtctatttcttcgctggggccttgtgaagcttatcaaagatgggatgtctcaggacttctttcgcagatggccgcctcactggatcaggatccatcatggactgaagacaagcagaaagagaatgttaagttgcatgtcggattgcctgttataggagagcagatgcttctgagaaacattatttgaatttgcaccttcagcctaccagctagtagctcatgtactcaaaggttggtacctcagtacgcaagatatttttgcataaaatgcatatgagagcacattatgcttaaatgcttagttgaaccaaaataacagttagtatcacacatgctacgagtgtgactagacgtgttgggaaaaagaacatgataacaaaacagaaagatttaaccaaagataaagttaactggaactaaaaggcagaacaaagtagtgacagaaatgataatcatacccaacaaaagaacatttcttgtcttaaccaactatatgctaaaaatagcaaattgtactagagcagattcagcaaatgactatttaggtgttgttgattttagaaagagatacagaaaggccaaaaacaggccactaccatattctatagaaatcactttagtgtatcaaaagtgaccaattaatacttcctccgtttcataatgtaagtcattctagcattgcccacattcatatggatgttaatgaatataaatatatatatatgtatagattcattaacatccatatgaatgtgagcaatgctagaatgacttacattataaaacggagggagtatcatattctacaatgacttcatcagttggaaacttgaaaatatatatccaacgtcagggtgcttcactgcttatgtatcataaactgaagcagtatatcaacaaatcagtcttttagttgtggaaacagaaagtctaacacaggatgagaggaagactttcccttcaaacaaattaaataaaagaaatgaaaagataagaaattcctggaaatggagcttctactccaacatggggaagatactgggatcgtggcaattaaatgtgtttcctctgatataaatagaggcaaatcaaaataagcagggacagacaagttacacggtgttgtacctttattaaactctgaaattgcattgggcatcctggaagcaacgcaatttttccctcccggagacttgtgaactgaggtccagaatcaggaagctgggtacctcttataagttcatagatagctgccccaagagaaaagatatccaccttgtcaagatgctcatacttgtcgttcagcatctctggaggcatataacgtgaatctccatcttcaattgccaaactccgatcaataagtgtagcacaaccaaaatcaccaagcttataaacaccatttctgacatatatgttatctggcttcacatcaaggtgtgcaataccacgttcatgaatgaagtccaagcctttgcagatcttcattttcacaaaattaagtttaatattaataggtgagatacacatggaatgtatggagaatttggaatgcaaacaacacatgattacaaaagctggtctataatgagcttcagagaaagacaaacactaccagcacaaagtatatgccctttcccacttctacaagaattctctccaacactaaaacttgtgcaggtaaatagtatttgtgaactgcctcacgcaattagaatacaccctatattgtggctatctgtataccatagtaccatacctccattatggagattaggcttcagtatttgtttgaactggatgacgcccatcaacatcaagttgaaatatgttacactcaccaagttaaaatagaagatctaagacctgtttgtttactctagcatgatgataagtgttccattttactttccaactgcatgtgttgtataccgtgtttgtaagaactaagaacccaaaaacttgcatgttttactcccaaagaccagaacatgcaccttacaaacatcatggtcaaataagagcaatcaattgctaatgtaagtggataacagcagagaataaacattatccatgaataatttgagccttcagaaagtatttaatatatgttgcagaaacttgtttggatgaattacgacataatattgttattatatcataactgcaacataacttagctacgcgtactgatccaatgacaaagaagaaacaaaatgaaccagtaaacaataagagtaactattgcgtacctggtacagcagttccagggcttccccacatttcagcggctgatttctatccatggacaggcagcggtcacacagttccatttgaataaaaagctgtttgttctcaaaccaagaagtgaaatatccaacaatgttctcatggcaccctgctaagacatgtaacagatgttataaccatgtaagaaatatagctgaaaatgaggaggttatagttaattttgctacctaaggctgccaaagcttgaacttccttcactgcttgcctcctgcaatgagagagacaacatacaagtatgcaacattagtttttcatggttaataattaagcataacgactgctgcaaggctacctttccctgtcattatgcagttgcctgatactccgttttactgcatataagcagccatctatcctcttcagaactttgaacacaacactgaagtttccacgtccaatttgctgaaaatcaagtgtgctcataagcaaaaccaacataaaatggaagtgtataacctgacacagataaccaatacatatccaaacttccaaagcaaacctcaatctcatggaaatcagttcgatagcgtgaaaggccatcaccatcaacagaaggagaaaaccctgcatataaaaaatgtgtattgggagatgtaaggctacacggtactgacaaacagataaatgatagttttgaggggatgtatcgagatgattatgatacaatagcatacaatgcatcaaaatgctacctgatgatttgcattgtctcccaccaaaaacattatcatctatttgatgatctgtattgaggtatggattcctgatgcatggtggaggcatcacccggcagcgaagagccactgccgattgggagacataactacctctcttgtgcgaactagattccttcagctgttcctcctctgaatcatctagaccttcaaactgaactggagcaatccactggctatcaaaaatgtcattggagccaaggcctttgggggaacaatctgtaagcattggcacacatccaattatacagagaataaataaacaaagggagcatatcaaactagtataagtgaagtctcacctctcttgtatctcttgctcctacagactgatttctctggagaattggggcaagggatattctcctgcagatgaccacagaaacggacaaaaaaaatcagcaaaaattaaagtaaagctcaatatccatttctaatcgatcaatctcgcatcccagaaactaaagcgccgcctttcccccaatacccccaaccttattggcgtcgaagccgctcccgagctgcggcgcatctggcgtgatgtaatccggggtactgcagaacagcaagcaaatagatgaagaaatagggttaatccaaccgcactccaccccctcaagcacacgaaagcacagctcggagccggatcgggaaccctaccagaagaaatcctggctgaggatgccactatccttctcctccacgacctcgtcggcgtccattggcgtggcctgcggctgcagcggaggtaggggcggaggcggggtcgggtccgggtcgcaggacccctcgagcagctcctcgaagggcgtgaagggggtgcgcgccgcggcggcgccctcgcggggggcgtcggcgaggaaggagaagagggagacgtgctcgagctgcagcgacagctcccccgacggcgacctcccctccctctccctctccctctccctctccctctccttccccgccgcagccgtggcgcggcgggacttgccgccgcgcggccgcggggtcttcgtcctcagcatctccccgccgcgaagaggagatctccgcctccaccgagctcgccgcagccctccccctcgtcgccgccgcgtcgcgccgcctcggcttcgcctccgccacttcgagaggtgtgtgggttttggaggagacgaaatgtactactaccagttgtagtgggaaggaagaaaaaaaataaatggaaagaaatggattaattaaaaattgaaatgcgagcgatttggcggtggaattggcgggaggagggggtggggggttcgccaattcgaggggtggaaatggaattggccgcgtggcactcgttttttctttctcgatttgggcgttggtcgcatgggccaaaattgcggcctttgtcacatttgtaaggcctgcgaaacgaaaaataattgggccacaatcccgggcccttctagggctttttcgggttaatccaaccccaagaaaattaagaaggattttgagagatataattctacacctatcatgtgtagaattatttcccctcaatcatttttccttaaggattaatccaacaaaggctatgaaaaaagagctagagtttcgcctgtcataaacaagggctaaccgtccgaagcattgttcggttatttagggattgcagggtttaaattatctctttaaatcccctaaattcttttgtggtttggattaaccgaataagatcttatgggtatttaggcccacatatcagggtcattatgagagcccaaacccatgatgtcgtcttatcgttttgagtacgtatcaaagataactaaggtgtgtttcatttttacatacgtaattgttatagaagtattatttaggccatagttctaaaaggattatctctaaaattttttatatcatactttctctgtctaaaatatactcccttcgttttacaatgtaagtcattctagtattttacatattcatattaatgttaataaatatgggaaatgctagaatgacttatattgtgaaacggatgaagtatatagtagcttaatagtaggtggggcatcatcaagtcctacgagtctagatagcatcctgcccggattgataacatttggaaagggtgaatagataacttttttaaagttatttattgtttgataacaattaatttatttgtatgagcaagctttgtctatctataatctacccaattatctggttagaacaccgttatcttctagtgtaactattttcaattactacataggatacgcatatgtagctattgggaaatcatgccataatcaggttttgcaaagtcgcacgattatcatgtgcggtaatcttctcagttcttaaaaccgtggtaatcctcacgacaaccacacggttttcacagtaatcgcggtaaccgtcttatcgtgggggtgacattaaccccatccaaaatagtttggtgaactccgatcgtaacgtaatttgtctgttcaaagagtaaagttttttttccttcatagaagatatactacttagctaccgtatgaatcaggttaaaaatccctgtttgggaaacatgggtttattccaagtccctgttacatcggatgtttgatactaatttggagtattaaacatgcattaattacaaaacccatttcataaccttgaactaattcgcgagacgaatcttttgagtctaattacgcaatgatttgacaatgtgatgctacaataaacttttcataattatagattaattaggcttaaaaaattcgtctcacagattagctctcatttatgaaattagttttttattagtctatacttaatactctaaattagcatctaaacatccgatgtgacatggaagttttaacccccatctacacaccaaccttcgtggggcaacatcgcagtgactctgcgtcaacgtagtaccggggtagaaacaaacacgtccgccgccgggcgccggccagaaaaccggtagaaaagggaaccgacgagacgagacgagacgacatccatccgcgcgtcggcacttgacattacacgcggacaccgacaccgcacccaccaaactgcccccagaattcgtcgtcaacctcaactctgcacacgtttatacgcccaaacacctgtattctgatgtattttaagcctcaatttaaaatagattattgactaaattattgttacgtattagtatctgctaaattgtagtgatagattatatattttggtaaacaaagttaaaaattaattcaggacaagtggcctaagcggaagaaagttaaaaaaaaagagtgtttgttgacttgtaaaaaaattagtccgtttcaataattcgataaatagtatgagaaaacaatacgcataaatttctaaacagccagctcccaaatactagttaggtagttgaagattatattagttgtagttgttaggtacatgcagcaacgtgctctcgaggaaaaagaatacatgcccgatcacatgaggaagcgtattattgtagtggtatctgtgattccatggcctgtacgttttctttttcctcctttctgtaatgcaaaaactcgcaggggcatgtgaacctgtcggtgatcactgctggtggatttttttttttagataatgtagcggtgatcactgctgatgatggatggatactatgactctataagcctcataggttacccattattattcctaacaagtcaagacgtcttattaataaataaaagctaacttgtaaataaaacttttatatatttgtccgtagcgatttagaaaccaacgctaaaaattatacattgaatcttaaaatcatgttcgaaaatttaaaaatttactcttgttctgacttattagaccgaccgatgtttcaagcacgatagaagaggggaatggatgatggatcattagccaattaacaacgttctatcagtcgccttaaatacctagcttagctctcaccatatctcgtgtacagtagtacgatcagacttatcagaattaatgctcaagactcttgacgacgatgtagcagtacaccatcattgttgttgttcttgacagcttaagctaccattaggttgaactgttgaagtactgaaccatcagatctgactaaagcagagtgaagcggcagacgcgtgtgtacgtaccatcccgtatacaagatcgtgtgtgtttatgtacttgattagtatcatctatctaaccttcgtttgttctgatgcacttatcctcttttaattctgatcaaatgcacggcaccaaatgtggcaggcaagcaactagagtacatcgactgtgcagatctaaaaggacggataagtggataaccttgtactgtacaatatataagatatatagaaaaagtttcagctaaacatctgggcctcctttgaatggaacgaacagataaatggaaaaaatatataaaattttgacagtaaatgcaaagcagatgattaaaaacacacggaaaaaaataatcgttcgaagaaaaccgtagaaatcgaatgagacgggaaattcaaatgaaatttgccaacacattagagattttgctagtttttctttcaaaatattaatataattgtctattacatagaatttttaaagtaatcgataggactcaatccgtgcgtttcaaatgtcctcgtagaaattttttacaggaatgaaatactcaaaaatatcatttattttttacaaatcaagcttgtctgaacattataggggacgaaggaacgcacaaattccgccattttattctgtcatgtctgatgattgatgaatgatgaagatcgaaacaagtgtgaaacagaagacaatctttcatacatccttcctattttgttccatacttccactcggtttgaatgaaaaggcactttttaaaagaaaaatatcctcccaaaatagtgccctctggtagcaactttattgactcgttattatctcccctaaattaatcacatgttaatcaccaaagtactggagtactttacttctattttgagatgactgatgcgatgcgaccaggtccgggatcatcacatccgatccgaccccaaccacaaagcatgttggttaacaactgaaacaaaactactttgccctatcattaacccttaattaatcatccccttttgtggccccgagaatttagattatttaccatcaaatttacatgactcaacttttttaccacccaatccgtatgtcttctataatatatcattaggagtactaattagtataattggtaccactttctcagtttttcaagtatttatcatttcttttctcaatttgtattctttttcaagttttgtggactgttttgcccctgggcccacctgtcaggtgaaagggtgatttttcctcctcaggatcgatcgatccctccagcctccaggcgtcgttcgccaccaaaccccgtcgccgagcgccgttcgccgccaatcccgccgccgggcgccgccaaccccgccgttcgccaccacctggacgagcgccgccaaccaaccgccggcgggttctaggccatgcgccgagcgccaccagcgacgaccaccgtgcgccgagtgccgctcccagctcaacgcccccaacgccgagcgccgcccgcaacgtcgagtgccgcgccacgaccccaacgccaagcgccaccacaccgctgccgcccccgccgacactgtgcaagatggaggcgatgagcagagctggatttgtgcaaagttgtagttttcagcaactggaagatcagatagttttcagcacctggatagtggcaagtctgtagttttttcttcagtgtttcttcagtagttttcggtggggatgctgcagttgaaattgaaattaacgaggtcagagtgtctaaagtcagaggcattgcaggcaaagtttctgggacatatgttcttatactgttagattccttttctatggacaatagagaatctgatgacaatgcagtgacactggaagctctagaaaattcaggtggaaacttctcaagattttcacataggaaggttcttgagatttaaccagctcttcatttcttgctagagcaagtggagaggctgatgattctgaaggttgtgaaggggagggcatgatcgatgtaagggaaacgctgatcatagccacctctccctctctcccttcaaaccctaggcagcacgggggagacgtgttcggccggggtggcggcgccaggttgcggtggccggcggcaatgctcagcagtggggtggcagcgctcggcggcggggtggtggtgcccggcggcggagtggtttctcgctctagttgacgcgctcagcgagacgtgtgttaacagtgaaatttggtaagcccggagtagtcatcggcttagagccaacatcggcttcaaagtccagagattagccgatgagaattgtcaagtcgtcagttgtcggattcttgctatatttggttaaggaaattgatctactaaaggaagcttatccagaagagaccgaggtcaaagagaatgcggcatggaaagttatttattaattaggaatagtttgttagtttccttttatgtttaggaaaatgtgtttagtgtcctataaggactttatcttttccttttatctttaggaaagtttctttcttgtccggcaaagacttgtatcaacccatgggtataaatatgtacacccagggtccatgtaatctatcaattacgatcaatagaattcggcgcatcgccaccttttaccttttctgctttattttatcgtccagcgggacttggcacctgacgcggggttgcatcggtgttcgatctccggcgaagggataagtccaatgttccgtcggtccaggcaattgtattgtctacgtcggcgtcgttcaaggctgcatcagtacattcgacctcttggattgctctggtttggatgatatatttgcctacctatttatcatatgtctatgttaatctagtcttagcatatcaatttagctctatcggctgcttctcgttttagggtttctgccggtattggctaaatcgtgttgctatattagattagccaagacatctaccaccctgaaaatcagtcaacggcttgattgtctagatattgtgcttctttttatacttagtgctgcatcagttgagcttgatctactaagtcgtgcttagaaccataatctctagcctgctttttgactgccaataagggtttcatcggggtttcagctgatgagttatttggacgttgcatcggctcataaggattgcatatacatatgagttgcatctagccgatgacaacaaaggtttcacttattaatctaatcttgtggatttcatgacatcggacctccagccgatatgtgctttagtcttcggatcaatgcttattccatcatatcattatagccgattggtttatactggactatattattgttatattttattatcaacaaccgattgcctttacatcatcatctacattggacatatagccgattgcttacaccttatcgctatcggctggtatcggcatcggctattatcggctatcggctggaactactccatcggcttatcagccgatcggctgttttgatctactatttgcatatattgtcagttgcaggatcaaactgactggcacgcccgcatctcattaatctttggacctgcacaggagctaagcagatctcccagaccggtgtgttcgattttttcatcaacaacgacgagacagagagattgatcgatccagactcagagatatatctcaccctttcacctgataggtgggcccagggggcaaaacagtccacaaaatttgaaaaagaatacaaattgagaaaagaaatgataattacttgaaaaactgagaaagtggtaccaattagactaattagcacttctaatgacatattataaaaaaacatgcggattaggtggtaaaaaagttgaggagtacgaatttgatggtaaatagtataaattctcgtgggccccacaacccagcttcctccgcctcctcggccggagcgagccggccggccggccggcgagccgccgctcgtctccgccgtcggtggtaggtagccaagccaagccacgctgtcaccgaggcggtcaacgagacgacgtggccaccaacgcgcttccccccactgcctctgctgacacatgcggcggctgctaattactgggattattacttggtaaaccctgctactgcctccgtcacacaatataaaagattatgtttttttcttaataaattaacaaagtagtaaaagaacatgttatagtataaattgtgatggatgagagaataaaatatataagatttgatagatgaagaacaaattagcgcaccttccgtaaaaaaagaaaaatctagaattagatattagggtacgaatctaaacatgtgtatatctaggccctgtttagatgggactaaaacttttaagtctctatcacatcggatgtttggacactaattataaatattaaacgtagactattaataaaacccatccataatcttagactaattcgcgagacgaatcttttgagcctaattaatacatgattagcctatgtgatgctacagtaaacattctctaattatggattaattaggcttaaaaaaattgtatcgcgaattagctttcatttatgtaattagttttgtaagtagtctatatttaatactctaaattagtgtttaaatacagggactaaagttaagtccctggatccaaacaccaccccaaattcgtagtattagaatgtgtcacattcggtacagattgattttttatggggtaaatattattgaatcgtactaccaatttcctaccacggtatagatgaagtacaaagttgatatttcctcccacgaaaaacaaactatattttctaatacaacgaatctagatagtgtactagaaaatatcatatctaatattatattattttttttatagtacagaacgagaacgagtatgtgtgataaatgggaaataaagtatcgtcttaggatcagaaatctctttaggagtattatgaatggagtactaacctcgccgttaattgcataataatctggacaagtgatgcctaattaagccatagtttaatcggcaatttgcttcagatccagctcggcatgagactatcagaggcataagtgtcaaagcatctctcgagtctcgagtcttcccttctcagccagcttcgcctcgctcgctagctatccatctcttcctcctcttcttctcccttcccttgtttgcttggaaggagagggggaagaaaagtaggaggacgcggttgcgggttggtccagatctagggcaaggcggtggccggagtttgagctgggcccgccggcggcgagatgaagcagtcgatgcggagccggcaggagccgcggcgggtgagcaacggcgtcatcatcgccgccatgctgctctccctctgcgtcctcagcatcgtcaaggccagatactgctccacccccttcggtacgctccgcctccgccgtggcggcgcggcgctcttcttcctcctcctcctcttgatttgtgagttgggagtgtgaaatttggttgggtgatgtgcagttaagcccgacgaccagctacaggagcagatgaactccagcatcaggatggagaccgacgagccggcgaccatggcggcgggaggttcgtcctcgccctcgctagctctccggattgtgtgtgatttgtgctcaacgagtgcgttcttgaatttgcagagcaagaggaggacgaggaggaggagagctctggcggtggcggcgctgagcctgaggtcagcgccacccctgccgtcgtggtcaccgccgcagccggcggcggcggcggcaagaggaagccgacctgccgcatgacgagcaagcggtcggagcggtgcgaggcgagaggggacattcgtgtggaggggaacgcgtccaccatctacatcggcgggatcgacaaggagtggaagacgaagccgtacgcgcggtaccacgaccccgtcgccatggccgtcgtccgcgagttcaccctcaagccggtcaccgagtcgtcgccggcgtgcaccaggaaccactcggtcccggccttcgtcttctccaacggcggcttctccggcaacctgtaccacgactacaccgacgtgctcgtgccgctgttcctcagcacccaccagttcaagggccaggtgcagttcttgctcagtgggctcaagccatggtgggtgaacaagttcaacctcttcttcaggcagctcaccaagtacgacatcctcgacatcgacaacgacaaggacgtgcactgcttcccccggatcgtggtcggcgccaccttccacaaggacatgggcgtggaccccaagcgctcgccggggcacgtctcggtggtggacttcaagcgcgcgctccgccgcgccttcgggctggagcgcgtcgcggcgtcccgaggcggcgccacggggaacggcaagccacggttgctaatcatttcccgcaagaactcgcggcggttcctcaatgagcgggagatggcgcaggccgctgccgctgtgggcttcgaggtgcgcattgccgagcccgatcagcacaccgacatgtccacattcgcccagctcgtcaattccgccgatgtcatgatcggtgtccatggtgctgggctcaccaacatggtgttcctcccccgcggcgccgtcctcatccaggtggtgccattcggcggcctagagtggctcaccactgtcaccttcaagaatccggcgaaagacatggaggtcacctacatggattacaatgtgcagctggaggagagctcgctgatcgatcagtacccgcgcaatcaccaggtgctcactgatccctacgccgtgcacaagcaaggctgggacgcgctcaagacggcgtacctggacaagcagaacatcaagatggacatggacaggttcaagaagacattgcaggaggcgctcgacaggttgccgccagcatgagagcttgatgaactgatgaaagctcaagcccacgaggtggtggtggtggtggtggtagatagataggttggtgtatctatctgtgccttctcttgcttaacttatttttccttttgaaattctttttacgccttcttcttcctttagcaacattcatttgatctgttgttttggaaaagaaaaaaagaggatgaacaagaacatcatgttacatatgcctagctgatgagtaatttataccctttgtgattattaattggttgtttatttacaagtaaatgtcaagatacaaaattgtggattactagtaagtatcaaatgtgagtgtacctccctctaatgccaggggggcaaactgtattctcctatgccttcttcattgtatcaattcaattcatttcatccagtacattgcctctaccaaaccatgccaaaattgacctttcctctgcaaatgaaccacgattttcaacatataaacgaactacatttgatcttccattgtctcattagtcattgcacaacaaattagtagagtgatcagtcattgatgctagaacagtggatcaaaggttccatgttcagtttggcagatgattagtgccataattgggggataaataggccatgaacaggaccaggattctccctggattcaactaacacaatgagaatgaaatggaccaccattggccattgcctaccacaactacctgtcatggtggcattgcataagcaatggaaatatttcaactttgtcagttcctttctcttgtgaatcctttggtttgggaagagatgagcttccttcctgctctgaccggatcacagcaagccaaattcatagtctgattggcatgatgatatatcagaaaaagagagaattttttggccaacgaaggtttggctgatctgctcggccttagtcaaatctgtctctttcgacgaactgcgttgcgttgctaatttgtcactgatgacaactacttctacctgccatctcatatgtgagcctgtcagaaacatggagtgatatgctagtaggaacactagaagcttccttctgtttcctgtagggaagaactgaagaatggtcagcacatcgtcgaccgtcggatcttgatcagatggtatccgcgacgcgggacccagccatcagtggttgggactaggaattttgcccaattgcaatttggcatgatgaatgtgttgtcctttgtgaaattttctaaaggcaagcagggtttgtacttgtgtgagatgtgaaattgattgggtaataattgacttgttcatggatgattgagttttaatgggagagtgattgcaggatgaattacaagttatcggtcatatgtgatggtaggtaaattgacagggacaacacaagctgaagctgaagaaagaagaagagaacttgttcaggtcagcaactagcttgtacttgacactgaattatgaatgtgctggagcttgctgatggctaaggtgatggcattgtgaaattaaccagctggccagttgatttgcagctgaaataatcaatctctctcgtcagcatttgttgcttgtaagcaaaaatcaaccaccgacaaacaatatggaggcactgttcttgcaaaatccttttggcacaggccgggctttggagcttacccttggccggttttgaatcaacatgaattccagtcgaatttattcggaattggattagttagttccgacgttttttttttataaaaggaatcgagtagaattcagatagccatcctatattgattctcgggataatggagccatggactatactcccttcctgtcaaaataaattcactcttatacacaaatctgattagattcgtacataagagttgatttattttagtacataaaggatttccttttgaatgtgtgaaccatttgtcggtgtctgcttgagtacgaatagtgagtggctcatcatactcaagcacgatgacctcttaaacaaaagagcacgacgagacgatgcttgggatggcgttgaattgatgaattatacatccggaatggaaatgccgtcgtcggagaagcacacgaaagatgacatcagcattcccggccggtttccgccgccgccgtctcgccggcggcaagccgtcgtccgtccatacgccaccaacctcaatgactcgccgtcgtcaatccatcgcgtcgctttcacaacccaaccagtccaaaaaatccaaatgtccagaactgtacggccgcgttaaggcagaaacggatgattagccacacatacaacgaaagatatgattagcatataattaattgtgtactcctattaattattaaaaagtaaaaaaaataagtttatttttaagcgattttttatatagataaaacttgcacaaaatgtataaaatatatcatttagtaatcccttcgatccaaaagaatcaatccagattcatagccagagtttaattctttttaaaatgagtgaagtaatttaaaaaacatgctaatgaaaattgaggaagtagtcaatccgatcttcactgtaaaacggggcctactggttaggcaactacccaccaccatcatccatccaggactgcaatttctcaaattttcccacgtaatttatttaaagaccatagaaaagtttgtttaaagaagtttagtaagtactgtttagtaatgttgatgaagagagtttttgcaaaaaatgagctttgtaagggtgataacggtaatccgtaatctgacagctaaaagtaacacatccttatcagagaaattaaagatgttttcttttgtttggtcaagatgaagtttcgttagatgaaaaaggaggcagcatgcaacacaagttgaaagttcatccgaggaatcaagccaaataaataaataaaataaaataaaagcatcaaagcaaagtgaaaactgatgcgtgacttgtgaactgatcaaggcaggagcccaaggaggaaagggaagacacaaggaagtgcagccagggtggttcgacttcaactggtttccatatcccaggacaatgaccaggcaacaacctaaccatgctatccagctaattactccctctgtcttaaaatataagaagttttagagttgaatacgattattaagaaaagtaggtataaatgagtggtggaggattgtgattggataaatagtggaggtagatgagaaaagtgaatgatgtagggttgtgattggttggaaagagaatgctagtgaaaaagttgttatattttgagacaaattctgatggctaaaaattgttatattttgggacggagggagtatttccttcttgctatttccatttttcctttttcgcgcatacatcatcacacatgcacacacatccgtttacacacgctcaatagaataactttaataacaaaattattgatccacttgattttatagaaaaacatgtatccataactcagtggagtcgtatatctaggagaatgattctctaacctcatacaaagtctgagaaatctcattcaccctctctgctctctcctcgctcccaatagaggtctttttttttttgggggggggggtgttgtctagatatacccataactccctttatcgcacatataagagatgtatctctcgttccaagaatatattttctataatttatgatttcccattcttgtatataataacaaagacaagttatgtcaataaatatgcatataccatggataaattaagctatatctgtatgcatcccatgaataaaacaacccatatttgtacctcataatacctccaacacaactattatcacaaaagacatgccaatgtgatggcttattatacccaataattttgtgatggcatgttaagaattaagattccatccatccatccatccatccatccatcaaaatcaatgagtcggttcgttggtagatggtgatctaatgacaagccccatactaccgaccacctctgcgtcctcatatgcctaacaactgatgatgcttcgaattggttatggctaaagatgaccaatggcatagcatggaccgttctttttgcatcctatggattctggagacgatgacactcacaataccaaataccaaatgcaggttaaccatattaaactacgcttattgcgacgtgcaaacaactctggttgcatcagcagttttgcccctactgcttggaacacatatggttcttgcagggttaagaattataatacaaaggaatatactgcttttaaagattgttgaaatttatgtttgaacctgataaacatttgtcattttcatagagatttctacatttgaaacacaagaaaaaaaaagccttgtgctttcatgcttccagcacacgaagaacatcattcagattactcccttgatttcaccacttttgtaatgcttttgctatctatgcgtacatgacaaacacaaccttgcaaatcaaagcagacaaaagcaacgatcagaagctgcaaagcagctagtgatagggagctggatggctgccttttattattctctagaatcaattctattagtagtactgttcttattaaaagaaaaaagaggctccagccacacgatttttaggaccagctagctagcatcaagaattaaattacaatgatctagggatggcatcagtcagatactgatatcagtgctgaaacagctcccaagttagaaagtttcaagtaaatggattctacacaaacagcaacggcgtttcacataagctcaggaaagttcctccgttcaaaagcatcggataagcacagtacaaatctcccatcaattcagtaaaaaccgtactagttttcagtttatcagcatctcctttatcaattctgtaaccttgggagagtacgtctcctccaaaactcatctatttgcaatatctgcagttcccatttacagaaggaacccaacagatcattctctttttattattttcgcgccttatttagagaggatcttctcaggcagatttaagctccatatttaggagctttccagagcttaaatgccacctcatgtagaaagcgttcagcaagcatagcaagatttccaccacgctgttgattaaatagcagaatgaaattagttatacagttatactcctccgagacaaccatattaaacggaataaattaatatgtaacaaaacaaatataagctatttggctaagttaaacacatatgaatcacaatatgggttgaacttggaagcttaggatctaaataatggccagacagatgaaagaaaaaaaatgctattgaattgtaaggccacaacagtggcacagtcaaggccctgccagttatatgcagtgtttctgcagaagctatctagaagaattaaaactactgcactgtattcttgcgaagcatattcattcaggtagcaccattcttgtataattcatgaataccaaatttgatcatatatcccacgtttagattgaaattgaggatttaccctcccacatgtcagtgaccttagatgacccccacatgtcattggcacaggagggtaaatcctcaatttttgatctaaattctaaatggagggtaaatataaatgacatgcttgaatggatttataatcttatactactagttttgcatgggggacaaatgccaaaaaggtacgcagatgatcatcccagcagcttttgacagtatgtcgtgaaacaaagaattaccgtgtagtgctgtggcgtgcactgcacaactgcacattaactcaagcttttgggtatggctttcgccgaaaggaaaaaaaggacagttacacaacaaagctaattatacctatggaacagcttgcacacttatcttacacaacaacatgtgatgtcacacaaaaactaccaccaagatgaagatataactcttcactacatgacatgcctttttgctaaccaaaggatgcagcagtgtgtataatatgacagaaataatttactatgtaatgcagcagtgtgtagtagctaattttaacacagcagcaattttttttgaacaaactggcatcctctttttaataattctataagaaaccaagacaaaatgggagaactcaagtgctttgaattgtaaacaactcaaaaggcaaattcataagcaggatcatgagaaaatgatacaaatgaagtatttactaagtatttcacattttcactatttgaattttcagatcgaggttataacaagttgattatacaaacctttatgaattcctcaaaagagaacccttcggtcaaatcagagcgtgtaactccttcctgccactgtgctaacagaatcggatgatgattcctgaagaacatgtatgatagtaatattggtgttagtcagggtttgctattataaagaattggcagacacacttttaacgaccacattatgtcatggttaagtgttggcagatactaaatcaacttatctggactgatggctcaatgtattagattgggtttgagaaaaaaaaacatttcaaacttgatttcataaaaaccaaaaggtgaaaaggtggttgtaagctgctagctttcaagtataaagtacctaaggaaaaatatgatatggctcttggaagtcatgtaagccactgcactccattatatgcagcgaaagatcaacagtaattacatttggaagaccgtgaaactattcaccttacatatatagcagacaaaatctaatggaattcttattatgtgtaacataaatatgattactacagacaaaacatgctctacttggaaataactttttggatttcatttgcagcaaagaacaacacctacctaacatcatccaatgtatttcctgctttcatagtatagctctggcgtgggcgaagcaagttcaagtcagaatctatttcagtcgaagattttgagatggaaaactcatccttattttcagcagcagacccatagctcaacatcacagatacaagaatacgggaggcgatagctgaacttatgggcgccgcttccatgattgcaccaactaatttatcaagccgatttagatcagtcttcattcccaattttcccaacttgctgtttgtattctccatggcaacatgcagaaacaccagatcaaattcagatgtctcctgaacattcccctctgaaaatccaagcagacttaacgcctgggaaataattccagcctccttagaagcagcggaagatccagattgtgcaactaaatcttcagtcccggatacatgaaaaccaagatttgctgcaaaagaactaacaagggggcaattggtgaccatggcagctctgatccccataaacctgacattccaaataccacatgaaagctagttagacctaattcatgaacaatgtaacagaaaacaaagcaaaaatcacacacatccaacctctcagatagcttgggaactgctagttgcagtggatccacctgggcagtctcttgaccagttttctcagtctatcacgcaaaaattacaatcagcactacctactctaaattctcgcacaatcaaccctcctaagtgcgaaccggtggaagcaagatctcaccttagcagggaagagatcatcgtacacgtcgagcagctgcgcgagctcaagaatcgtgctgtcacgcttctcctccccacctacaacgaccaaaacaaggaaaatctccattcggtcagagcagcgagtagaatcacagagagagacgacgcagaagagagaatcgctggatcagtagtacccactcgcgagagggggcgagcggagggagaggaagccacatgacgcgagagacgcgaaggcgtcgaggtggctccctccccctcctcctccggctccgccgccgccgccgctcgccggagggagcagcgccgcgtgccccgcggcgtagagcaccagcccgcggctcggcttgtccgccattgctgcacctcccctttcctcctctcccccctcctctgctttattcggtgggccccagacgtcagcctcacccccacgtgtcaacctcccgaccccacgtgtcatcgagatcactatactagcccggcatgtgggcctaactgggccggcctggcacatgggctgaattgggccgcataggtgggtcgcttcttgggcctctggttcctcgactatacgtatacaaaagaaaaaaaaaagaagagaaagagagggagaggagaaaccctaggcttggttggctccaagcttcgcagccatcgccgcctcggcataaacccttctactccgcagccatcgccgcctcgagctgagcttgagattcgcggggggcgcagcaatggccgggaagaagaggccgccgaccgcgctctccgagcccgaagccgccgccgccgccgaggaggaggaggccgcagccaagacggccccggctgcggaggcgccagcgaagaagaagaagctggccatggagcggaagaagcagcggaaggagattgacaaggagaggcaccgccagtccgctgaatcggacgccgctgccgctaagccgaagcagccggcggaggtggcgccggaggctgcggctgcggctgcggcggcgcccgtggctcctccgcctgtgattccggtggtgtcggggcctgggcttcacatgaacgtgttcagggacctggcttcgcctgaggcgtcgcagagggaggccgcggcggaggcgctcgtggcggagctcaggcaggtgcaggtggcgcacgagaagggtgggcggaaggagggggagagcgaagcggagggtggagatgggtcgtcgaggatggaggccgagaaggacgatggcctggagaactgcgcgccgtcggtgcgttacgccattcggcggctcattcgcggtatctcttcttctagagaggttagagatgcttttccaattccatgacgaagtttagctttgtgtattgcattggtcatccgctacagttagatcgtatcttatgcttgggaacttggtttgcagtttgcaaggcaaggattcgcattgggtcttgcagttgtgctcgaatcaattcatgcaatcagcgtcgaagcaatcatgaagttgatacctaatttgttagagtattcagcttcaatgaggggaccggtaattatgatgattagttactgctgattttttctgcctattgtgatgttaatttgtttactcattttttttcatttttcttttgtaggaagctaaggacaatcttttgggacgattatttggttatggatcaattgttaggtctggacgggtctcgggacagtgggcacatgaagaaggttctcccattgtcaaggattttgtggatgaggttatcaaacttggtagcaagaaacgatatttaactgagcccgctgttgccgttatcctggatttagctggaaaggtacgcgcctcaggcacatactgcactttttatgactatgctttttatgcgtgtaatctaattagggacattaaaatttagttgaaggtctatcgcataagaggttatcattggcatccaaatacatttaaaattgttacagaaaaatgaccagcaaaaaggacaatcttaaattaaatttctcaaaaggtgtaacaaagcaaccattttcataccacctgaaaacattttttatgaaaactttggtgtttcagtttgcatgttgtacttggcttctgtttaatagataagatatccccctgacatcaatggtactgccttttggtttgaaatcgacctgtgattatggcaactttcactcttattttgtatcaattatgttgaaaatcacaccttgtgatgcacataagtttggttttggagtggatatgttatttcctcagttgtcagttgtaccatatttggccagtgacttgattcaacatttgctgaatctttctacatattgcagctgccagaggaagctataatatctgagattctggaagctcccagtgtgcaagattggttcaacagagctgctgatgctggagatccggatgcactctatctggctttgaagttgcaagagaaaacaaatgcccaggagatatttgggaagcttctgccatatccattcagtccagagggtttttttgcagaagaacatcttctttcaattgctgcttgtttcaaggtaatttgttttagtaattaatggttcaggagtaacattgccaaaatctaacatagcatagctcaatataaccaagatgtatttgataaatataattcattttgttatatcaaatttctatatgctctatgccattcctttccttatcttttgattggtcttctataaatctttcaggaatccacattttgtcttccacgcattcatagtttgtggcttgttatcacggacatgcttgttcgagaggcagcttcacagagtgatattgccacaagctcaagcaagaagcacaaaaagaataagaaaggcagctcctctgaggatacaaaaaagaatctacatactttctgtgaggttataattgaaggaacattgctgctatcatctcatgataggaagcatttggcatttaatattcttcttaatctccttccaaggctatccccatcttcgattcaagtaattctgtccagcaaggttgttcatggtttgatggatgttctgtcaaatgaatcgtcatggttgcacaatgccggccaacattttctgaaggagttagtaagtttagtgagtgatgataatgatcgacgtgttgctgttattactaacttgcagaagtatactggtggaagatttgactgcatgacaaaaacgagaactgttaaagatttggttgccaagttccgaagtggtcaagattgtttgtgtcttgtgcagagtttgatgtcactctttgtagatgaaagctctgttacagacgaaccatctgatcaaagtcagacaactgatgagaattcggaagttggttcaatggaagataaggacctttttggccaagggagtgctgaccttttgaaaagttggatagtgactacaattccttgtgttttaaaaaatctgaagctgacatctaaagggaattcactgacagattctgaaatggttaagtgcattgaagaaaaatttctagtgcagactgaggtattgaaattccttgcagttcaaggtcttttttcagcgtctttgggatatgaggtgacatcatttgagctgcacgagaagttcaaatggccaaagccagctatatcaacatcaatacgcaatgaatgcattgaacaacttcaattcttaatagaagatgcacaaaaggatgaagctttacacgttagtgaggttaagtctaatgacctgggcttctacttcatgcgcttcattaacaccctttgcaacattccctcagtttcactcttccggaccttgagcagcaacgacgacaatgcattcaagaagttactggatgtagaatctctgcttttctatgaggtttgtaactttgctattattcaacctaacatattatagttaactcattctgtggtgtaacattttaaaattttaatttgacctacaaggatggcctcactgttcctgtttccggtattgaaactatccctgactgtatttatctggttttaaattgatgacttttgaacaccctaggaatcataaaacggtgtcagtgtttattttaaaaataaatcagaggtcccaacaactgagagtgtgcactaaggactttccttaaaaatctagtctcttgaatatggatcgcctcttttgatgcagtacggcttacttgtggcaatggtgatttcttttggccgttctagatttaatcttgttggaataaggagttcaaaagtatagaagcagggatttagtttgaataatggttctgttcattttcctggatatttcatatagttcctttttttttcccatcatctaatgtctgtggttcccttgtgaataggaaagaaaagttggccctggcttggattcgactaaaatgcatgcgatgcgttatctccttattcagttgctcctccaagttcttctccatccagatgagtactgggaggcagcaattgatgtgactatatgctgcaagaaatcgttcccttccatcgttcagaatgacaaatccagtggacagccatctaatgagggtgcggaggtgtttaatgaggatgggccaggcaaatctaacaaggatgggccggaagagcataatgatgatgcgtcagaggattctaatgaggacgggccactagagtttatggatgtacttgtccagacttttctttctgttttgccccatgtgtctggccctgtatgtttctccatcgaacaggcaagtaacactgtacatgtacctctagtaataggaggttttccatttttgaagaatcgtatgttgatgataataggaaataaattaggggcatgcagttttaaattatctagtatacactcctttctaaacagccattttcaattgtactagcagaaatttaatcctagtaaatagccattttctatcatactagtcgaaataacaaacatagtaaaatcaccagtacatatagattgtgctgccctcattttcctttcttgtttctgtttaatggcggttatttgttgcttttcttgctaaacatttgacttggctgcgctaacttggtcttttatttgaatcaacaggtcttccgtgtggtctgtgatgaaattacagaaacagggcttcttgacatgttgagagttgtgaagatagatttgaaaggttctcgtcgccagtcaggtagtgatgatgatgaagatgatgcatgtgttgacattgaagatgatgatgaaaccattgtggaggacgcggaggttggggacactgattctactgcagacggactggatgaggaaatggatgatgattcagctgatgaagtagatgaaggtcaagatgatttgaaagaatcagttgcccatgagtcaaaggatggagatggtgcagaagttaccaaagatggggatgactcagatgattcagatggtatggatgatgatgctatgttccgcattgatccttacattgcgaggattttcaaggagcgcaaccttcctggcagtgaaactaagcaatctcaacttatgcggttcaagctccgtgtccttacattacttgagatatatcttcagaggaatacaggtacatttcaaatattccttcatattttcattcattttaagttgtatacatgcatataatagtcaaaggatactctaaaaattgatcattgccgaaaatctgcctccaaaatcacatcagggaattaattgttactgcaaggttttttattaggaaatggtccagctttcattcagttttaactgtagtatttacatttgttatatgttgtgtaaccttctatgccctaaactccacaggaaataatctggtgctggaggtctattctttcttaatgcaagcttttgtgaagtcacatagtgctgatggcagtgagcaattcaagcaacgtataggtggtatattgcagaaaaggatattcaaagccaaggattatcctaagggtgatggtgtagagattagtactcttgaaagtttgctggagaaagctctaaaattggcatcgcggtcacgatacaccacggttgcttctgtagcccaaaatgctgcattttggcttctgaagatcatcaattcaaagagtcattcgaaacaggagcttgcgagtgttgtcgaaaagttccaatatatattgaccgactacttcaacaacaagaaatcgcggttgaagcttgggtttgtgaaggaggctgtccggaggaatccttgggtaggagaggagctctttggatttgttctgcagaagattggatgcacaaaagctgaatatcgaagagttcaaacgctagaattggtagactgcatactcaaatcttgggctggtgatgattcgagtgcatcgaaggtgttgaagaagcacctttctcagttgtgcgagctgatacaagaagttcttacaaagatcccagaaaacaagtcacgtcgtcaagaagtccggagattttgcacccgagtattgcagacagtgacaaagcttaacctcaaagaccggtttcagaagaaattgaatcctgaaacgctctccctttgtgaggcacagctaggagctgcttttgttcgctttcaaaaatgacattacatttatgaggagactgtatttgttccctttcgaaaatgatagtcactagaaatattttgagctgagctaagttttgttcctcatttcagctacatgagtagattctatcaaattaagctgtatcggtttttgtgacagtatctgaaaggaaaagatattcactgttatgttagcaatactaattggtatagacgcgcgcagcacagctgccatgcaatttgctcatgaattctttgcctgcagagtttgtttgatgattctgtcacgaattgtctcacttgaaccatgcaaatatttgctgtacgcctgtacatggataccttgtgtagtaggttcacgaccctgtattcggacacatgctatttccggtttttatgtttctaatagatgatgcactcaaattttgaacatatatttatatttaagagtaaatttcataaaacaataggtattttacacaatttatcacaaaactacatatttatgagcttgtttcacaaaactatagatattttgtacaatctatcataaaactatagatttaagaacttctttcacaaaactatatatttagtgtattcgttcatcatagaactacacatttagtatcttcatttatcataagattatagattcagtgtctctattatcacaaaactatagggtttaacaatactaaaacttagttttgtgataatgaagacactaaacctgcagttttgtgataaatgaagatattaaacatgtagttttgtgaaagtcttcattatcacaaaactataggtgacggagcgtggggctcctcaccgggagaccgcgcaggcccccctttgccggttcggccgggggcgctaagtgaggttcttcgccctcgatctgatgaacgtcagcgagagaggaagtgcacaagacacgggcgacgtagacaggttcgggccgctgagaagcgtaacaccctactcctgtgttctggtggatctgtgtgtgaaggaatacagagagccggagagcgagagagagttcaggctctagcacccattcgccagagtcccaactcctcttcctctttttttcctctttctccccctttttccttcctcctaggcctgggcctcctttttatctggtcaggggtcaccacatgggcctccagctgcctaagaaaggaaacatgctttttacaatgagggctagtctacagccggaagtgacctctgacaagcagagcccacgcctcctgccccgctcgccagcttttccggtggacgcccatttcaaccttcattcaatggccagcgacttccttgccatgcttgcgctgaagcttggaatggatttgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgcgctgcgccgcattaaatgcggcgtggcgcgctcgtccaacccgctataaatgcggttaggtgagccccgctgtgctcatctaacccacacacgtggcgccaaaaccacaggaggtcggggcgccccagccctcggggccgaaacgggggcgccccagccctcggggagacagagggaggggtggccacgtcaccctcgggcccgacccccccgagggggtcaggccacgtgggtgaccgcggctacccaagcctctagtcatgatacccccggccccatgtcaccgacagtagcccccggcgttacgccagggcgatcgcccccctcgagggaagcgctcgggcgtgacgccactccttaggcccggtgataggtggggcaggtccctacaggcgggcagaaaacccagcggtcgcaaatcgcgcgcatcggcaagggaaaaccgaccgacaataatgagcggcctctttaagaccgctacattactcgagcagcgcgcgaatcgggacgagccggttcgtttcgcctggagacatgatgatggcgcttttcgcggttggcgagcgtagttaatgcgcgcacgatctgtcccatctcaaccgccacagccgcacatctgccgcgtgcgccgcaaacgggcgagtggggttagtggaggcgtgggcgcgagaaacgagggggcgaggtagtgggcgcgggaagcgaggagccgggcatagcgttggcaagggtgtaaagacgccgaggaagggattcgtttccttcctctcgccactcttccccttgccttcgccacttgtgctctaactcttcgtttcctgtgccctacccttgccgcactcgctcgctctcaagctcctcctccgccggcgtcatggcacggggctccgcaccgctcgacggtagcgtgctgccgccttcccgcatcgtgagcgagaggcaggctgggctgccgcgccgattcatgccggaatctgccactggccgggaggtggtcgcgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcgaggtgcgcccatctctccggctgttccggtggttcttcaccgtacaaccggcgtcgccgccgacggtagtcggtggctgctacttccagccgcgggggcaggtgctgaaccgctacattccttgcgtcctccgcaaaaagtgggacgactggaagagcgattggttctacacccctctcgccgacgaagcgcgcctccgacttccgagccagcccccgtcgcaggcctccagctggcgggcggcggtagatctgggagacggctacgacgccgttcttgaccgcctggcgggtctgcgatcccaggggctcacgggggccatggtgttcggcgactaccttcgtcgccggatcgcgccgctccagcggcgcacccggggcgcctgggagtacaccgggcccgaggactacgtgaggacccatcaggggcgcaaatgggactgggaccctgaggacttcaggatggtggtccaacgggtgctgaatctcagctccgtggaggcatccctcatcccccaaggggtcctccccctttgctgcgatccagagcgcgccagcatcctggccaccatgcaggtggtcggggcgtcgggggagcgggccccccgaggccacgatggcgcgggcgggagccgcaggggggaacaatctaccccgggagggggtcgtgcttctgggccccgcgacgggggcccggggggcagccgccctgccgacgcccgggggaagaggaagcaggagggtacccctcccccatctcctccccgagggggcggggtggtgcgtgccagcagtaggcgcccggagggtgccgtgccgacgccgcagcccgagggggagcgaaagaagaaacggccccgcaagatggggggaccgagccatgccgggggaacctcatctcgcccccgaggtggtcgtttagccgacctccccgcaggttcgtccccgcgcccaccgcggccgtattcattctcccatctcccaaggcgagttttcactcacccgtttctttttgtcttctggtttttcttctgcctcagcgagatcccgtcgcgccccccccgccattccaagtccggccggtctgaggccgaggagacggcgaccgcggaggcccggaggcgggaagctgaccggcgagaagccgcagaccgcctccgggaagccgaggaggctgcccaggaggccgtccgggttcgccaggctgaggaggccgctcgggaggaggctagactccgccgggccggggagtccgtccgggaggcagaggcggcgcgcgcacgccaggcggcctgccaagcccccgacccgactccgcccgaggcgacgacgacttccgaggccacccacgacgaggccgcgggcgcgctgctcgggcccgacccctcgggcgacgcttgggacgagccagcttcgggggacgcccccgagtccggcacgtcgatcggcgggccgagccgcgcggcacccacaccgaggcggctctcccctatgccttccgctgccccactgagcgcggagcccctcctgcaggccttggccgccgcgaacaggacggtgctggacgggttaagtgcccagatggaggccctgcaggcggagcgggcggagctcgacgcggcgtgggcgcgcgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcgccaccgccgttctcgacgaggcacgggatgacctccgcctccaatacggaagccgggcggcggagctagaggagaagctcgacgctgcccggggtgtccttgacgccgccgctgcccgtgaacggcgggcggcggagaacgaggcggcgtcccggcagcgcgaagaggcccttgaggctcgcgccacggcgctggaggagcgcgcccgcgccctggacgcgaaggagagagacctggcggaccgcgaggccgccgtcgccacccgggaggcaacactggcggcgcacgaggccgcctgcgccaaagaagggtccgcactccgcctccgcgaggacgcgctcaccgagcgggggcgagctcttgaggaggccgaggccgcggcgcagcggctggcggacagcttgttcctccgcgaggcagcgcgggaggagcaggcgcgccgcaatctggaaggcgcccgcgccgagagggccttactggatgagcgggccgctgaactcgaggcgcgggcgaaggagctggacgcgagagtgcacagcggcggggcggccgcgggccacggcgacctagccgcccgcctcgctgccgccgaacacaccatcgccgagatgcagggcgtgctggactcgtccgccggggaggtcgaggccctccgcttggcgagcgaggtagggcccggcatgcttcgggacgccgtctcccgtctagaccgcgccgggcggcaggcgggcctctggggcgggcggtacgcgaagtacgccgccaaccaggggggcctcgcccagcgcctctcagagatggccggggccctcaagcggctccccgaggagctcgaggagacgatcaagtcatcctcgagggacctcacccgggggggcggtggagctcgtactggcaagctaccaggccagggaccctgacttctccccgtgggcagcgctggaagagttccctcccggaaccgaggacggcgcgcgcgcgcaggtctgggacgccgccaaccacatcgtccacagcttcgagggtacggcccctcggctcgcgttcgcgctcgactccgacgaggagggcggtgacgatgctgcggacgacagcgacgacgaggccggcgacccgggcgcgtcggagtgagcccccaagcccccgccaatcttaataacttttccttcttcttctgaggccttcgggcccccttcttgtatagactgatttaatctgcaatcaagtaaagaggaaatttctgcgtcagttctgtttgttgtgtgtatgagacgaggatggtctgtgccgcggtccttctgtgtcttggcttgaacaagggctcttgcccaggtcccagcctcaaacggcgcgggtcggggctagtgcctggggagatcctcgtgtcgagactggccaggccgggagcgcggtgaccgagggttatggatgacccgattgtgggcctttgccgattcccccccggagttcaccacgccccggggcacggctcggttctgggcccgtttggcgattttagccggcccgggccaccgagggcagggtcgagcacgagcgtgctaattcaagccaagattcttcaaaaggaaacgatggcacagacacagtcctcaggaaatcgaaaatgcttttattgaaatacggaagagaaaaaagataagtatatgcatgtggtagcccccggccaaccctgcacgccccgggggggggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgtgtttggacgcagtgtaggacgaggtcgtcgacgcagagtgatcgggcccggacgtagcgctgatggtagcgccgcaggctctgctggtagcgtgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcaccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggcgacgaaagaggtatggtctgcagggcctgggccggctgatgggtttgcctggcgtggaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgctggacgcgttcactcccttcgcggtcctcgggtagagtcttatctgcaaggtacgcctggatctcagtgatccaagcaatcaatctaggggagctgggagcgctcccctcgggtcctgaggcctggactccgacgggcctcgggggccgttcaggcgcgtccgtctcccctagggggtcgggtcgcgccgacggctgggcaagcctttcttcaaaggcgcccggtggggtccgggctcgcgaggaagcgagccttgagagttcgtcggcgaccgtgttatcccgtctgggcacgtgccgaagctctatcccgtcgaaatggcgctccatacgccgcacctggcgcacgtaagcgtccatctgcgggtcagagcactggtactccttacagacctggttaacgaccaactgggagtcgcctaacaccaggaggcggcggatccctagtccagctgccactctgagtcccgcaaggagtccctcgtactccgccatattgttggtcgcccgaaagtcgaggcggaccaggtacctgaggacgtctccgctcggcgaggtcaacgtgacccccgcaccggcgccctgaagagacagggagccgtcgaactgcatcagccagtaggcggtgtgaggcagctgcgaggggcccgagctggcctcgggggcggagacgggctcgggagctggggtccacttcgccacaaagtcggcgagggcctggctcttgatcgcgtggtgtggttcaaagagcaaatcgaattcagagagttcgattgcccatctcgccacccgtccagtaccctctcggttatgcaagatttggccgagggggtaagacgtaaccaccgtgacccgatgcgcttggaaataatggcgcaacttcctcgaagccatcagaatagcgtaaagcatcttctgggcctgagggtatcgggtcttggcgtcccggagggcctcgctaacgaagtagacgggcccgctgcacctttcggcggggccgatcgtcttcgccaggggccgcatctccagggcgctcttcgtccgacaggccgcgcggggcgcactcggcttctgtgccgaagaccttggggtcagagggcgacaggcgcggccttcccgcagtggccccggggccatcctgggggtcgggggcgcctggcaccgtcggacaagcaggcggagggccagctccggccgtcgggggccttgggccgccgttcggctcgggggcctctcctccctgctgtctcccgggtcgagtcgacacagggtggggatgcgcggagtgagggttgtcctcgtcgtgctccacgaccaacaccgcgttgaccacctgcggggttgccgccaggtagagtagcaacggctcatctggctccggggcgaccaggactgggggagaactgaggtacgccttcaactgagtgaaggcccgctcagcctcctccgtccaggtaaacggcccggagcgtttgaggagcttaaataggggtagtgccttctctcccagcctcgatatgaaccgacttagggcggccatgcagccggtgacgcactgcacatccctaagcttgctggggggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaagattgcgtcctatctggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctaatctatgcgtggcagggggtaagggtccttaggacatgccttgttaaggtcggtgtagtcgatgcacatccgaagcttgccattcgccttgggaacgacgaccgggttcgctagccactccggatggatgacctcacggatgaatccggcctccagaagtcgcgccacctcctcgcggatgaaggcttgacgttccggggcctgccgccgcactttctgccggaccgtccttgcgcccggccgcacggcgagacggtgctcaatcacctccctggggaccccgggcatgtccgccggtctctaggcgaagacgtcggcgtttgcccgcaggaaggagacgagcgcgtcttcctatttgtcgtccagaagaccaccgattcgtgtggtcttggacgggccgtcgcctagggcaacctccttgaccgggacctcgtcgcacgtgacctccgctgccttggggcggccgggacggaggtgctgagcctctcgtcgccacccgcgggcttggacgccgcggcgaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccctaggaccgtgttttagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcttcgatgtcctcggcggtggccttctgcttggcctcacttcgccggttgccggcgggagccgccggggccttgccctcacggcgctcctgcctcttctcctcctcccacttcctcgtccgctcagccaaacttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcgttggaacgggccgacctcttcttcctcctcctgtcccgccgccctgaccgtgcggcggacccgggggcggccagagctgccacaccagaaccggaggagttccaggtccaggcctcctccttgcgaaccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcacccccggcagcctcgatcccggtcgtgtagatctggagaaactcggcggggttgacgcttccgtcgtatttttcggtgatggtgggccggaaccttgggggccaacggacgttccgaaggctctccacaaaggctcgacagccggcaccgccaaccggggacacggggggccggcccccgtgtccggaccgaagtggcgctccggacgaggaagcgccctccgttgcgtgggcggcgcgacgagcgtcgcgccggtgctcgatatcgaggcgggcatccggccccccacgcacatcttcttgggtcggaggcgttgacgagggaatggcggacgaacggcgggtaacggccgccgctcgccgcgccctcctcctcgacgacatggagccggcggcggcagcgccagaggcctcggtggcggaggaccgcccgccggcgcctaccgccggcgcctaggcgctgctgcgccgtcatgaccaagtcggccacgtcatccagccaacgtcgggctggagtctctggatcggggacgacgggcgggtgacgcaggagcgcgcccgcagcctggagcgcgccctggggcgtgccgccatcgcggtagacgaggcggcgacgcgccccgtctcgccgtcctcccccgtcgcccgcgggcggcgaagtcgcggatccttcgacctccccgagcgcctccccccgcccaagatttcggcgagagggggacggtggggtgcgagcccgacggcgcgggttccgctccccgtcgtcaccgctagcgctcggagagaggctgtgcgccactgcccgttcggccattgggctgagcgggagaagcttggcgcacacgaaagaggacgagggcttagaaagacacgcgcgcccctacctggcgcgccagatgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgtgtgaaggaatacagagagccggagagcgagagagagttcaggctctagcacccattcgccagagtcccaactcctcttcctctttttttcctctttctccccctttttccttcctcctaggcctgggcctcctttttatctggtcaggggtcaccacatgggcctccagctgcctaagaaaggaaacatgctttttacaatgagggctagtctacagccggaagtgacctctgacaagcagagcccacgcctcctgccccgctcgccagcttttccggtggacgcccatttcaaccttcattcaatggccagcgacttccttgccatgcttgcgctgaagcttggaatggatttgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggctaagcgtgcgctgcgccgcattaaatgtggcgtggcgcgctcgtccaacccgctataaatgcggttaggtgagccccgctgtgctcacctaacccacacacgtggcgccaaaaccacagggggtcggggcgccccagccctcggggccgaaacgggggcgccccagccctcggggagacagagggaggggtggccacgtcaccctcgggcccgacccccccccctgagggggtcaggctacgtgggtgaccgcggctacctaagcctctagtcatgatacccccggccccatgtcaccgacaataggttttaacaatactaaaacatatagttttgtgataatgaagacactaaacctatagttttgtgataaatgaagatattaaatatgtagttctgtgaaacaagttcttaaatatgtagttatgtgatatattatgcaaaatacatgtagttttgtgataaacaaagacactaaatctgtagttttgtgaaacaagttcttaaatatgcagttttgtgatagatcatgcaaagtatatgtagttttataaaatttactctatatttaactattcattaatttaaaaatatactgccttctttttttaaataaatgtcactgttaacttttagtcacacatttgatcattcgtcttattcaaaaaatttatgtaattacataatttatgttgttgtgacttgttttatcactcaaagtactttaagtatgatttatattttatacatttacataaaatttttaaaaatataaatggtaaaaaatgtgattaaaagtgaacggcgttatctattaaaaacaaatggagtatataattattatttattttcttgtgacttagtttatcactaaagatatttacacataataatttctaaacatgataaatgaaaatagaatgcagagtctgcaatacgggagagagctccaatgccaacagtaatagcctagcaacggtgacagatttgtctagcctccgacatattgtagcacacgctactgtagcgatgtaatctgaaccgttagattgtgatcgtgtggttggaagtttctcagaatgcacacaacggaacgaagcagtcacgctcgtgcgatgaagatcggacgacgcagctgcgctcgagccacgtcaaaggatctagctagtactacgagccatgcgtaaaaaaaaaagaaggaaaaaataaggcgtgcgactagagacacacgaaacgcgagtacgccgacgccgcgacgcgtcctttcgtttcgctcccctcctccccccgatctccgccgccgccgccgccgccgccttccgatctccgcctccctcccctccggatccccgcgctcgccgtcgacgcgctccctctcctccgcccctgcgtctcggcccacggtgaggtgccctccctcctctccgcaaggtctctgtgcggatcctcctcttcttccctcccgccctcgtacgccgcgcgctagggttagtcaggattcggtttggggggagagtttgcgtggttagcgtagcaaaactagcaataggagatttacgcagtgacgcctcttaatcctcgcgtttctgtgggatgttttgctgttgggataaacgagcaatcgagatttgttcatatttcgtcaaataaattattattactttttgaatctgctcgtgatgtgcgttgcgcttgggttattcggagatgaatcatcctgcttgtgtaaacagctgatagcattttggggaattaaggtctgccttgcaatgctcataaaaaaatactaatcatgttggtttttcagtatttttctaactctggctagcatatcaactcctgctactttatttgctgcacaacatattagttccttataatgtgcttctctgtttgatgcgtctgttgcgtggcaccgtagctgcacatgtgaaagacacgccgtttatatttttcatctacttgatctgtaccccatctgatcttagcttctctattcctatcaaataggttacctgaggtgaatacattggagttggctgggatacttctgatttgaggagattataaattggaacaatgcctccccataagatagagacaggccaccaggatgttgtgcatgacattgccatggattactatgggaagcgcatcgctacagcctcttctgataacacaataaagatcattggtgtaagtggcaactctcaccagcagcttgctactctgagtggacatcagggccctgtctggcaagttgcatgggctcatcctaagtatggttccttgctggcatcctgcagctatgatgggagggttatcatatggaaggaagggagcaagcctgatgaatgggcgcaggcgcacactttcattgagcacaagtcctctgtcaattccattgcttgggcacctcatgagcttgggctgtgcttggcttgtggctcatctgatggcaacatttcagtcttcactgctcgttctgatggtgggtgggacacaacacgcatcgatcaggctcacccagtgggtgtcacctctgtttcttgggctcctgcaatggcgccgggtgctctaatcaatacagggccttccggtcagtttgaatatgttcagaaacttgcctctggtggttgtgacaatacagtcaaggtatggaaactgtacaacgggagttggaggatggattgctttccggctcttcagatgcacagggactgggtgagagatgttgcctgggctccaaatctaggcctcccaaagtcaacaattgcaagtgcctcccaggatggaacggttgtaatctggacagcaccgaaagaaggcgagcagtgggaaggcagggttctctatgatttccagacacctgtgtggaggttatcctggtcattgactgggaatattctggcagtgtctgatggtaatgataatgtgaccctatggaaagaagccgtcgatggcgaatggcagcaagtgaccactgttgaggcttaggtgttttgagttgttcttcccctggctgccaattataacatatgtgtagccttcaggctggccaatggctctctgcttacaatgtggctctagtaattttgcttctgctcagcaattagcaaggcgcaagtaatttgcttggatagagtagaaaaccctttgtgtcgcaactctttcatgtattatgtgttcccttgtgtgccttctgtttaccattatttatggcacttctgagtgcagatttttcgctatcctgcgactgtttaatgctgcccgtaagcgattatgatatgtcatcattcttagcaacgaaagcaagaatctttagatcttgattgagaagtttggtagccgaagtttttaatccctgtcagtgtggtctggtaggtgttcatccattgcagcttcgtgcacggaacatgaaattaaacgatgcatataagagtgggaaaaagcttgtttggaatcttccgttatcaatttcttactttgcttctacgtgagtctaaaacaactttattttggataggacggactattttttttttcaaaagaagtcgatgtatccggatagtgtaatcaagtcgtaaaattttacgaatacaaacatgtgtttatcctctgtttgactcatatttgacctgtttattattccattcgttcaaaaatatttggcgttggttcatcgcaaaaaagaaagaaatggagggagtagcttttgtaatttcttttctcatcatcattgtaataagagcaaaataggtttttactatttaaattcggccaaaaagcggcctatttcccagaaaaagctgtccatcaatagcagaagcccccaaaaaacttgaaagtgtaactaacacgttgtgggaccaagagacgatcccgaccgtccatccggggaaccgcgccgatctccagccgtcgatcgggctccacgaccgtttccctcctcgccgcccgggcccccccccccccctcctccttccgttccccgtttcctccctttcccctctcctcctcatcctccccgacgacgaggcaagcgcgagcgcgaggcgagccgcggcgacctagggtttcgtcgcgccttcctcctcccctcccccgccgcggccgtcgccggagacgacaaggtatgcccgcacgcgcgcctctctctctctctctccccttcgtcccacttgcgagcgatcccccacgcgagccgcctcctgtggttgtggtgtgggttgttgttgtttgatcctgggtgtatcctgctacgttgcagtgttgggtggttgcgggtggagttcgatgctctggatttcgcgcgaatcctagtattttagagttgttgttggttggtgatgctgtggaggggggattggggtctcctccatgcttcgtgattgctggttctagatgtttcctgttgttttttcgtgcgtaacgcatcctttgcttagtgccttggttgatcgagttgcagtgtgcctcgggctgccttgtaggccagacattgctataatttctcagcctgtctgttgagaaatctgaaatgaaggtgtgtaatatgtaggggtgtcaccaggaaggaagtgaaatcctcgttttgttcaagttgcattatatatctaggaaccttatggtagctttgtgctggagtgcgggtgtggaatacatttgtgcacttttttgcactggagtgcggatgtgaaatacatttttgcacttgttccttgcaagttgcaactatgtgtgattaggctattggttgaagttgggtgacagatttggagctcgaggcaataggatgttaaaaactattttattatggttgcagttacaatttgctgtcgttctatgcctaccctgtttttcattactattcatgtccctaattgttgaccatttttatgtaagattgcactgttaagaaaaaaaaatgtatatggactgtggtgtcatctttactaagtactaatagtactgaactgttgcctacagcttttttaaactgtacatagctaaaatgttttatgttcccaattccaaggtttagttttctggatggcaagttatttttgattgaagtatgagatcagtttttggttgttggaatactttatctaggacctgatcactttggacatagtattgtggaaaacttttatatggtgatctgcaacttttgtgcgttaacttatacggaaaccaaactactatgtgacagaagaagcagacagagagatatctcagctagttatttcttattagatagtagtaatactttttttttgcactgcctcttcggttgagtaatcctcatagtaggcatgctgtgtggaataagttaatttctcagcaaagtttggcagacatgaaaatgcagtttatgatctgatgaatcttcactatttgtacacattttaccaagagttccttgcacatgtaacaggtctgctggagtgccaataatggagcggtcttctcggttgaatccaaacgccactccctttgtgcctccccccaggccttcatttgaagaaagcttgagcaaaagaaaggcctctgagaagcaagtaggtgatactgaaaaggatgagaatgctgacaagtctgctgaatatgagctcccagattccctttctttggatgactatgctgaaagcctaggaaagctcaacatttctgcagaatcttcatcaaaaggagaagctacaaacagtgcgtttgatccatcacagtatgagcaaaatggtgttgataatcatcttgctgtggtagaatctctctcaaagatgttcccagatgtgtctgccgacttcattgttgaagcactgaaggcccatgaatttgatacagaactcacaatcgatatgcttgctgatctggtatgtgaaattactacttctattctctgcctacgatatttcaagctattattgttgtttgcacaccttaccttgaaactgcatgctaactaacatttttgttgttgaaatcatctctgacaatctctctcgttgaattttctacttcagtgtgaaggtgatgattatgggcatcctgctgaagtgtcagcgaagtagcagcagcaacggcgtcgctcttcatctaccttggcagaacaattacccttcagctacatgttattgaagtcattcttcttgacaatcaagactgaatttggtggtgtacaacttattgctgctgtaaagaactcagccttgtttaggagccaaagcaacaaagaccgtgttttgggtttttagttcctggtggaacagctattctcagtactttgagtctgcatcatgttgatgatttcacccagcagtttatcgcgtgatctgttgcaacccttttggtgtagctgtacctctcctagctaagtgttcaggagccagcaatcgcgtgcagttttgctgcaaggctgtgctcctaccatgtacattctggtcttgctgcattctgtgtagggagatgaaccattcctcttattctgttatgatgcattgtttgaacagatatctcgttccagttattgaatggagatttggaggctatgatagtcttggttatgacttaatgaagcctcactataaataatcttatatatatattttttacttactagttactaccttcatcccatgattttgtctcggcacactaaccggtatctctagctatttcttcaagccgtagtggtcaaaattgcatttcaagaccgtgcagatatcaaaaacatttctctcatgacttggattgaatggtattagtatttgggaccacttttagaaggcaccatcctaatggcaatgctaatcccacacgtccagagcattatgtgtgtgcttgcttaaggtgttctcttgaggaaatgttcacatctcccttttgtaatttctccaagaaaaatacaaaaaaaaaacggctttcatttgtgtgttctgttggaaaacaacaaaaaaaaggcacacacccattgcatttccttgtgtcactggggaatcctcacgaataagaaatcattttttcccctcttctccaaactggcacccgctcgaccgtcggatgaagcgtcccaaccacactccaccgtccgatccacccctcgtgttccggggggggggggggggggggtttaaccgcacaaagccagaagaaaaaagggaaaacctgtggccgcgagcgcaagagcacaagagtgcacgaagacgagacgagagcgagctgttcatcctcccactccacctcggagctgagctctgcttctctcccgatctctccacccaccgcagcagcatcctttcgacctctctagggttccagcctcgagttggcctcgtccccccccccccccccccacattcgctgcgaggttgctgctcgcttcacttgtcttcggtttgatttccccccacctaactgattctgattgatacggctcggctcgtgtgtgcggctcacttaggtttgggattctcttccggattggattggtggagtggcagggaattgttagttctggtgtggtttgtggttaagagaaggggtgaggttcttgctgccgtgtatctgtactgattccttttgcatagttgtttttttttcttttcgtgtatactgttatctgctactgtatgagagacttatgttttggctaatgttctcgattggaagctatgaaaatgtaattttgatctatcttatttcctatttttgttcagggaaatagctatggagtgtctgaccacaagttttactaggtaagttattctcttgattgtgcaatattattattcagatatagaatactccaacatgaacagcatgtatgtatgatctattgatattgtccgtaatctgattttagcttggtaagttagttaatccccgtacgactttcagaattccccatgccctgttgaaaccacatccagaatgcatagttcttcttttaccccccttttatcattactttaacatggttaggtgatgtttttggtgaaggaatccgggaagggagtataatctcatatgtccgagcgaagctctgtctgaaaaacaaaggattcaaagaagggttctatgctattttccagcttccacaaactcaagacgatgtcgcaagttcacaactatggcatatcctgttagcccaatagctggcagacgttcaaattggagatcttttgctgcaagtctgaatttggaagatggtcctgcatcctctgactcaacatcatccccttcagagcaaactagtgatggtggtgaagtttatggtgacccttctgaaaatctgaattctcggaaacttaaatctgacgaggtatcatatcatccaattgtgtattgtttcacccatgcagttttttttctttgccaggacggcggaaggacacgccgtccgaaattcattagattttaaaaggagtacagtacaaatagcttggcaaacccgtgcagcttatcactctgcattcctgtaccatatgtcactcaaagattagcagagccagcatttcaattcctccaatgagttcactataaatgatctctactttcaaggcatacctcacgttattatactttcctgcataaatctttcagtccatttttaggagttattgtttgtatttgtcaaatattaggtcaacagggggtttttaatgtagcatctgcgtaagagaaatatgtatctgtatgatatctatgtggtcttattccctagcagctaagacagcttaaggagatattctccttaacccttataatcataagtattagagagtgacctccttcagaaatgaactcaacagagaaatggcaaacttgattgtagctctaacagttgatgtttcggttcgtagatcgcacttgaaagattgatacttccaaagtacaaagaacaacgttgcaacttggtcttttttttttcttttcgattagcaacctacagacactagcattattttatatatgactaatgttgtgcttctctttttattttggcatgcagttgaaatctcttttggctgattcagaacgatctaagcttttgaaaaagcttagtgaagcaaaccaatacaaccggttcctcaagagacaggttctattattgtacctttttccaaagtgttcattgaattgcatcatatatactgttcacaattatcagcaaataacataatacagaattgttcatactgaatagctttctattatctgcgacttgaactttatgctttctactgaagatagcgcctagacgttttgtaaaatgaaaaacaattactctgtccaggcactgtatttgctgtcatgatgcaagtcagcaagaactagcaattttgttcagtcaggatcgaatagaatatagaactccccttttacttgtagattactgttgttgattcactttatgctacgcactatatcgccagaaaaattacattttttttataaaaaatctataatgcattttgtagtacaaatgtatttaaatattcctaacgaatccaggactttgaactactgaaagtatcttaggatatttttctttaaaaaatcattcatgaactagtttgctaaattgaagcttcttttgcatcagatgaatatttttgtgagattacattttttttgtataaatagctgtccatacagagttgtggttatgtcaaatatgcacaattccatttctcttattaagcactgaatcattgctaactagatagaaatgtactatttcttgcagttgcaaatgaaggataatgacgttgtgaagttcaagagtgaacttgccgttatggaacttgaactgcaggttagctctaacagacttttcttgtttcatagttcaatcataagccctttggggacaggggatgctatcaacatgcctttaactcatctagcatcttgagaattcattcataacttcatgtttccttttccataaagatatcagactgtaaatacatgaatgaagtatgtctggcttcctctaaaggattgtatgattttgtatgcctctgtactttgtctcccctaggactggctttaaatcaatatattttgtttcttggttttgttcaaacttttatcagtgatcagtattgttgatactgttactctaaatgtatttacattttgtatgtattcactgtttctttatgtccacaggctctggttgccctagctgaagagattgctaattttgatgttccatctgggtctaggaagataaatggaaaatatatccagtcacatcttctcaccagattagaaggttatctctatcacaatgctccaagttgaattaacaatgaaattttctgacgaaatgtttgtttcctatagctgttcatgataaggttatggaacaaattaaggatgtagactctttaaagcaccaagaaatttctgtcttctgggttggcattgctgaggtaaaacaaggtttttgacttaactcgttatatggaacagaactattgtcatatatctacagctatcatttatgtcctctattgttcttcattggttttttgtctgcacatcagaatgtacaaattatgggctccttcgatggctggtcccagggagaggcaatgtccatggagtattcaggttaccaagcaagattctctgcaactctgaatcttagacctgggaggtgtgttttgtgaattctgcagagcgatctgatttgctatgatttatttattaactaaacaatctcacttatctgtttgtatgcaaaataaaggtatgagatcaaattcttggttgatggagagtggaggctgtcactggagtacccaattgatggcgaaggttcaatgcagaacaatatacttgttgtaaattaatgtagatatctgttggctcctagtttgccatagttgtaacttgcagctataaaacctagcgcaagattgaactgtactcgattgctatcatgcatccgatttgcaaaatttcactttaccatgaaatgcaaggcctttttttcctggttggatgtacatttagctcagttactttcacattctaaattgatatactgaagtccagggactacattgatagacaggcactcccactgggttgcacaccatcaggctcagaaaaggatccttgggctgtggaaattctgccaaagtaccaattatgaaatattcctacagaatgtataattgaattggatctttcatgctgctgcaagagtataccattttctgattcgtcgccgcttgaaaatcgaggcagccttgtaagtcagtgccactgcacatcagcacattttcgctcttcagtattgtctatattttcactgagcatatagaaaagcaagttccataatgatatcaaacatgcatcaaattctgtacttatttgctaatgtagctgtcatcctagcaaaaagatctgaagcaatttgtgcctttctctttccggttattattcaagatgaaacaatgttcatggtatattgacactctctaaggcatgttcctttttacagtgatttttgacaggtctgaactttcttgtatgtgtatcagtagtaaaaacttgagaaatctgtttgatgttcctgctactggtttcacactttcagctacattttttacaactaatctgagctagcgcaggaactcccgatgttatcagctacctcctggaccatcagcctgacgaccaccggagccgccgctccggagcctgacctcgccgtcaccgacatcgacggcaatgccgggacgacgtcgaggcactcctggaagtcggcgtcgcaggacagaagcacccactcgtggtcgtcgtccaggtacttgacgtcgaaggcgccggcgtccaggctcagccgcttggccaccaccgccttcaccgccgcgacgccggctgagcacggcaccctgaacctgatgatgtcacctctgtggctggccttgatggtgaccacgccgtcgccattgccgcacctcggaggttttcgcaatgcagttttggcgtgagatggcggcgcctggcatgatccatgggaggaggtctctcctacggtacttgacaggcatggccgcggtggcggcggcggcggagggagaagaagagctgggtgagcaggcatggccaccggcggcgacggcgagcagttcacggattccatgacgcgcttcatcttgtcgagggagcggttcaccttgctgatcttgcgaaatggccaccttgggatgccatgctgcctgcagatgcgtttcattgttgttgggcatactgcaaaacaagaggataaaactgtcacctggtgatccaactttcagtggttgcgtgttaatttgcgcataaacatcaggattttgatgaagataatccactgaatatccagctgattcatttaactcatcaattatcatgatgattatatgcaggttgttggcaagtgtgatgttgtcttaccaccgaggcttcttgcagcatccttcaagctaccagagaagtgtttctgcagctcctccaaagtgacagatttctcagcttttcctcttttcgtcttgttcttgccaacttgtgatgtaggatcctcatttctgatttgatctgcattgtgaatgttaagctcaccaatgtttgtgttctccagcagctgcagatcctcctcgtccgagcatctttgatcatctccaagatcatccatttcatgccttagttggtgatcaccatctgccatagtatccaagaacaaatcatccaagttgctgatcacaatggctttcaggttgccggagcattgcttgatcgtggcggagacggcgtccaccgccgccttctgctccgcgacgccggtgcagtccggcgggaggaagagctccagcacgacgcagtcctcttcgtcgccggcggtggcggcggcggcgtccgccatggccgccgcgctgagctcagcgcgtagcacgaggcatccggcgaggccgtacatgccagcgtagtgcgcgagagggtagtcgtccttggagcaccgcgcgacgtcggcgcagaggcggccgccgcccggcgcgcgcgccgcggtgccgacgagcccctggccacgctgcaggtggtgctcgacgcaggcgtcgcggaagccccgcgcgtccgcgccggcggcgaggtggaacggcgcgccggcggtcgtcagcgcggccttctccgtgtcctcgccgccgccgccgcagctccagcatctcacccatgtctgtgccaatggcagcttgtgagcttcgcacaccgtgatcaggagctccgatacctcggccatggccgcccgggtcgcatctcgatggactatctggttcacggcaagcgagtaacactggatcagtagatgaacggatcatgcaatttctcgtgaaatttcatgtgatctcaactctcacctcggctgcacggttgcaaatccctgcacctctcagtgacactgcctgcatatgaacacaagaaatgttaatcacttcactaatctaatcactcctgctaatcatttcttgatcgagacagagagattacccgaagagcgttgcagaggttggcgacctcgccggagacgcggagcagcggggcggtggtgacgagctcgagcacggcgaggggggagctcgcgtcgtcggggtcaaggatggggagggcgaggctgccctggatgtcgtagatgagcgcgtagctaatgcgggcgtactcgccgctgccgtagcactgcacgttgggcgtccactccggcgccgtcgcgtcgaacgccctggcaggaagcccctgctcgtcggcggcggcggcgccgccgacggggaagacgcgcgtgagggagacggtcctgtactggaacaggcggtggcactgcgacgccaggacgaacggctgcccccgcgtggcgagcacgcgccgggcgccgtccctcgccggcgcccacacctggaccatccacccgccgccgccgtcgcccgccgcctccttgtacagccgcagcgcccgcgcgatccgctgcttcaccgcgacggccgccgcctcctccgtccccggcgatccccctccccctccctcgctcccacctgcgcacgcacgcatacaaacaaacaccttcatctcatggaccatctcgacgcgttcttgcagatcaagaagctcaaatcaagcgcatcggcgtggcgcctacacggacgttcaccggcggcgccgccgcgttggaggaggaggttgaagtcgccaacaacgcgctccatgtcggcctccacctcaaccaccaagaccgatccaccacgcagaccaaccaaacaaagaagaagacgatgcgaatatgcgacccgaatcgatggcagctaccgctccatctccatctccatctgcatggcgcgaccaatgtcgagccgcagcttcccaaatctcgcttctctggtcaacgtctgtagccaccttgtttaatcgcggcccgggggggggggggggagtggaatattatgtcctgggttaggatgtgcgggaggagattagatctgggaggggttaattaatcggagggggagtgattacacaaaattatcatcgtgtcccactgccgctttggacttgccattgccatcttggatatgggagaagaaaacataaacaatgttactactagtgtagtagtagtaggcgactcgtagtaatcctctttgattgattttaaagaaaaacaacaatcgtgaaaaacggaccgaaaagagccgaaaatgggaaacggaactatcaacgaaaatgtgtaaaatttaagtaagaagaaacaacgagctataacaatattatgcttcacacgctaaatacatgtatatatataactttatagtttattccatccgtctaagcaaccttatttttagtttgtcttagacatatattagtacctgaaaaagcttccgtgcattgcaacggatattcggaagaaactaaatatttagctacttcaaaaattcaggatgttttgtcctaattgtccctccgtggccctttgtaagtcgcctctatatttgaaattcgttgcaaaccaatttcttcgacttccgctgacatggcagattgactatgactcgccgagtcaattggtgggacccatgtgtcaacgactttctcttcatttcatcttcctcctcacccctctcaatctctctttcctctcttcccacaagcgtgtcatggaggagatccgggattccaaatcgagtccgccgtcgtcaaccgctcaacgcttctcgacgccagcctccccggaggtccgaggaggcccacgggcaggagagcacagtaatggcgtgttgacgacgctaccaccatgagcgccatcgtacgaagcagcaacgtggaggtgtcatcggccgagttgccgatgaggaaggaggatgattgcaatggccgcatcaatggcaattggagcaacaactcttggaagaatgtcacaccctgccttggcatcacataatagtgacaccagagagggtacgacgcagaaaatccacatgaaccgaatcccacaaaacctcgctgctggtaccagtccaaagatacaattgcttgtacctgcaaccaacagagattcatcatagcaattaaacatactatagatagattgtacctttaagaggtcacaccttcggggtaactcctggagtgtaaccggcaagcagaaaagcaacaacgaaacctaacatagctagacccaatccacatgcaatggcctgggactaataaggaaactctattcttcaacttcacttcactcttcctgtagaggaaaaacaacgattgagtacatacgtacttagcaagtcacggaaatgtggggttgcaggatgcaaaggagggctaggattgttttgtaaacttttagaatacatttttcaaaacactaagtgtcggaaagaagcttttgcctcaatcctatctgcaaattgcttgcaacaactcaagcgggcaaaggaactttttagttgattaaaactattctaccagttgccctaccatgaaaccggtgcatgatcttctgccatcaagcaacttccaactcatttcccaaatattagtttcttttcactttcaaaccatcgggcatcaacgcatctcataacacatttctttggctccaagagccatacacacaacttccactcgagaaacgtaatctatgatgccattagacatcttgatctacacaatattgttttagaccacgtaacggtcacccatcaacccacctagctgaatttagtaacggttttcattcccacaaattatttttgcaaatcacatgcaaacaaatctacacaagaggaatcacttcgcatccgcccttgaccatgggcacggttgttcgaacagtttcataacctctgcaaatgggtacactttacccacacgacgtgagcttactccaatcgcccaacgcgtattgattagatacaatcggtgaagcaaggttcacgacaagacatttccaaagccaaccgaagatacctcatgccacatagaagggttctctctgaaccgagcatcaggcaagcctcagccctcgtctacccatgaattcggaatgtcttcaaccattcgtgcctagcatgttaatgttcaatgtgtgcccaacgcaataaactatctcacatctcctcatttgttgcgcccggaaaaattgccttttcccaaacgctagtgtattaatcctcgtcccaggaaaagccggggtacaccacacaaacatgatacaaaagacacatctttattatatcgataatatttacattattacaaaggcacttaaggcctaacaaacaaaaataaacagcagtggactagcgggcctacgactccatcttcacaggcgctcaactggggtataagccaggactccacctaaaacttcttctccaaagcctctcttacagacgggggaaagatagagcaagaatgagtacaaccatagtactcagcaagccacaccgggagatgcatgattaatgcaagggggtacaaggggtaataataggggttaggttttacagtaaacagcatttaaaagtcacttagttgcccaaagctattttgtaaacatgatcctagagctacacaatgttattaatcaaggccgtgaacccacacgaacctgccttaacccaaggcctacgatgattcagaccgaactggcaacccgacctgggtcccagctcgtcccaagccaacccaggccaatcattccacattttagttgttaagcaagttttaaaaattaaaccactaacttgggtacattgctaggcttgccctaaacaagggcgcggctattcaaatagattatactatgaacagaggtgtacatctttacccacaagacacatctttactccgcattccaaagccttggaacccgtcgtaaacatgtgacataaccattcacccatcctagccgtgaacaaaagtaccgacccaacctcgcctacgtccggaatcctgggacaggtaggcaggattgagcccctagcagcagaacaccggccctatgccataacatctcgactaccgagccgcagcttgtgtaaccttcatttgccctagagatgtccatcgggccccgatttcgtccatctccatccgtttccttctgtttaggattagattgagcaccgagttaagccttacccattagatatgtggttagtacggtagtgctttgcaacagaggcccgaagaccggtccttatggtggccgaggtgctcctagcaaaaccacgcacctcgagcctagcctaaaaccattttgggagttttgaatagagggggaaggtgtgtgtttaattccatcacacgcaaaccattccataatgtccaattgatatgagaacttccaaagtctaaagttataaaccatctagtgttgcctaattaatcagcgaagcatctacctaaattcatactagtggaactattaatagagcacccactagctgggaatttgttttcctagggtaagcaaggtgataataaacaatatcaatgataaggctataacaaggattaataggtattgctaaataaaacagtgataacgtgggaatttaaataaagcgataatgcaataatttaaatcaaaatagttttataaactaggattcaatatgctcaagggtgatgcgacttgccttgctcagagagaacggccttccgaaccttcggcgatgaccgcgaaccatgcttcggaaacctccgaaacgacagaagctacgcgaaatacacaagcaaagctacaaccctataaaaaagcaataacaatacataaaaagaaagcacatggttcgttaggttataacaaacattaagagacttgaacgggtcaattcggagttcgtatgaccaaggcatggtcatcgaagtttaatgctgttatatggagatttgcggattattataattaagctttgcaactataaagcatgtgtaagcgctaccctggaaaagacgggaaggctgcgctgttgacaggcggaccccacatgtcaacctaagggaccacggtggaccgagtacatagagacggtccacgggtcgacgaaagcggaccccgtgtgtcaaccgaggcgagtggccgcaaacggactccactagacaccacgcgggctacacacgtagaaaccatgcggctaccgagcgggcacattaacacggacaccacacgcacacacgaacgactaccgacaccggtacacgggtaccggggtcgacaaccgcacaatgggcacagggcgataccgaaaggacgaggagggacccttaccatcacgcgacaaggcgtggaatgacgacgacgaacgggcgcggcggagatggctcggggacgacggaggcgaacagcgaggggacgacttcggcggcgattcttggacgaaggcgagacgcggccggcgcagggcttgacgacgcggagccgaggacgaagacgacgaggaggctacagcacacttgacgaaacgcgggcggcaaacgcaaacggcttgacggagggacgaacgccacgacgatcgggaacgacgagaggacgacgacgaccagggccagtaaggaggcgacgatggcagccgacagcagttgcatagaggtgaggacggcgtggaacacgccgctacaatgccgacgacggaggtggcgccgcgggacgacgagccggcgaggatgaacggccgaccggaagagtacatcgacgagaacgaacgatgaagacgacgacggtgacaccggcggggttcgggaggaggggaggcgagaccgagggcgaccttgccgctgcgatgccaagggaggagacgacgatgtcggccggtgcacgggcacggcggaaggggctgccggaggagacgttgacgaggaggaaggagaggctggtgcggcggcggcggtctctggacgaatccgagggcaggccggggtggagggcgacgtcaccatgccaagggaggagacggcagcgtcggccggcgcttaggcgcgacgaccggggcagctggaggcggcacagtggcggcaacgccattggactacggcaggaacgcgcctccggtggtttccccgtgaaacgaaggcgacgccggggaagaggatgcacctgcgaggccgaggatggcgacggcacggctggccggcacacaggcgaggcggcagaggcggctggaggtggccggcggcacaggatagagacgagggcgacggggagaggtggtgcggccacggggagacgcgggaggaggctaaaacgagagaacggaggaaggggattccattttataggtgaggggagggatctggccacgggaggagcggggaacggcggcgggaatggcggccggcggccacggaaggtgaccgggattgtcgcggccgttccgggcgattaatggcgctattcaagggggaaattagggggaaagagagaggaatcaatggggtttaatccccctaatcaattttggaattagtcatttgaatcgagcggatttgagggaggaagaagctagggttgcacgggagagagagaggaggccgcgcgggaggaggacgacgcgcctggcaggcgggtcccacgcgggaggcgcggtcaacgcgtggcaacggcgcacacgtgcgcggcacgggtgggaggcgcggctcggcttgggccgggcgaaaccgaggcggcccaggaggaggagagcagggagtgggccgggaaggagaggagggagggaggagggaggggcggcccaagagagagagaggtgaggaaaagagagggaggagagagggactttggccgcagggcgagggagaggtgggggcattgggccgaactgggcccaaaggaggaaggaggattatttttagtttttctttttaataaactttgttaatggttgttgttgcttaataattatttccgatgctctgaaaattcgagtaaaatttgaggactccttttagaccaaggagaatttaacaaaaattctccaggccacattcgaatttttcttgtatgtattttagtgtttgccaatttcttttcgaattttaattaattctattattccttttagagaattatttttatttcgggatgaatttatcaggacgtgacatcatctcaacaatccccaactattgacgtacaaggcatctttggttagctaattacttagccaagggtaaccagtacaaccggtgtggtcgtactcatcctttatttagcctgagacatcctttctgctgtttttttcctcgatctctcaagggtagaaaattccaaagtgagcgagaccaagacgagccagacgtgggggacctacatattattataatgcaattcccaaaggaaatcgtccttatatgcaaaaacagaaggtatccatttgcatcacgagttttcactaaccactttcatttcacaaacacaacactacctgtcgggttttaaaaaggttttgtaacccattttcccactttgacaaacaagttatacgagtaggaccgagataccacaaggtggagtgacgtgggattggtgtcatcaactacctattggattcatgcaactactaggtagatctgtcgattagttacatgaaccgaggcatgttaaattaatgtgcacattgcatgcaatttcgcaaacaaaaaattttaaaaactaggagtaatatgatcaaagggtgacttatctcagctcttcatcttcaactcttcgaagagagaaaatcaagaaaaccctaaaaataaaatattattattaataaataatagttccattgggtttatctcaattttagaaagatttggaaagttgaacgggtcaatcggagttacagatatggagatatgatctttggaatttaaaatgatttatggaataataggaaataatgaattgaaattggaactgaatattcagaatattccttgggctaaaggaaagttagaccttctgttttcggtttgagggttggtgggttcagtccaagagagtaggaggcctggtgaggtaggtaaatgggcttcatttgattgggcctagatagtacgagagagaagggagatcgatgcccactttgggcctggtagcatcgtggcctggcccaggtgcgagaccggcgcgggcgaaagtggtgcgcggccgcgggccgcagcctggtccgagggagaccagcgtgtgggtggcatagtggtggtcacctcggccgacgtggcagccacgccatcttggaccgacgggagttgaaccaccggggagatcgatggccggcgacgcacgacagtgagccgatgaatggtggcaggtaggagaaacggttgaagaacgagtgaaggacggggaactcattggctagcttggatggtggagatgggcaactatggacgccggcgatgagagtcgagaggacgagggtggcaacgagagagtgccatggttcggcggcagtggaggaatgcggctatggggaagagaaaatgtttaacttcaagggttttcctttccacaaggtgaccattgtagtatctatcaccccccaccccccaaaaaaaaaatatttctctataaagtgatttggctgtaaagttcttcctcttttctagaggccaaatcaactcatctctcttgtcagtcaaacaaaccccctccacctttatcattagttcttttggatctctcaaattatcccctgtaagtttcttctaaaagagagtttccagcccccatcatctttcacctctctgtagccctttgttgttcctttacattatataggtaaggaaaaagattctttaagggaacatgatcacaccaaacatctcccaaaaataagtactttcactattgttgactttcttttcctgaaacttattcacccaaaagttgatctcatgcaaactcttttaaaattatgaccccctacctcataactctgaaagaaccccttttgctgcatgtatttttttccaagaacttccaaacaaatatcattattgtcactttctagttagtaatccatttacttaataaacatatattcataactcttgtgtccaagaaacctaaacctccaatatctgttggtctacacaaagcctcccacttaaccatgtgatatttttttctttaccacctcgcctgccaataaaatctcctcctcatagagcccccacttaatattttttttagtttatcccctccttgcaaataaaatctctccctcacagagtccatcttgttgtgagtgctctcaggtaacctataaaagcccattgcacacatagttatgcttgacaaacatgaatttattagcacttctcttcccccacaagataagtagttggcttttcaagagtctaatctctcctcggttttcacccccacaatcatgagttctttcttaccaatcttctctccactaaatggtaatcctaaataaattattgggaagtcccccactttacaatttacaatttagcatatctataatttggctctctctctactcactccatcaatataactcacttttctgataattgattttcattactgacatttactcaaaacagaagagaaaaaactttagtgtcatcacatttttatctgtagcaaacaaaattgtatcatatgcatgcagattgtaagtgtgataaaacctcattcacaagatttggaactagtccttctaaaacccgttctctgttacatagctctaaaacctcctctgttgcagagctcaaaatcctttaaaaccccatctcaaccccctttgttgcagagctcaaaatcctctaaaaccccatctctgttgcagagctcaaaatcccaaaaaaaaaaacatcccctagcaagttgacggatggtcaccctgtctcaaaccaatcagtcttgaaatatggacctgtttttccattaatgtttaataacatccaaacaaagatcattattgtcaatttccagtttagtaattcatttacttaataaacatatatttataattcttgtgtcaaacaaaccaaccctccaatatcttttggtctacacaaagcctcccacttaaccatgtgatatttttttcttgtttaccccctcccttgccaataaaatcttccgctcacagagtccattttgttgtgaatgctctcaggtagcctataaaagcccattgcatatgtttgacaaatatgaatttattagcacttctcttccctataagataagtagtcggttttccaagaatctagtatcttctcagttttcacccccacaatcatgagttctttcttaccaatttttctccactcgacggtagtcccaaataaattattaaattataaagaagtccaccactttacaatttagcatatctgcaatttggttctctctctttactcacctcatctctataactcacttttctgataattgattttcattcctgacatttactcagaacagaagataaaaaactttagtgtcatcacatctttatctttagcaaacaaaattatatgtattgtaagtgtgataaactcctcattcacaagatttggaaccagtacttctaaaacccgctctctgttgcatagctctaaaaccccctcggttgcaaagctcaaaatcctctaccaccaccatctctcttgttacttgcaaagctcaaaatcctctacaaccaccatctcttgttacacagttcaaaattctagagaaaacatcatgtagcaagttgacggagggtcaccttgtctcaaacccctcggtcttaaaatatggacctggttctccattaatgtttatgaacttccaaacaaaaatcattactatcaatttccagtttaataatccattaacttaataaacatatattcataactcttgtgtcaaaaaaacctaagtccccaatacttttagtctacataaagcctcctacttaaccatgtgatattttttctctttatccacttccttccaataaaatcttcccctcacagagtccattttgttgtgaatgctctcaggtagcctataaaagcccactgcatacatagacctatgcttgacaaatatgaatttattagcatttctcttccccataagataagtagtcggttttccaagagtttaatatcttcacatttttcacccccacaatcatgagttctttcttaccaatcttctctccactttatggtagccccaaataaaattattgggaagtcccacactttacaagttagcatatatgcaatttggttctctctctttactcacctcatcacagtaactcacttttctgataatggattttcattcttgacatttactcaaaacattagagaaaaaactttagtgtcatcacatctttattttttagcaaattagtgtaagtgtgataaaccctcattcacaatatttagaaccagtccttctaaaacccgctctctgttgcagagctctaaaatccctctccgttgcagagcttaaaatcccctctctgttgcagagctcaaaatcctagacaaaacatccctaccaagttgacggagggtcatcctgtctcaaacccctcagtcttaaatataaaactggttcttcattaatgtttatactcacttgtttacacccaagtttcaaataggtgttttcctctaggagaccggtcgccttgtataggctggtcagaccgcggcctgaactccggtcagaccaccggcttgtgaccgatctgaccgacagagttcgagcccaagtctgttttatcgggtctcgagttttccttactcgggaaggtatgttttgggtttcctttggtttctatccaagttggacgtggaggaggacctgtagaggacaagaccaacccctatataagggacaaggctggttcaattgtaaaagatcatacaatcaatcaaaataatcgttttttttcaatattgctttgtactttgaattagttctagtttggtttgtccatctttgtcgatttgcgctgtatatcgtccactgccgcagcgaaaaattccgttttgcctacgagacgggtagttatctatcgttctatctaaatcggctccgctagccgatttaatctatcaaaacccatcttgacttaacgcttgctgggttggggtggttggtgactctacgatcatgtaacatacccgaattctaggagcgaggaatttccatcaaaaagttcttcaattttgtgaaccaaaaatttccattctaaacctaggtgaagttgatctaactcttgcatgaataaaatttgagggtaaattaaaaccttttcatctctaacctaggacataaatgcaaacacaagtgtagacatgcatactcacatatgaatggtttaacttgagtctttctagtgcatttggatctttgtttgcatttcatattaggtctcatgagcatgattaaaagataagttcactaagcaaaacctaaaagcgttcatgagtaataatattgaagacatgaaaaagaagtctaatattaccccttcaggttaagaggagtccagatataaattttataaacatttacatgcatttagaaatgggaaacatatataaagataagtcttactaattatctaaaataatttgtgcaagataaaatcatgaaaaaattaatgtaggctatgatcaccacatttaattcactgtaactttggtataatttaatatctacatttgatatctcaaataaatcaatcaaactaatcaaaaaatagattaactgtagtttttaccatacctaaccaaaatatgtattgaactgcatagaattatacatgagagataaattatttaaatactagattatttatcatggctaaatataatttttctagaattttacttctcatttcaggtctcataaaaattcaaactagcttccaataagctcgtcatctcctaatttctatgagcaatctatttataatttttgagtgtaaccaaagaaaataaaaactaggtatattcatctacctccaataaaattcacgtgaactcatctgcaccacaaattaatatatgaattaacaaagatgggaaaagaaataatcctgaaaatcatctaaattcattgttcactcaaactcaaacctatacccctcttgcctacctagtgtacaccgctctggacccacttggcagcctccccagctaacccagcctctgtccatttccattttctcaccgctcaacacgagggagaaaaggaaaaccggcgccgatctctctcggacgcgctcgacgcgtggcctcgacgtgtcacacgctgagctcgctttctcctcctcccaactgcatcgccctcattcctactccctcccaaaaccgagcagctcgagagggagagcctctgcctctccgccgctcaagttcttgccgccggccgcaaggatgacgaccgtcgccatcgccgattgagccgcggttgtctcgatctcttgttcgttcccttgtctcctctcagtgctggttccattccccttaagttcagtcgatttcatgcagtcgatgttccggaacacggaccttgctattgctgttctggagcaagcctggagcgccgccgtggatagcgtcgccgttcccgtcaatccggtggatctcaggccgaggcttcgcgccacgagaattgccaagatcccagtagcaagcccatcgaaggaatcgagctgaggcgtcgccatcgaggagatcgagcccttcttcttcaactccggccgctggccgtggtcgtcgattccttgatcccgggtgagcttcggcgcaattcctcactcgtgtagcatccttagatggtctttgagccgttacactccttctcttggcagcccggagtccggatagtggtcgtcatcgtcgccctgtcgatttccgccgccgccgggccattcctcgcgctgcctggccaccgtgccgagccatcgctgagccaaagcccaaaaggcatttccacccgtttagtacatcgtaaaagagggcaaaagcacattacatactgagatgtcttcgcgggattgggcatttgggcgagtcacgaatttctggcgacggggcaacgagccaacgaatgcacataaacgcgttgcatgtgaaaaaggaattgaaaaagaataataatctaatgaatctcaacctacttccttttgaatgtaaacacttttttgtttcagacaagaataaaaacaccttgttaatactgagatgtataatactgatataatagcaacgtttagtcagtcctcctcaaaacgaagtgtcaaatagcaatgcatataattaattatgcttgacaggtcaaaacagtaaaatttcggaactacagcctacttaaggctgcgttcgaacatgaaggtttccaacctctctcttgttttccgcgcgtacgcttttcaaactactaaacggtgtattttttgtaaaaagtttctatacgaaagttgttttaaaaaaatcaaattaatctatttttagaaaaaaaaattagctaatacttaattgatcacacattaatgaactgatccgttttccgtgcccaacccatcctattgaacgtagccaagtaatacagcaaaaactatatttgttagtgaaaactatatcaaaatttataaagaagtggaagagactgctgcacagatgaaattgcaaagagggacatggtaacatggcatttcttgcaaataatagctaaagattgtcaatgattgaaaattcagaaagctaaacaaaaccaatcctgacaacagcaacaaggatttgcaaagatatgaactaccaccaccctttgaactagtgccgaaccaagaagtttcttgtacttggaggatcactcagcatccaagttattatcaacatcatgccatttggcatcctcatgttaacaggactgcaactcagggcaaataaagtgcaacatacatttcatcctgaacagggaacatacagtagaacgtactaagacctggaactcaaagggcttgagctatcaacttcactaacatatccaggaacaagcatccaaaattaccaggttagtttttgtttttctctgcatctcaactcatgaatcatccttccagaggcacgcctttgtgacctcatccttgtcagtgctgctccgagtaagattctgccagagttattgtagggtgttagcatgtgcagcaaaatgtcccaatgcacaccaagctgcattaattcaagtcccctactatttcattgaatttattcactgggtatttcattgaacttattaatcaactgcaggcaagcatattgtacaaaaaaaaaagaaggcgttgggggggggtgaggaggaagtgaaatgaatagaaagttagaaagtaccatggcttgacactttgggtcgcattggttttctgttcataaagttcttctccaattccagttcttcaagtcgaccaaccaggaacagagctaactgcaactcagctaaaagtgtaggaaactctgcataccacatgcggtctacctcgtttgccttatatctgaaaccgagcttcagcaagtccagcctgtgacatacgaaatgtctaatagtgtcaagcagttcaaaatatgtccctcctaactccatatttctttcgttttgctccaagaatgctgtcatgaatgaattgcttcgagccttggtcaaccagatattcttgtaaggaatgcgtcttcttattcttgtgctaattgtactgtaacgtgttataccgagtttcagttgcctggctttatccttctcttcagccagcaaaattttccgaatgaactcatgaatcttcatataagcaatgttaatgttatcatcaggtaacaatgatacgtgagtaccaatcaagtacttgtaccgaaagccatccttttccatcaagctgagtagcatcccaaaatcagggggatgaactgtctcttcacccatggactcggataggagcttcctgaacaaaacagcaatatctctgtagtcctttctaaccccttcaacactccagttattaagagcaaaacacccctctagcagaacaaatttccaagatgatgttaccagaacggtgcttgtggatatctgagagaaacaatagcctgcctcgtgaaacgactcaaccagcacaatcaatgaatcaaagagatatttggtctgttccttcagcttagtgaatgtccattcttgacctaacacattgtatgtctccatcaacttattgcatctagcaaactcttttggatcgaatttcagctgaagaagtgtttcatcaattgtactcttctcagttttagtagcactaggattcagaggagtgttaattttcctaataaacagaagtacagagttcaaaaggaattagaacatggggaaaattcacttattctttgcatgtgattgaaatggtaatgaaaaattctgaaaagaaaatgacagcacagataattgtgtgatgcactaacatgcaaaattgaattcatcctagacaagttgaagtaaaaataacaaatctgactacaaatacaacgttcaattgcatttcagttccattcttgaattaatagattgggtaatgaagcttaccaaaaatcagcaggattagttggctgaggcggcgacggcggcggcggcggcgacgacgacgatggtggcacattggggacatgtgaatttgaacaccacctcctcaggacctgcagatggctagcgcttgctctcagtggttggtgtcgtcgtggcggcgatgatgattgcctccgcagcaacacacgcagtccaatcctctcttgttcgggtggctcgccatggatttctacgacacggtgtgatttggctgaggctctgaattctgatgccatcggcgttgccctccacaagattcgcttcatgcgtttcagcgccgcgagttggtactgaccagcgacgccgcggagatccggcggcggcgcggagccctgggagaggatgccgtggaggcggcgaggagggagactcgaggagaggaggcgatgatccaggcaaatactgaagatgatctcgtcaggcggcttcatcctcccaaccgcctcaaggaacaggttgcccaggtgacgccgaatgtagcgtatccgcgccgccaccaattccgtggaatcgcggcagccaagtggacacggccccacggcggcgctctcgacgacgaggtcgccgagcccgacgcgacgccggatgaagcgtcccccggtgatgaattctgtggaatcgcagcagcgaggtggagtcggccccgcgtcgacgtggcgatcgccgagcccgatgcgacgacgcatgaagcgactccccgctacgaatgccgtggaatcgcagcggcgaggtggaggcggccccgcgtcggcgcggcgatcgccgaacccgatgcgacgacgcatgaagcgactccccgctacgaattccgtgaaatcgcagcggcgaggtggagacggccccgtgtcggcgcggcgatcgctcccttctctctcgacgtcgatgaggaggttgccgagcccgaggcgaacgtcgacgaggaggttgccgagcccgaggcgaggccgaatgaatcctctccccgccgcgaattcctccgtggaatcacagcagcagcgaggtggaggcagcccggcggcgctcggggcgttgctgcggtggcggcatggagggtgcccgcacaccagctcggagtcggagcggtcagaaatccttcgcctgacggtgaggatttcgctggcggcgctcatggcgtggcggcgaagcgggctgtggcgcgcgatcggcatcatcaccagcttggagaaggcctccatgctgctggtgacgaaccggccgggcgccatttttggttggggtgctcgagagctcgagctcgaggaatttgtttgaaaccgcctctcggcttctagaagaagattcgaattggcgagtcggttggagacgaggcataaaatgatttatgattatgaggaatatgggtcgcgagagttagttgcttacttgcttctcgaagcgaacgctattatggacccaaaaccatcgtcacgtcttaacaaaaacgagattagttcctccaaatatctattatataattaaaggaatagaaaaaagagcctccacgttcgctctcatggcctagaaattctcatattaatcggagaaaaagaagaaaaagaaaaaacaaagtccatatagaaatacaatttaaaaatagtgaaattcggaattaaaaaataagggatattagaagaggagactagagtccatatagaaatacaattaggaaataactgaaattcggaattaaaatataaggaatattagaagaggagactagagtccatatagaaatacaattaggaaataactgaaattcggaattaaaaataaggaatattagaagtagagtatatagttcatatagaaatacaattaggaaatgaaagaaatttggagttaaaaataaggaatattagaaatagagtatagagtccatatagaaatacaattaagaaaaaaaaatagaaattcggaattaaaaaataaggattattagaagtagagtatagagtccatatagaaatttaaaactaactaaaatttggaataaacgagtccatatagaaatacaattaggaaataactaaaattcggaattaaaatataaggaatattagaagaggagactagagtccatatagaaatacaattaggaaataactgaaattcggaattaaaatataaggaatattagaagaggagactagagtctatatagaaatacaattaggaaatagctgaaattcggaattaaaaataaggaatattagaagaggagtatatagttcatatagaaatacaattaggaaatgaaagaaatttggagttaaaaataaggaatattagaaatagagtataaagtccatatagaaatacaattaagaaaaaaaaatagaaattcggaattaaaaaataaggattattagaagtagattatagagtccatatagaaatttaaaactaactaaaatttggaataaacataataaaattaaaagtagagtttagagtccgtataaaaatacaatttacaaataactaaaattcaaaattaagaaaaacatgggaataagagtttaatgtcaatataggaatacatatataggaatacaatttaaaagtaactgaaattcgaaattaaaaattaaagaatattgaaagatgagtttagagtccacatagaaatacaattagaaataataaaaattctaagtgctaattctaagtgcgtgcgtgcagatgcactgtcttggtttatccgttttcttttatcacactccctcttgtatcaacgactcaacacattaggaaaaagtagtttgcaaaaaaaaaaaaagatatagcattacttgtgatgacatatatgtggcttggacaagcctaccagagcaatgttgcgacttcttatggataaatattgcaagaagatggcatgttggcaacccaaattgctatccctggccaaccgcttggtgcatttttttttccactagtaatttgcccgtgctaacgctacggtatcataatactttttttaacgaattacatgctagtaaaaataaatttcctagaatccgtccgattgaaccttaatttgatgtaggttcacatattatgacgaagtataataattatattacctaaaaatattaattcaataccgtcaataagtatatcaaatcacttcaataccaatatatgagacaatatacatccacacaaaaataatggttttgtaaagaaaaataattgtcttatagagtaactcacctgcttcatcctcctcaccttatagagtaatacgatcaagagaatcagggatcctgagccactggttcaaaatgtgccatcaatgcggctctcctacatctcatccagtgtttttccattttgatagcaatcaatgagacaacgataaaaatgttcaatgggataaagagagaaccattaggagtaaattgttttttaccattatgttttttacagtgagtaacgagagaccaaaactccaaacggttagtatgtacttcctccgtttcataatataagactttctaacattgctcacattcatttatatgttaatgaatctagacatatatatatctatatgtatgtggacaatactagaaagtcttacattataaaacggagggagtaccagttagagaaatcttcaaaaaagaactaaaactccccacgattacctttaagaattccacctttttctcctatacacaagcctgctacagggtaaacatatgttttcttaggtaaaaaactccaccaagcagctgtccataatgagaaagagcatccaatcaagctgtgtgacattgttgaagagggaggaaatgtcaagcgcctctcgaacctattagacgtttttcaaaggcggaggaaatcccatgtacctctcgaacttctcaaacttgctgtatcttgtacggaacagaattattgaaaaataaatacagattgcaatagattagtaatgtgtgtatccgtttattttttgttgaaggaatcaagcagaaggctagaaaactgcaggaatgcagaaggctagaaaacttcttaatttggtcactgcattatacaacttacacaatgacttgcggcatttttgcactgcactgaacatcactaaagcaaacttgttggttattttttttaacggataaacgtgttagttcttacgtagtacatactaacaaataaacttatgatggtggcaatataagagtctgttgtgtaggcggctgaccggctgccttctcattgtggcaggtagacatgggctgatttcgaccttcccagcaaaatgcattgatttgaccaattgaccccatagaacatactacatccgtcccaaaataagtgcagctatatgtattcgtgtccaacgtttaaccgtccgtcttatttgaaaatttttaatgattagtatttttattgttattagatgataaaacatgaatattactttatgcgtgactatttttttaatcttttcataaaattttcaaataagacgaacggtcaaacgtagatacggatacccatggctgtacttattttggaacggagggagtagctttcaacaaaactctattcagtaaaggaaacatatgaagaatcagtgaagttaaaacaagaaatatattagcttcaggttaggagatttctgacaattatggtgcactgtcaggacgatagcaaagaatcaagaaatatagatcgcttcagaagcaccaaaatatgaaatagcatgagcctgagcagttaaaaattaaacattgcatatggtacaaaagtagaaatcgattaatctcgaggagatatcatggacattgcacaaaacaacggttgaaaggcactatgatcatacagtccattttcttcagacatttttaatacatacacttatttgtctatacaagatgtaattctaaatgtgtaagttgtctatggagtttggacataatagtaaacatgaacatcacaagaaaaattacctgcttgatggtcaatacaatcaccaccaccaagtctgttttgatctttgtattgtactccctctgtttctttttatttgacgctacagtgcaaatcagaatcgttttttttgtttgacgctaccagttcattcgtcctagtcacgtttgttaatttctatcgttgcccttcatctcaacatcgccacggcgctgcctcgtcctcatcgcgaccggactcgctcgccactgtctcctcctcccacgcgccgctgccgttcatgcctcccgtgcgccgccgccgcaccccaatttggcggcaacccaccccgagctgtggcctgtggggcgagcaagagtcaggcagcatggcgcacagggagccggacgtcgggcttgctgctgccgccactgttgttcttgccgctcggctgaaaccaagcagaacgtactgcatctgcagatgacatcgtcgttcttgccgttcggctggagatcaaccagaaccagggcttctcctctccttctgattaaattgtaaattgggcaaaaccaggcaatgaggcaattaaaattggaggaaatgagaaaaaaaaaacaagctggaagttggagaaggcgagatcgaggagctcacttacagagagggtgacgagtgaggagccgaggtccagggaggacatgctgcttggagacgagaaaggaggaggactgaatcgagaaggaccgcttgatctcaggctccaacgccgctttcaccgggaaggtctgagaagaaagggcgacgcggcgtccgggaagagcgttgtgcagcgggttccttctcctgtggtcgcgagcagcggcgtttgggagacgacgagcgagccggcgtcgaggcagcgcgggggagatggcaagggagccggagtggagggagccggcgtgcgcgaacactgcgatgaaaagggatgaagggcaaaatagtaaaatcgctctatccttaattttctcgatgctgtcggaaacgtcatatatattaaaacggagggagtataagaataaactctacatacactatcatgacacgctaaagagaacatgaaaaggaagagaggaaattcgttgtacctgcaggggtggaacagaggatggggggcagcttttggccttgatctgacgaggatcgtcaccaggggtgttggggtcgacggcgagcatgcggccttgaataatcaaataatacacttgatccacctgcataacgatgaggcaaccaaggccatgatcctctcctcgagatctaatcagttcgtccaatactcatagcaaccgttgcaacagagcatgagccatcataatcacacaaaaaaaaacaccttcaaactgtggcactgagtggcgacgctagagggttcgaggagtcgccatggtggacgatgggtttggcgctggggatctcgcggcgtgattttcgggtgggtacgagaaagaggagggggagagggggcaacgggagggggagcgatctgggcgctgatggggttggaagagcggcgaatacagaggtgggaggaggagaagatcaggagcgttggatctcatacgaataatctgaaccctagagtgatgaatgaaagaatgagtgaaagtatttgttgaactatagggtagatagatagaaccgatacagggtgtgtcaatttcattgaatactagtaatctgtctgtgttaacactacagtgacatttagaaacacaatttaagatagatagacatagttattattttgttaattaaattgccacatgcgtaaataacatagttattaaccatgtccaaatggggtcattagcgacaacatagcaaatattcggatttttttattttaaaattttattaatagacatttccgaaaaatatttccgaaaactgaaatttttggccacgccagccaagtagctagtgtggtagcgttgttttgccacgccagcctcttgccactgccacgccgactgtgtgtgacatgacaaagtgatttggccacgcccaggtttaccttaccgtttttggggaggttaccccccaacggtaaccgctaaaaaccgtgtgaatttcatctcgaaaaaattgaattaaaaaattggcggtttcgcggtttggtcgcggtttgacgcggtaaccgcgatattgcagaaaacatgaaaaaaaatgaaaaatactaaaaaataaaaaaaacacttaaatgcgtgtagaaagtagggataattagaataatatatatgatacttgcaaacctaacttgtggatgtaaaataaaaaatgaagcccaatacattttttttgtttttccatttcctaaacaattatcggttttgccctcaaatttgattttatcttactctttgtttttttaaaaaaatcaccatctagcattaaaaaccaagaactgtatccatgattttttttttgcttttttcgtttttttttggaatttttgaatttgctcaaatttcacccaaaccttaccgccggtaacccttaccgtacccccgcggtaagcaccgtggtaaccacgcagttaccggcggtaagggaaaccctagtgtggctaaaaggttcatatttgatgtcacgcccggaaattcacaagtaatttccaaacttatttgtgcataaaatcctcgtccaggaatcagccgaggtacacaaactgacaatttaatatacagattcatcataataataacgttacacacttacaaaagaaaagaaaacagcagcggaaaaacggtctagcgatggcttcagctccactcccacaggcagctcaactggggtataagccaaacgtcttctccttctggatcctttttcttcaactgaggttgattgattattgcaagaatgagtatatgacatactcaacaagccacacagcaaatatgcaagtgcacaaggataccaaaggatggcataatataggctcatttgcaaaagcagcgtttagcaaaacatttaagagaaataaaacagtagagtagttaatcagaaattttaatcaacaccgaacagcacacccatgctgcacaggcccgaccatcctgaacaaccatacccgactgtacagatctaatctccaaaccaggaattatccattccaaaccaggagctaagcaaattattaccagttataacatcattaatcattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgtaatgaatcatgttatacaaaaggtaaagccgttgctcacgctggcttgtggttggcacggttaatgtttcacaactgtagctcgcgaaccggtccttaattgccatgagcacgaccttcaaaaccatgtgctcacaacccaccattaatcatattttaattaccaattaattatcataacacgattaaccatcgtgagctaccattaagccatcattaaataacagtgagtcataagttatcccaatagtgtgctaatgtttctaagcatggctaagcaattatatctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatttgtgtgacttgccttgcaataatcggtcttcaattaatcttcttgaatacttccggcgcactcgcgaaccttcgcaacgacggaaacgacaagctaacacgcaaaacaaggaaaagactaataaaaaccaaataaacaatacataaaaagtaaacaaacatgtagatcataattttagatgaattatgagacttgaacggcctcattctgatttcatatgaatttattatgaattttacaagatttaattccaattaaacctattaaacggagactattccaaattaattaaatcatttacaaatgatttataacggagataaaagattaaagcaacctccggaaaagattagatcatatttggtagatgacatatattaaaaagaaataatatgccactgaaaagaggagaggatttatattgattttggacagctgagattaaccttgaccgagtcgactaagatcggatggcttggattgatctggcaagcgagcctcacgagataccgactcaacgagtcaactccacgtgacatgagatcacctaaatgatcaaccaaaaccggcgaacagaaccgacggctctgaacggctctaaactaaaggacgactcaacacggacgaatgaacgaagcacggggaacacctcgttcgaacgaacgagcgaacgactcaacaacggctgtggctaaaccggtcggctagacacgattcacggtaaagccctggtacgacaaacgataggccggtaggaacctagggttgcacctacggctacacaactcgactaaaagcagcggctaggtttaagcggcacacagctgcgacacggcggcactaagacaacttgactcggctaggcggcggctaggcggaaacacgcagctagggttagggtgacggcacagccggtagcgaccatgcacggctagagcagcagggctgcgagcaaaaacgcaaccggcacggctgcggctgtggcaaagcggcaaacagcggcagcggtagtgatgcatgatagcagcacggtgacggactgcggctgcgctaagtctaggcctctagggcaacagcgcggcaaagcggcaagcagctgcagctaagcggctcagccggcacacgcgcagcagcggcacggcaagcagctgcggggcaacgtggcaaggcgcgacgcggtagcgactaagcagcggtggctaagaggctcggtagagcgacggcaaaccgcagccgcacggcgtgcagcagctacgacacagcgacgacgacacacacgtggcttacataaacatctaccctaggaatcggagaggaggcctcaccgagaaacggtagcgaacggagaggaagaggcgacggctacggtccgacgacaacacacggagacgatgatgacgctagggccaaacaagattagattagatggaattaagactctagggataaactacaccggtgaacgacataggagcggcggttgccggcgaaccacggtacaataatgcaaacggagggcaccgggaggtagagaaggtgacggcgattcttaccaacacttacacgatgacgggcagcgacagaagatggccggcgacgagctccgaagggcggcgaggtactgtccacggaggcgacgactttccggcgatgtgcggcgacaacgaaggggtggccgggcttcacttcgcagctgcgaatccaatggaggcagcggcgaagcttggcgatgacgggaggagcagcagggcttcgcccgagatcaaaacgcgacggcgacgatggagctctggtggatttcggcttcggggagatggctgctgggctccctctccttcttgcgaacccaacggcggcagcggcgaccaaaagcggcggctaaggcggctgctagctacggctggagatcggaacatgacagcaacccaatggttcatggcgaggacggcttccggcgaagtttcggcgcaaggggaacggcggccggggtggagctcgaccttgcggagccgatggaggtggcggcgcaggaaggaggcagatgaggcggcgtctagggacggctggagcgcgccggcgtttggagagagaaggagagcgcggggacagcgtttccggcgacggcggcggacgggacttgaggggatgggtagaggacgactagggggtcctttatataggcacgggagctcgggatcaagcccacaacgacgggaaaaactcgggaaagtctagggttctcgccggaaaaaggaaggatttgatccgcgaaattggaaagaatttccatagaaaattttggggatttcttggggaaaaggaagaggagattgaggggattccattcccgcaactaatttggaaagaggagcaatggggaggtcggattggtgggaggaggcggcggcactgtgcacgagcacggctggctcggctctgtctggaggaggaagatggagtactgtagcgatagggaggtcaaacagactttatctgggctgagaggaagggagaggggaaaggagggaatgggctggattcggcccaagctgaggaggaggatttttattactttttccaattaaattaatcaatgaaatgatctttgaattgttaaaaatacttccaatgctcaaataattccaagaaaaatcttgaacatacttggacactcaaagtacttaacaaaattataattagaccatttaatgattaatttaatatgtgggtaatcactgaaatgctctttgtatgattaaaaattaggaattgagctccaaaaaatccgagaatattccagagagtataattaaccatggagaatttaataaaaaattaaatccatccatgctttatatttaggaaattttatttcccacatttaacttcacttgtaaattaatgaacatttaatataaattctattaagaatttattaaataatttataaatcctgaaacaaaaatcaggatgtgacatttgaaaatatttttcgaaaatgtctattaataaaattaaaaaaataaaaatgtctaaaatttttttaaaaaaatccatacattctctatggaatctgaaatgatcaaactgaatattcgacatgcatgatgagttacatgagtacattggaaaagaaagcaatttgcccaccttattcgataggtggatagtgctttaaactattctgctacacattggcatatccgcttaactaaaatctagatagtgtttaactatttgtgctactacacatacatgggagaattaaaccgtgatgataaacatgataattgttaatctccaaaaacattgtaatagctgaaaaatacaggaggtagcttatggtacacaaaaagatgaaaaaatcatgcagtgaaatttcgttgatatgcgaaacgacaaaatagctgaaataataggagctagcttatgagccgataaaaaaacaaaaatctaattttatatatgcattacgtatgtattgtctttagatatcatacgtcatcttttttttaagggaaactacggcgggtttgaacaccagcctgaactttattcatatggtaaaaaaaaactttacaaagggggaggtacagagggacggagggaagaaactaaaaattagtggttaattacagaaagatttagcgcccaagagtgaagttgttgtttgcctacaacgtcgttacatcggtttgaccacaattcgatatcgttggcgcaacgatgaagaactaccgagtgggcttcatcaatggagttgaagatcttgttgttgtggcgtttccagatgttccaaacggcggcgagtaagatggtgcgccagatccgtggggtgagagcattgtcagggggagggagaccccataggtcttcgagatgtgctagggaggcgacttgttgttcatcgagtccataggagtgccaaatggctgccactccggagcagctaaggaagagatgttccacatcttcgtcgatggggcagaaggggtagcacgcggaagttgcaagtccgcgtcgcacccgcctgtcattggtgaagatacgtcgcttgtgcgccatccaaaggaagatcttgcatttggtttgagcatggttgtcccaagtggtgaccaaagtaatggatcacattaatctatgaccatatatagcactgacaaaagaaagctaataatgattcagttttacaaaatcaatctattgtcttttggggctaattagtgaaaaccattgttaacagaatgtgttacaacaccaagtcaaatagcccataggatggtagttgattaacatgtcaaactaccacagtcccaggttgaggctgatcttgccaaaggagtggtagaccaattggtggagttcagccttcttggcaattccaacaccttccctcctcaacggcacctcaagtgacaataggatggaaaagaaacaccttcttagtaaatgatagcgtgtatctctattactttaaaattctgtagtggtagcggtgactccaaccctgacagacacacgcaatcgtacccattggatccagatatctaacgcttcagaatgcgtgctattggcagacacgcacatcccctccccaccccccgagtcgccgacctctcctcgttcctcacaaccaccgcgatctctcgccctcgatggctcgatccctctctccgccgctccctccaccgctcctggcatccaccgcgcctcctccgcgctctcctccccatcgccactgcggcgcctcgctgaaagacgtcgtccccactcatccatccagggcgtcatcgtcatgcgatcctggtgcagccgtgacctcacgcacacgtctctctccatagattagggttggggactcgcggctgggtggttgggtgaagcagcaagccagcaacgaggtgcttcggcgagccggcgatagcgaataagtggaggcgggcgcaggcatgcaacagcagccgggcgccgcggtggcgagccggcgagcagcatatggcggtagagcaggcgagggcgcaaggcaccaggcgactgccgactgggcaacgagaccaccgacgctgacagccgagcagctagcagattaggcggcgagcaacagcagctagaagaacaactaagcacccggtgaatcaatagttaatagtcactgaattaatgtctgaattagtcatggtcttgcactcttgtcctattgctttttttctataatgctatatatgcttaatcactgtaaatatgtaatctatcattctaatgaagttcaacaagaatagtatgagatttattacaagaattgagcctcatgttccatcgttttgatttattaatttgctatggagaagaaaacaacattgttaaaatattataaagcaattaaagtggcaaccttggatcgatgagagcgcaaactattctgatttagattgtgtatattgttgaccatgagatgtacatgattctgatttaaattatgtatattattgatcatgagatgtgcatgccatttttcaatcccaggaaagcctaggtccaggaagaatcaagcggaagttcagggacatgcacttgggaatctgctgaagttttctctgacatgatacggtgagactgtctttctctgaacttcttctggaaagtgaagaagttttgtgccatgcttagatctgttcttgtgttagttggtactctcttcagccagtaaactagcagagacaacgcttccgtttgcttgtgaaatcaatttttaatctgcgtgaatcaataaaatgttatatcaaatatttttgtcaacaatacaaccaaatatctatgcatcgaagaatataagcaaaaaaaaaatgccttgaccatagtaatcatttttaatttccgtcataccattagtctatcccaagccctacagctttgatggagctgtttgatgaatcagcgagcataggcacctcttccttatgaaactcaacagatccaactgaacctatgtggcctgattcacattgcacccaaatttagaattgatagttgagcgtccatcattaacagaaagcatttaacaatcttatttgcacaggatgaggttcatctgaattacaaataaatgtgcatggcccctatggccctatgctgcaatatgacataggtagaaatcaacagaaagatatatccagctcattcaatctaccctatagcgatcaacagaaaggacataggtagaaatcaacagaagcttttggattatatccagctcatgatcaactcaccagattatattgatgaatcactggaaaaaatttcaccacatttccatgcatacaaatgttgggggataaattcaaggccaacagcagtctctataaggatcatcaaatacaaacaggaggtggtgcgggggggggggggggggataaaatcaatattctcaaagatatatggttgtccctatagaatagtagaaactgttcatttcatacaagagtgtacacgtcgattttatcagcattagtcagaaaataacctaactaatcactgtgcaccaatctaaaattcagggattagatgaaagagtaatctgcaatattatggtaacttcgacatatattttgacaaaatttatattagagcaagtacccataaaccataatagccttctgaacattaaatcacaacatgagaggacctgaactgtgatttgcagtcaggaaaaaccaatgatatgaattagtaaaaagatttacaaggaaaaaccaatgatatctccaagcaaaatatatcatctgatttacaaggaaattgggaaataagaaatataaattaagcaaagaactttactgtcccctcacggacccaatataaattaagcatttgattttaataaatataatctgaaacggagggagtaatagctgattaaagcacccaataatatatttcgctgataagcttgtacatctccgacttgtgcttcacgaggcggagcactccagtgtcgtcgcagcgctccacctcgacggcggtgaacacagcgaacagctccgggttgtgttgttcgtcggcgtcgaagaagccggtctcgaagaacctggcgatgcagaagttggcagagcccaggtgcacgaggtgggaagacacctgcgtcaacgccttgggcggcgtgtactccagaggaaggaggctgtgctgctccggctttctcccgccgctaatgagatcagacgcagataggacgttgtcggtgccggacgcgaggccatagaacaggccgtgctccggcacgtacacggcgaggccggtgaacggcatcgcgcaccactcgccgccgctcgccaccgcgctccactctccgcgctccgtgtggaacctgtaggtgccgacgccttgcttggatatccagatgtccaccccatccaccaccgcgtaggagtcgaattggaagtcgccgcgttgcttcaccatgtaaggaggcggcgggagagtgtggcaacaccagtcgccgtcggcgtcggtgaagctctccctactataggttagggcgtggaagcagtgatcatggccgccggtgaacgggccctggatgtcgtcgaggatgtaaaggtcgtcgtcgccgatggtgagggacacgggggagaacttgggcatggggagggtgggcagggagcggacgacgtgctcgtcggggtcgtacaggagggtgcgccccgtcaggtcggtgccgactatcttgttatgccttccaccaaggagcatgaactccatcgtctccatcgggcagaccgatgcacggaagctcatcaccgggcatggcagattgccgtactccaccgccgccgcgccgtcgtgtgctccggcgtccagcggcgttgccaatttacgggggaggaagaagcgtgacatgtccatgcgccgcactgtgtagttgccttggaccttatcaagcaccagattcacaaatcgccggtaactcataactgatcttcctcctccaaattatgaacaggaatctactagatatgtatatgcactagttgcatatacgatcgatcgattagttggatttatccgaaattctttgtgcttcggatgttaattgttcatcttgttgattccaacacatcgaggcagcatgaatatctgtacctcgatttctccttgtacaaaaaccagaaataatccagcaattattactcacatctcccactgtattactactagtataacaattaggatcaaaaattgcgtagagtacctgcgatttacgaaaaaaccgactccggatttacttctgtccgccggaatccagtcgagtgttcatctggatccgatcgatatccaccggatttctcctactcctcctccacaacccggttgaatgcaagcagatggagaagcgaatcaggcgttgggttgcggggacgggcagcggcggcggcggcggcggcggcggcgattttttattctgctgcgagggacaaggaccaagacttatgttagggttatgtttgggctcgaatgggccgagggccgactaggcccataaagcgaaggttcaagtttgtctcccatatcctgattttcctttttcaaaccaatcctgcgattattttttccccctccttttgcaatgacaaattgacagtcctgcatgttgatttcgtctaggagggttaacttgagaaacgtaccaacaaaagcaatggatgctccacgcaactcagataagttatccagacgaggagtggtgatggtagtcaacaggtgggtgaccagaaattaacgttaactacaatcatagcttaatccatgcaaatcaacatcttatcagctttaattaattggcattataatgcaagcttgcttgctccatataaattggcacagagagaagaaggatcaggagtgcacctggcttacactgatcgatgctgttctcagttctcaccaccatttttacctcgaagatttctagattcgatcagcaaaccaattggaagcacaatgcagttcaggctggtgatcttggttctgctcctctcctgctcgcttcagctgcttcgcgcgtttccattccccatcccgttctttggccccttcacgagcccacaagacggtatttttttgcaacacttgtcagttgtcaccaagattttgatttcagacaagatgattttgatgtgatttcgtcgcttgcagttgatgcgataaacgagctgtacgcgtcgctgggctcgcctgacctccatggctgggcttcttcaggaggagacccctgcatggaagcatggcagggggtgcaatgccttggacccaacatcactgcaatgtaagtgtaagcttagcttcactctcacttatgctgctggtaattactgattattagaatgcttgactcttattgatgctgctgataattaccaatggttactctgaatctgtaatttctgacgaaagtatcaacctgacagagagctcagaggtgcaggcctgggaggaaagctgagtgagacgctggggaagttcactgccatgacagcattgtactgacttgcacaatgcatttttttcatatctgatgtctctagttcttgttcttgctttgatcactgtatgattgttgggacagggatctgagcagcaaccgcattgggggagtgattcctgagagcttaccacctgcagtaaaacaactgtgagatgcaggcagatgtgttggttgagttcttcagagatcagcatctgtggacaattggtgaagcttactgatggttgttcttggattgtgttctgcaggaatttatcttcgaatagtctcagtggcaaactcccagattcgatggcgaagctgaactcgctttcgacactgtgagtattatcctccttaattgtgtgcagtaatgttctttgtttatctctgaatttgcaatgtgtccgcaacttgtaggcatgttcagaacaatcagctcactggcacacttgatgttctaggagatcttcccctgaaagacttgtaatcactacatcaattcacacatgctctgtccaggaaaaaaaatcacacatatttaccttgatgcatttctcacctgatcctctcatgatttactaatatttgcagggatatagagaacaatcttttctcaggaccaatcccagagaaactgatcaacatcccaaaatttctgtaaatctctcagccttcctcaagaacagtagaatttaatctagtggcatcccagtctgacacaacagttggttcttgattgtgtgcaggagaaacggcaaccatcttaccatccccacgatgcccggctcttctccaactccggataccatccccggctctcctccgactccggcggcagcggtggcggcgcctcgatcaggtgcttcacaccctcctatatatgtaattccggccactccacatggcgctgcacagggtgaccctccgagacacggcaagaaggtctcgccggcgaaagccgccggattcagcatcctcgccgccggctcactgaccattgccgtggtcctgatcgtcttcgccgtgtcgaaacggcggcgggagacgtctcttcatggaggatttctgagaggagttgagatgagcactccggattggagtgggaagccttcaggacaaagtgcagttgtcaaggtagacaaagaacaaagcacaggtatatacaccgactgaaaactggagtatttcctatcttgggcccacatgtcagtgacatattaagaggtcaatcttagaacaattattaatgctcaaaaaattcagtacataaaacgctagcttgtgcagtcatctcatctacattttaatcattttgtttgttgtgttgatcactgaagttgctgaagagaaggataccaagggtagcatttcttcatatcagaagaatgttcaggagagtttacaaaaccatcctttgcaattcaagttcacaatcttcacagttgcatccttgcaacagtataccaacagtttcagtgagcagaatctgatgaggcaaaccctgttcggaaaaatctacctagcagagcagcaagacatcaaggtatctaatcaactgtaccctgaaatctccattccattcctacatggattgaacaagtttatttcttgatcagttgtaatcaagatcttgtcatttcatctctgatctctctacaccttatactagtttgcagtactgaagcttgacgaagcgatggcgagaatgccggtggacgagttcttgaggatggttcagagaatctctgaactccagcatcccaacatcgaggagcttgcaggatgctgcgtcgagcacggacagaggctgctcgtctacaagcatttcagcgatgaaactctcgacgacatgatccatctgaagaaactggcatcatcagacgatcctgctgccaagatcactcttccatgggatgcccgggtagctgtcgcactcgaagctgcgaaagctctagagtacgccattgccatgatcatcttcaatttgctgaataattcgagtgtttgtcttgctggcttctgaatctgaagtgagtaatcggtaatcgcttctgccattgctgttcttgcgttaggtacctccacgaaggtggtcagagacaggttgtgcaccagcatttcaggcctgaacatgtgctcgtcgacggcgagatgcgtgtgcgcgtgtccggctgcggccttgctgcggctgtgaaatccggcttggatcttcaggtaatcgtttcgtagacaccgcttgatcgatcagcttgttcttggatgtgcatctgatcgatcggtgtcgatttgagcagtcggaatgctggctcgacgcgctgagctacgagccaccggaggcggcggcggcgccatggacggacaagggcgacgtgtacagcttcggggtggtgatgctgcagcttctgacggggcggaggccttacgacggcgcgcggccgcggggcgagaggcggctggtggcgtgggcgagctcgcggctgcacgacctgacggcgctggagaagatggccgacccgcgcctcgggacgccggcgacggtcaggtccatgtcgcggttcgccgacgtcatcagccggtgcacgcagcaggaagcggagttccggccggccatgtcgcaggtggtgcaggatctgcggcgcgcgctgcagcctgcacgcgatgcttgcggacagcagagctgcagcaactgattagtgacgaaaatttactaatcccgcagttccgaaaaaatatatataacaccatataagacatactctaatgccctatatttatgccactatcttgtgttaaatctattatattttggaacgaaggttgtagtaatatttgtcatcctcctgatttgcgtgggttcgatttaaagttttagacagcgaaataccatcagaaaatagatggaaaagtggaataccaacggaatacaaagggaggaaggggcagttcaaattgatgtcattttcaaccatatctttttttttgcaaagttgccaaatttgataaatacataagaaatcctgctaaaattttggcaatattaccatcttgctaaattttggtaaggtttattttggctacaatctaaacatgcccgaaaagtctctcatgttcaacatacacatttttctcaagtgctaaatgatatgtttttcataaaaatatgtatagagaaaagttgatttaaaaatcatattaatcacctttcccttccggtgatcattaaaaaaaatcatgttaatctattttttaaatttgaactaattaatactcgcgtaaccacgtgctattggattaactcattttacgtgtcttttaaaaaaattctttcacataccctcaaacatatcctaaagtaagtatcgctaggcaatattctcgcaatatcttcaacctcccatatgctaaaatcaccgcttgtcagatatacgctgatgatttgcaaccataatccacttatttctttcatttcaaatctccaaacaaccaaaatgaagagaggctccaggtccatgtagatttgtccacataagttgaaaaataatggtcaaagttttaacatctccatcacataaagttgcgaataaaaaggtgagttgggaggcgtcgtttttatatttttaaggatgcaacataagtaacaaggcatttatttgatgattgaaacagctcaacgatacattattttatttttgttgtttcacaggttttacatgcaagagacaaaatatattgcaaaacagtatagttatgatttcatctagatgaaattcatttcgtttctcacttcatttatctcttatcatatcataaaaatattggcacggcacccaatttaatgagaatgaaacttatattgaaactaactatcagaattatgaataccacatacctaatagtagttgactaaatctcggcaagacccaccacataccatgttttatacggaaacaacctgcggatatgggaggagttccggataaggaaagacaactagagttctacatggaaacgacaaggactacgcggattgtatccatattggtttccctagttctatttggacaaggggatacctatgggtataaatacaaggtcccctaggaggagaggggacaatcaacacacccaccatgaaaaagacccaccatagaagacacggaacaataaatcaagacagaagatcagcatagaagccagcatacgccaagacaagacgcaggatatcgacttcagagataagtacagttagtcccctacggtgtctccggatactgtcaagagagacgaaagcgctgtctctgatctcgtcgggcacgaactcgaggaagaagactaccctgttgtcgactacgagtcagacctttagaccgccatgtcgacaacagttagataggctaccccaaatattgtactggtgtgattatggtgaataagagcaataccggcttcggccaacaggatgtagggttattacctgacaattcaggggcccgaatctgtataaaaatccctgtctccatctattttatctcagtctcgcgtatatcctagtaccgacgatccccataccatgcaaataccggaatcgcgacatcaaacgtcgacactaacattacttagtaattcaattcatttcatttcttaaactagacaaatcttactgcatataattgtgtggttgattgcctatccaatcggtcggtcctggacaaacggaggaacggatagacacgggggcggttgttcccatgcacgaatctcaaagcactccatggttcggctaggacaagtcacaagccagatctcgtccacctccattcttcccttcccattttccgcttttccggtttcctcccacccaccccgcaccgtactcaatttctcgtcaatctcaggaaaaaaaatggtgcctcgccgcgacgagatctgagagcgcgcacgcgcgtcctcctcgccctcgccctcgcctccgccgcgcgcgcgcgcgatggcgtcatgcgcctcaccgtcgtcgcggttgcacggcaatgcggccggcggcggcgccggcggcagcgccaccgcgatgatgctcccggggccccccggccgcggcaacggcgggtgcatcgacctcagccccgcggggctcctcgcgcatggcgcggggagcagcgtcgtcatctccgacccgcgcaccatgcagctcctctgcgtcctccccatgccatcctcctccctcgcctccttcgtcaccgccgtccgctgggtgccacccagctcgcgcttccacgccgcggggatcgacgacgacgacgacgaacgccgcccgctccgcctcgccgccggcgaccgccacggccgcatcgccgtctgggacgcgcgcgcgcgcctcgtccttcactggcttaacctcgacgagacccgcggtgtcgcgccgggatccggcggcggcgtccaggacctctgctggatccaccatgcctccggttggctcctcgcctccatccatgggccctcgctgctctgcatctgggagacctccaacaaccctagtgtcctctggatgttcgacgcctcgcccgagtacctctcctgcctccgccgtgaccccttcgacgctaggcatctctgcgcgatcggcctccggggcttcctcctctccgccatcccgcggccggactctgatatctcgctccaggagcaccgggtgacctgcggcgccagtgacattacagagctgcagaggctggagaaggagatagcggcgcccccgccctccccggccctcgccgcgtttccagcattcacgccgaagctatgcttctccccgctgtggaggaacatcctatatgtcacgttcccgcgggagctcattgtctttgacctcaattacagtactgcgctctctgtcactccattgcccaggggatttggcaaattctctgatgtcatgtctgatcctgatttcgacctgctctactgcacgcacattgatggcaagctgagtatctggaagcgcaaggagtgagtttacagtcatacttttcatgtggatactgtagaattagaatatagaaaacatgtctattgaattgtgtccaaatgcccgaactcgtatgaactaaatttgcaataagactgtggtggtcaagtgcaatcaataggctacatagaaaatgcaggaacaaaacagaattcaaaatggtgcaagtacatagtaataaattctagataaacttggaaattccttacatccttgggagtgtgctgataaacacataattactatgaagccattggagtttcaattatgttgctgtgtaaaacgaatgaataatcagtatacacacctgttagtgaccgttgatctgtttattaatggacacaattttaatgaaatcgtacattatactatatatgttttacaatctgttcaggttattgacatatgggcttcacaattgtgaaccaatatatgcatgatcacattacgtttgtacataaatgatacacttctttccagtatattaagttcctctcgtaattcttttttcttttccggttctaggggtgaacatgtgcatttgttgtgtgcggtggaagatctcatgccttcaattggtacaattgttccacctccagctgttcttgctactacaatctggcagtcagaggctgttttccgtaacatagagaagcaatcacgggacttgggacaaatacaatctacacattctgtcatctctgatacaaatacaaaccaaaatatgtatcaagggaccatgacatatctaacctcgatctctgaagatggcaagatctggtcatggcatttaagttttgacaagtctgcatgtgctagaaaagataaactaggtgcgaaccagtggtcagttcagtgaaatagctatttctggctctcaactgtgtaatttactgatgattccatttctgtcactaatgttgggaagggaccaggtacatcgaatcatagtgatgctggaatttccaattcgcgctccaatggacttgattttaccgtaaaggttgtagtgtaaacttcttccttggtttctgttgttagggtatcaccatgattaagcaggaatagtggttctttggaatctgaattccctatacttctatacaaattccctatacttctatacacagctcgattatcctaaattaatgggattgagatgtactccctccgtttctattttaagtttgatcaagtttctagaaaaatttagcaatatctaaaatatcaaattagtttcattaaatctaacattgaatatattttgataatatgtttgttttgttttgaaaatattactgtattatattgttctataaacttggtcaaacttaaataagtttgactaggaaaaaagtcaaacggcttataatattaaatagagggagtacatgtttagtcatcaatcaatatcccctattcctggcgcttatgtacttcccttatgtggtttgctcatttgtgctatgctctgcagattaatttgatgggccagcttcatcttttgtcctccactgtgactacgctagctgtgccatccccttctttacttgccacagtagcccgtatgcccatgaccataacattgtaccgtgttctgaaattataggttttaaatttgttcaacattcccataacagaaaactttctttttttctatctgaaggtggtggaaacaatcctgctccagcagtaccacttgttgctgtaggaactcagaatgggactattgaaattgttgatgttttagctaatgcaatatctgttagctttgctgtccatagcagcactgtcagaggattaagatggcttggaaattcacggcttgtttcattctcatatagtcaggtactcaggtgcttccatgttacttctgataaatcttgtcttttataaaccaagtacctacatattttgataatgtgaccaattaacattgtggcaatcaaaggtgcttcattactggaatctctgatactattctgtttcttatagtgccctacgttaatattatcattgatttgactacaggccaatgacaaaactggaggatacaataataagcttattattacatgccttagaagtggacttaatcgctcattccgtgtacttcaaaagcctgaacgtgcaccaataagggcattgagggcttcctcatctggaaggtggttctatctctcttacctagaccaatctctgtttgtgcccatacctttttcaagttttaaccttttacatttcaatatgcatggatttggcacatttatcacagctatatttttcatctcaagcatagttttactttcttaggtacctcttgatactgttccgtgatgctcctgttgaagtatgggctatgacaaagaaccccatgatggtactcctttctttgctctataattttgcaaactaagaatcagtagttagctcttgttaggtcaggatcgccataaatcctagtatatgccttcaaaatattgacttttgtattcccaaatattatggaagcaaatgtagacacattctttaaagtaaacaaggttgcaccatgaattattctaatcggagtggaataactttcataatagcttcagtaaataaaacatgacatcaacgttacagtcattcgcttttttctaccactgtttgtagcttaggtctttggcccttccttttacggtgttagaatggactttgccttctgctccccggccaggtcaaaacgctgcatctaaacaatcgtcaacctccaaggagcggtcagcaggtattcactgactagcagaatcttattccatgaaacccatgtgttgcctattttattcgtttaccttatttcttggctttctactctacccagggtgcaatttttaaaaattgtgaaatgactggatctattcttgctttcagaggctactggtgcagaaagtactgatgaaacatctgaaagttttgcttttgcattagtcaatggggctcttggtgtgtttgaagtacatggacgccgaatacgggatttcaggtaatgaaattgctgatgttatagctgtcagcaatgaaaagatcctcagatgcagcttttgtcagatgatataatgtgatacaaagtatatttaattatatttttgccccgctcaattcatgtagccctcaactaaattctactagagcgttatggtatctgcttggctagtgtttgtactgtgttgtcaggcgcaatttgtaaatacaatctgttatcatcgtccctgttttttacgtgaatagtagctatttgatttgtccagtagtaacatgccttttcgctcttacttgcctgatccattgaagcttcctgatttttgtaagggaagccataacacaataaaagataggttttgcaagtatgttttggaaatgatagatagttttgcttcccattcagtttattgtagatgtcaaggtatgctttgtattctcaggatgattagtatttcttgagctaccgtgaaccaggcgggagatacttggtgcctttaggtttatggcataaattaaaaggaaagaaaaagaattggctccgtaccatcagaaagtggcataaactggaacagtgtgtgtctgcggatgaaatgactgataaattggctggtattttcgaagtcgtacggaagtaaaataagaaagtatgattgcccttgttctagtgacatgatatgaaactgaggcaaaacattgtgtagtaaatttcagattgaagactcacttatttaagtataacagacttgaactaaaactgaagtaaatatgtattgcttttgtctccattgctgagcttacttatgtagtttctgttcatatgcatgttgttttattttacttttatgcttaaactctatcaccatattgcatggtaattacatgcatgatccatatggttacactaacaattgtttttcaggccgaaatggccctcatcatcatttgcgtctgcagatgggttggttactgctatggcttatcgccttccccatgttgtatgtacattgtgtcatattttttagttccatcttccagtgttctttatatgtgacgtgtttgtaacaattatttttaggtgatgggtgatagatcaggcaatattagatggtgggatgttacaacaggcctttcttcttcttttagcactcacagggaaggcatcaggaggattaaattttctcctgttgttcatggtgatcgaagtagagggcgcattgctgtgctgttctatgataatacattctcgatatttgacctggtaagtacaaacaaaggtgacactatgttattttctagatctcagattcattgctagcagtcctactagcggtttctattttttagaaaaaaaatctttttttatcaaacatctccttttgttttctcagttttttttctctatatatttgtagcaagctcttgttttctttggagtacagaaaaaaaagattgttttattgtgtactgtgtagattactctagtttgacaacttgaggcataatgagttgcatgcagtccttttcatcctaatctaatccatgcatgttttgtttttcatttcaatatgcacattgtctttcacttctcaacatttctgtacaacttttgtatattgtgtgatggagctagttgaaacagtactgagatcaggaactatgttttaggatagtgcagatcccttggcaaatgctcttcttcagccgcaatcacctggtacgcttgtcttggagcttgattggttgtcaacccgaacaaagaaggatgaaccgcttgtgttatgcatcgctggagctgatagtagtttccggctgattgaggttaacatgtatgtcattttaatttgcattttatttgtttatttcagtacgttagagtcgtcgacttacagttgtttcaagacatgacttgtcatctattaaaattcagtagtaatgtgtatgactaacaaaatgtgtatggaggctttatttgtacccttcatgggctgttaaataccttgctaatttacctgacacttttcttaacatacttgtgagttctgaaagaacctatgagcatgtagttaatttatattgtaataacttagttttgctgataattgagcagttgacatttatcatggttgcagctaaatattgagtcaattaaacctgatgctgaaaaacaacctgtttcatttttttagagcatgttaaagagattgtgaatattaagtgatagatagatcaaaagaagaaaagagacgaacataagaacaacacatcgagcactaaactggatctaaccttagaagctgaactgtaaccagccattcgagaacgaaaaagagttggaatctgttgagaatatgatttgaatggagcaagcagtcctatgatgctttaaaccttataagtttggcatgatgcttgctttgtgggttatgatttgatttctgattcgttctttttccttttaatttatgattgttagaaatcatacatgcaaattgatttatgattgtttttttttttttgtatctaacagcgatcctagggccagttctactttgaggccagtaactacaagagagaggtttaggccaatgccattgtgtctgccaatactatttccaacagcacatgctttggtatggtgcatataatttttgaaaagtgacattttgttttaccatgtatctattctgctacatatatactccctccggtttcgtaattcttgacgttttggacaacgacgatctccaaaacatatcattggctatgatttttattgtatgtgtgtgtgtgtgtgtgtaagtcagtttatgtttattgaagtattttttaagactaaacagtatatcgtgttaaagtgtcttcagactaaatattttaaaagctattgattgtcaaagttctaattgtttgacctcaaccttgtccaaaacgacaagaattatggaaccggagggagtattatatagtatcttttgaaagagttatttcatgaatcacatttgccttcatgtgcttgatatgttgcttgcagatttgtttatattccttccttcagatagaattaaaccaatcaccatttaaaatcatcaaacacaataggagaaagtgattatgatcaatttcttcaaataaatcttttttgtgttgtgcatggcgtttctaaccttcttaaagattgaatgtgaagcactacaccaccactaatacttttgtctctcaggctttgcggatgatcctgcaacttggtgtgaagccatcctggtttgaatgcaatagcggcgataaattagctagtagcagctttaaggaagcaccagcaacttttggagatcttcgtagttacatgattgagacaaccctgcctcccattggtgattctgtagtggcagaattgctgctaaaagtgttggaaccatacagaaaggacggtatgtcatcagttcgtttctttagtagatgataatatgatatatcgtgaatgatggagatattctgctttctgtttgttgagaagggttcattcttgatgatgggagagctaaattgtattcagctattgtgaataagggaacatgtgcaaggtttgcatttgctgctgcaatttttggtgatatccaagaagcacttttctggctgcagctacctcaagctcttcatcattacctggataaatcgacaagtagatcaagcgagaagggctcagaatcaagtgtgcattatcattctgagcaagcctccacattgaacagggcatcatcttcaacggagagatctgcacctgaaaatatggcgaaagttgctgaggtaataattaaatctgatgtctgtaatttccggcctacatatatttatctacttttgaatttggtggtttctccattgtacagaattgtggacaactaagttcaatggcatttaggcaagagcaactatggttcaatgcaaatgaaagaataccttggcatgagaagcttgatggtgaagaggctttgcaaaagcgtgtccatgagtaagaaccaatcatgccaccttttattttatgaaattttaacacatctggcctatttgtttgtgccacatgtttttcacaatctttgtactcaggcttgtctctcttggaaacttggaaactgcggtgtccttgttactgtcaacacctcctgaaggctcaaatttttacccaaatgcattaagagcagttgtattgtcatctgcggtatcacgatctttacatgaacttgcagtcaaggtgaacagccttagacatcgatatgatgttcttcactttggtacacagcatgtttagaaatgacacagtattaagtcatgaaatcttgtaggttgtcgcagccaatatggttagaacggacaaatcactatctggcacgcatcttctctgtgctgtgggaagatatcaggaagcatgttctcaggttttacttaacatctcagctgctacagcataaactcttattctcttttgcttaacttaattttacataagcctggtctataacctacaagctggttatgtttcagcttcaagatgctggttgctgggttgatgctgcaactttggctgcaagtcatttacatggttctgattatgcaaggtaaaacttttctgaggaaagtaaatgaaagaattggttgaacatgcttgtaaaatttatcttcttttcatctcaacgcaaacacagctgcaataaccatgagaaggtggtttcaacttgtttggtttagttgttgtaatatccagttagtgtatgtgcagtagttatgctttatctgaaaaatgttgatgctaatttggtgatatcaggttaatgagcagacattccttttctgcagcccaaagtgaacataaatgtcttgcctgaagcacttaaaagtgacactattttgttctcctttctcttgatgtgctatggtaattctaacttgctgtgcgtaacccatgcagggtactccagaggtggggtgattatattcttcgcagtgaacataatatgtggaggtatgttgatcccttacagctacaggatttaaacaaattcatcactcctgctctaccaacacatcgtttgtccttccacagagctctgatactatatgtagctgctggagcactacctgaggctttagaaacgcttcgcaaaaaccaacgaccagacatcgcggcgctgttcttgcttgcgtgccatgagatctattcccagatcaccacagaatcagagtcatcagatgacacgccagggtctggatcgccgacatcggaacagagccccaagctccggttcccttccaagaatgtggacgacgaggacctgatcgcggtcagcgaggtcttcgggcattaccagcagaaattgattcatgtttgcatggatgctgaaccaaatgtggattgagccctcttggcgccatgccatgccatttgccaattgccatgtgggagggaggccctctcctggatggacaatatccgaagctgaaagagaccgagtgcccccactggtctctactactctttgtagatgtcaacgtctagcttttgcttctccatttttgtctggtgtgaagcttttttttttctttctacaggatgtatgctgcctgcatttttgtctggtgtgtaatctttttctacgggatgtatgtcgcctgcaaatcttgatgctggacagagccgcgttgcgccgtatcctacaaaagacgccgatgattagcattgctgatgtggcatctgtacggagaacctgataatactacttgaaagggataggcattgcggtgttgtattgtactagtaggtgaggacgcttggcactggcaatacttttctgtaagaatatatatatctgtacattttttattgctctttctcgctcaggctgcaaaaacagaaatttggaagttgtagcacatatgtatcgacttaaaacatatttaggtttggttttgaggaatcaaaccatccagaatgagaaaaatccctactttctcatctagaattggtgatccatcggtggacaattcctcaattctttttttgacaggacaattcctcaaatttggtagaatgtctccattgctcatttcttttctactggtacttgtgagttgtgagtgactggggatcatgggatgatggataaacctattcaatttctcaaaccaacacccccccccccccaaaaaaaaaaaagaagattaaccgatcaattgaccaacccaatcctcaaatatcctccatgttactattaggccatgtttagatgggactaaaacttttaagtccctatcacatcggatgtttgaatattaattataaatattaaacgtagactattaataaacccatccataatcttagactaattcgcgagacgaatctattgagcctaactaatccatgattagcctatgtgatgctacagtaaacattctctaattatggattaattaggcttaaaaaaattgtctcgtgaattagctttcatttatgtaattagttttataagtagtctatatttaatactctaaattagtgtctaaagacagggactaaagttaagtccctggatccaaacaccaccttagacgcttgacgcattgagtcgtcgccatcaatcaatcatgccctattaaaatcttgtagccactgctatggagtttgatgaaagcaacctttttctgtcctagatgcctaaaatcatccatgaacctctgtaattaactactccctctgtctcataatatagcaacctacaagacgagacatttcatattacaacgaatctagatagatgcatgactagattcattgtactataaaatatcacatctgatcctagattgttatattatgagacggagggagtactgtagtattactttcacgcaggttcatttcaggtccaactttcttggccacatgacatcttaagataacatatttggcatagttaatcatcctcagacaaccaatcaaggaagcatgataagcaaccactaccataacaagtagcagcaactttctatccaaattacattactggcccgaaacaaaattccattttggctctgccaagtgccagccaaccaaccaaccccacgtttccatccaaattaatcaccaaacttatccaaatcacttaattaactatattagaccgtttgacacgactccgaaccggagctctacctttttccgaagtttgagcctaacgaaacggtttcaaaatacaagcaagatcaatagtgcagcccactattagctctaaatcatctatagtcaatataatagccaattcatataatagttgcttactatactattaatatttggtcccacctgtcatacatacattatatcttggagcccgtgctgcagctgactacagatatgtagcccgctgctcttctctcttcctttatctctttaaaatatgtttatagctggcttatagcctgctctaaggaaatagtactaactataatactatcacaaaataaactgtagaaatgaagttgggtttagacagctctacaaaccctattttagatctaactcataaaattaaatttaatagtttaagccctaccaaacaaattgcagttacacaaaaagaattttagaagcgatcgctacctaaatagcctgcgacctcatgaggccgacaaactgagcacaggtgacaacaatctatgactagtggaaaaaactagcaacacaccataacgttcccaacaaagagattcgaccctaattctcctaatctcttaggaaatatggaagaagcgggaccaaagaatcttccaaaacaaggagctatccctataaatcttattatgaaaattaaggagaagccaaatcttgggtattggcgggagccaaacaactaactaagatgttaccatagacgtctgccttatttgtaaatatttctttgttttctattttacatgtaaataacactcctatattcaatgaacaggcacgctgtgtctttcgtttttcttttttaaaaaaacacatgctaaacgacccataacgacggcattttttgcgagagtgggaggtggtcccacctcgagcgggcaagcaaagcagcaacgagaaaaggaatctggacgccaccccaccacaccaccactaccccccacttgcaatctcccctctctctccctttttaaaataaatccggataacgcatcggtgaaccctgcggattaacagagtaaactgcaacaaaccacgcgacccccaaacctctctctctctcctcgcctccgccgtcgccgtcgccgtcctcgactgctcctccggtgtgatccgatcacgcgcggcctctccgcctcccgctcgcccttctccgcttcgcgtgttgtactgttctcccgcggtcccgcccgagcagaggtaagaggaggaggaggtgggtgagagaccgcgtttgatccctgggccgaggcggcgcgggatcgggtgggggcgtggttggaggtgttgtttttgtttttcgggtggaatcagcttcgtgccgcgcgattgatggttgtttcgtgtgttgtggctgttattttttttttttaggtttgggttggccagcgagggaggttggctagggcagcgggctgatgagagaggcgtcaggcatgtccgggggagaagacgtccgcaaggtttctcgccaggacatacagctcgtgagcaccacaggaaccctgatccctaaccttttctctccccctcaattttttttgagcctaccttggttgtgcatgcgctgtgctgtttgtcccccttcttcacgacgattttcaagttatacgttatcattcagatgcaaggaataaccgaaacgcgtgttgtcgtagctaccatgttatcattcagatgcaaggaataaccgaaacgcatgttgtcatagctaccatgctatcattcagatgcaaggaataacagaaacgcatgttgtcgtagctaccatgctatcattcagatgcaaggaataaccgaaacgcatgttgtcgtagctacaatgctatcattcagatgcaaggaataaccgaaacgcatgttgtcgtatctaccatgttattaatcagatgcaaggaacaaccgaaatgcatgttgtcgttgctaccatgttgtcattcagatccaaggaataaccgaaacgcatgttgtcgtagctaccatgtttcctttatatgtatatttattagtaccttttatgcctttcataattgaatggattgacatggctggcaaatgtctgtgttgctttaatatgccctcatttgggcttttatgtactagggttagttcgttatttcagtatatgcgcgatcccgtgttggactttagttaaagatcatgtgctggagtcactgcaggacaaggttgtcggaaggagagagaaaggagagcaaaagagtttggggatgaagggaaaaggggaaagaaatttaaggaaaaacacgtggcccaatttattatttgaagctgaaaatctcataaagcagaattatgatgtctaacggcataattgaaaatttgaaactctttatgtgcgtttctttccttttcttcaagtcaaatgctgaataggcaaccgctcttgcttcaatatccaatgcttaaaaaagaacttctgaaaaaaaatcattgtagtgttcccttacctttccttttttaatatgcaagatatgctctcttttttttgtcggatgtcctttatcatttcttgtactttctcatttattttgactctgttaacacttttgtgtgaacatattggaaactctgtagttgtacttctctctgcatacttgaagcaataagtcctcatacaaaaattgttttacaggtccagaatcttattgaacgatgtcttcagctttatatgaaccagaaagaagtggttgagaccctatcattccaggcgaaaattgaacctagttttactgagcttggtaatacccttatacagattttctttttcttgttgtgcactgaatgtagcataactataacttggttgacttcccattgcatattgacatagcaatatagcattcatggtgcaccaagcctttgaatttttatgagccaatggttaatatcggacaggaatatgtgtgctttctaatacaatttggagggcattaatttcattccgtcgtaattcataaacaattggttctccgattgctgtttttaatggtaaaacacaaacacgtttgcctctatttctcactgttgtttttctccagtctggcagaaacttgaggaagagaatcgtgagttctttaaagcatattatgtgagacttatgcttaagaatcaaataatggtcttcaacaagctccttgaggatcagtatcggcttatgtgtaaagagcagccttctggagtaccttctatgcctcctactactaatggctccaacatgggcacatgtaagtatatgttgttttttttttcatcagctgtctatacaatgatgttaccttgcttactgttcaacaaatccctctaaactatttcattctaaattgatgctagaggttgtttaccctcttattcgggtaatatagctgttccgtctgtatatattaagacagtagtaaactagtagagtgatgtccgtttctttgtactagtgatacagtatgaagaatttatgggcttgccagtagtatatcttgggattaccatcgagtttagatgatttgcaagttgcaactttggtagtttggctctcctcaagatctaacatttcccgccttccaacgaaaatcataatatcatattaagttgattttaggccactttatgtttactagttactactgtgcttttagagttctctactggcagttttgttagatcagaacagtatttgagaaagtttgttccctagtcctgaatcctgatacatagcttattactaagtttgtaatttttgtgatgtccggaccaaattttattatgttctgacatagttcactgttgactctcagtgaatcaaaatgcatgctttttgccagacactactcccagcactgcaatgccagatagcttgctacccaatggaagttccagcggtattgtaaatggcactccatccagtgaccaatttatctatgctggtaaagtcattcatggtcttcctagcagtatggatgcttcatctagtctactggcagcacataactcaactgctgggaggtttaatggagacaatggaacaacaatcaagacagaagcaagctactcgggcaactctgattttggtttctgcaatgagagcgctttcctagaaccttgccagtcaattggggatgcctctggtggatccttcagcagctctgagctgaatggacagccactaggtgatccaattatggacatggattcatcatcttttggtttcttgagccaaattcctcggaatttcagtttttcagatttaactgaagactttagccaaagtgcaggtattattttctgtgatattaccttttttttttttagttttccttttcttcagcattgctgtttgctgtgtaatgtatacatacaccttttattttgggttgtctgcagaaatattggagaattatggcagatccccttttatcccttctgaaccaaataatttctcagagtctactcctggagaccatgcaggttaattatccccttccctccagttttctgtttcgttcttatccaccaccacagtacaccccacccccacaacatgtaaggcaagctagacaaggaaatattgacttgaacatacggcactgaggcattgatgtaacgctcaatctagctaatgtttctcttgctattgtcagaaataggaaatagacggctagataccatatccgagggtgttagttatgaagattttggaagcgattaatcagatattgatggtactgcttaaggtaatcaaactttaggcaaaatcacaactagacacatttccccttttcttccatttaattttctggtcttgcattggattggattgtgggggtttgtggcggaaaattaactctctaagtattcccgtgttgattggtatgcatatggcacttccatatttaagcggtaatttgtggaatgtcttcacatggctgtatgagaacattctgcagaagtctgccttggtgggattctgtctttcaggcccttgagtttacctgttgtttatcctaagcacaacaaaaaatgggtcgaagttattgcatcatgagacagttgatttgtgacagctaataaacagtgtttatcgaacactgttcttgcaccttagacattttgtccaccgtgagcttcctattcctcatgtgatgctgaagaagattgtagctggatgttagtccaatactccatccttaggcactcaactaggcatcagcatgcatactctactgttacatgggctcggtagttactagttgcattatttttcaacttaagagctagtctgagcatgaaaaactaaacagagaagtacataaatggaacggccagctgaataaagaaaattcatctgatgtattatcctttaggttgccacaatacactaactttagatggcacaaggattatttaatttaaaaacctgatgatggtgccatcagcctgtgaatatggtggtggtgtgtggcaaggggatgaagatggggggtttgcttagagcatgccctctctttttctattcttgaatagcaaaatagggtgttatctatatgctactggtttaactcttctaacttgattcatcgatctctatgtatgtgcaggttgagcagtgatgcataactttgtacatagtagtttgggcaagtgagtctatattcgtggccatggaactcagctaatttcatggaaactattgcttcgtcagttttaggtcttgttctgttggactaccagcttcggtgacttgtgtgagaatatttcatggcctaataatgtgtcgcattgactgatgcaagaaacctattgtccctgtgtcattgctgaagatattgtagaagttagcgttaatggtgactggaagctttacattgacatttcgtgctgttgcacttgatgtgtagtttgtacatgatgcttagttaacattttccctctgttgcacttgctgcggttggccatgtcgcgctctgcactcttcggttgttcagacatgagagtttacaataattcagtattggagaagttggtaaaactgtcagattgttgacgcttggtgaagtttgattctcaagatgtgtttgttacactaccgtctaccattacatgtttccattccctgaacacagaataaacagtgattgcaaatttgacatccaagcacaagatgattaagattctgttagcttctagtccaaagagagtgtgaactgagaacgggagatcgataagattgagtagaaaaaaaattagctttacgaaattcaaagttacgcgtatacaaaacctggacatgggcaaagaacatctccaatttacagtaattcagtaaacaacagatcacaaatctcacagaacaggacgaaacacatgagaaaaatagtctagttcttggggatgttcttgccgacgatcttggcaggagcgatgcggaggaggttcccgggcttccctggaacggcgcccttgatcatgacaactttcaggtcgttgtcgatcttgacgatcttgagcttcctgatcttggtcttggttcctcccatcctcccgggcatcttcttccccttgtacacccgacccggcgtcgtcccggcaccgatcgatcccagagctctgtggctcttggagccgtgggtcatcagccctcgcttgaagttgtgcctcttgatgccacctgtgtcgatgtccaagaaccgtcagtcgcaaattgagagcatagttgcacaattatgccatattgccattagatgatcaggaactaaaagagatattggtgctcttgacttcatgagaatgctataaacgattatgttgtttggggagaaacacccaggggtcttccaactagctccacaaggtggtaggctagacgacctgggttcgaagcctcacccattctaattatttgatattaggtccttctctaatatttgtgtcttttttattatgttgtttgggaagaatatacatgaaatggataatgtttgcggtattggcaaatcgttggtcgcagcaaatcaagagcgcaattgcaacgggtttacgatgttatattcacttcatgaaaattatacaagtgatgctgatggttgcaataaattgtgaactataacgaatgtgttgacatggtacaggtctgcaactccaagaacagcattgacattgccatattggcaatgccattgtgcaagtctaggacgctaatcaagagaagaggctaaatgattcttcccaagaacaattctgtacactaacattggtgagcatatggtaaatttgatacagcaaaatttcaagcttgttctcaagtcttcctcacaatgtaaagcattgttcaaattcagacagggcgaaatggtagtcacattgtgaaaagggagtaaaaaaaaataatcaagtttactgaccttggaaccccttgccgatggacttgccggagatgtcgacgaggtcgccctccttgaacatgtcggcgaagtcgagcggctggccggggtcgtacccgtcgacggactggaggcggaactcctgcaggtggcggagcggcggcgcgccggccttgccgaggtggccgagctccgggcgggtgagcttctcctcgcggacgccgtggtaccccacctgcacggcgtcgtacccgtcggtggccgccgtcttcacctgcgtcaccacgttgccgccctcccggaaccccacgacggtcaccggcaccggcttgccggtggccgggtcgaagtaggtcatcatcccgaccttggtcgccatcaccccgaccccggcctcgtacgacgcgcgcaccaccgccaccagcggccgccgccgcgccgccgccgcagccgcgccacctgcgccgctccaggaggcggcgcggcggcgcggcgcgaggaggcccagcgcgccgccgccgccgccgccgatgcccacggccgccatggccattcttggtgccccggattcgagcggggatttgctcactccagcagtgtcccggcttcgcttgctgctttggttgtttttcgtgttgaattcgattggattggggtttgcggctaatgcccccttatcctcccgcctgcagagaggcgctttttaggaatacgctttctttgccggggaggtggattccgtaacagttgcaaaataccacgggtgcataataaattacaggttaggctagacaggcggagctacctcctgggcaggtcgggcgaccgtacagactccgccgctgatgttgctactattctccattgatagcacatgtaaaaatttagggagtaactatatatatatttatagcgccgtatttttcaccaaaaaaatagtcggcatgtatttacattgcaagtccctaaattacatatataattttagtgtatttacaatgtaaattccaaaattacatatgtaagtactaaaattacatatgcaattctcaaaattacatgtgtaagttgatgtaattcccaaaactataaatttgtgatgacacggatatttagtttttaagactaattagtaatcctaattagcaaataacattaaaacaacagaagagatcagaagagaacagaatcggagggatatgcgtacactgcgatgatttctgcatccgcatctgacggttgaaacaaccgactgaaatccatcgtaatttgtagcgacatatttttagcaataccgaaaatttatggatcactagtaaacgttccttgtctcccaggtttaagtatgctgctagctttgccattgagaccatataactttaccgagttttattttagataacgtgctatccagtgtccttacttaaagtcaagtgtttttacctagatcaattgtaccttagcacggtgcccctgtgcaccaggtgggaagatatcaatgggaactgagtttggtacagatggtttgttttagtatataagtgggtttttgtaggttagccacttgcactctcgatgaccttcattgcactaacacagttcagaatagctcactacaaaatagtgattgaacacttcaaattctatcgaaccaataacgttgttcaagaattgaaagcaacgagagaaatccattgccttctacgcgagtgagattcaaaaacacaaatcttgcgctccatcactagtattttcacaattcacattttgctatatctttattgttttctatgcccttcgctctacctgatcacttatatataacaaaatattgctttacttagcatatgttcttctggagggattgaaaacccccttcgcatgcaaaacgaagcaacatactaacactgtcggagcttggggctcctcaccgggagaccgcgcaggcccccctttgccggttcggccgggggcgctaagtgaggttcttcaccctcgatctgtggaatattcgcgagagagcaaatgcacgagacacgggcgatgtagacaggttcgggccgctgaaaagcgtaataccctactcctgtgttctggtggatctgtgtgtgaaggagttacagagagctggagagcaagagagttcaggctctagaacccccttcctctttctctcctctacaagctcaagtattttcagagtcgtctcccctcctctctcttgcttcggtgggcaaggtcctccttttatatctcaaggggatcccacatgcaccacttctacctactcttcttttgggtggggacccaccctatcctgaccaaaacttggctcgcgtcttcgcctggaagctaaatcacagcttgtccttgagtgaggcccagcgccgtcactcgcctgacacaggggatacccctgtcatttcttcattaatgggtggagatttgcaatggatgctgtccgaatgaccctccgatgggatgggtcatacctacctccactccgccggaagcagatgcaacgtgggagcacggttgtctgccgatgacgtgaccggcgtcagactagtcacagaccggtcactcttgtccaccacgcgtcagtttagcatgccgcacgtctgcccttcttcatacaatgacttcctcgccatggttgcgatgaagcctggaatgaatctggccgggactgacataccaactctaggagttagcacgccggctccggctagggacgagtgcctggaggctctcattattccgacgggacggggcgaggcgtgtgacaggccgcctgttgccacctaacccgcaatctaaccggtctgtgaccggtcacacactgcgaccggtcacggaccggataagcgtgcgatgcgctgcattgaatgcggcgtggtgcgctcgtctaacccgctataaatgcggttaggtgagcgccgctgtgctcacctaacccatacacgtggcgccaacaccacaggaggtcggggcgccccagccctcggggccgaaacgggagcggcccgacccctcgaggagacagagggaggggtggccacgtcatcctcgggcccgacccccccgagggggtcaggccacgtggatgaccgcggctgcccaagcctctagtcacgatacccccggtcccatgtcaccgacaaacacctaattaaatattagcttaaacttaaaaaataaattaatataaattttacaggaacattttttatagaaaaatatttgcaaacacacactatttattagttcggaaaccgtacgcaaaagaaaggagcgagtgaaggttaggaccacagacttattctacgcttttaaaaggcatcttctatctttttatttttgcttgcttctgaagagggggaatttctagaactgttcggctgcactcattcaacgaagctgcaacacagtggttgcaccttgcagccgaacaggccctctaattatatataataagcttgtaaacttctcaaatacagccatacacaactactcaagccgagagagaatccaaaaattgctcaaatttgaaaattttggtcgtcagccatcaggctcgagccagactgcgaccctaagccgacctattagagcatctctaatagtctctccatcctactctctaagataaattttagccattctagccaaaaaaacgtgctccaacagcctctccaaccggatggctaagccatatggctggctaaaacccttcctccactagccaaatttggccactctatttggctggccaatggtgggccctacgtggctaatcaactccatccccacgcggcaacagagagacacgggaggagcacgacgacgagcacgctaccgacggcctccgctcgccaccgcaccaaacccgcacggcactgcccgccgcctccgctcgccgcgtctgccggcctccgcgcgatgaggctcggcgccgccgccgctcgctgttctccgccagtccgcagtagtccagtaggaggaagggaggaagaagtagtagtagaaaatgggttggaagaggaggaagaagagtaggagagactgacatatgggtcccatttgtaatggacttgtaatagagagggtagatgaagaggctgttgaagtaaacaaatagtattactagccaaatcagattgagagttggctatagaaatgtttagagaggctgttagagatgctcttatgccgcaaccgcaccaagccgcaaacgctccggttgagttggactcgtccgagccggatctgataacccacccgcgactcctaccccattcgagcaccacccgccccgccaccgcctccaatctaaaaccctagatctctctctctccccacttctctctcttctccccccgagtcttcctcacccgccgccgccgccgccgccggaggaggaggaggaggaggattccggtgcggccatgtacctctacagcctgacgctgcagcgggcgacgggcgcggtgtgcgccgtcatcggcagcttcagcgggcgcgactcgaagaagtcggcggcgtccgggtcgtcgtcgtcgtcgtcgtccacgcaggagatcgccgtggcccgtggcaccactctcgagctcctccgccccgacccggagaccggccgcctccgcacgctcctctccgtcgacgtcttcggcgccatccgctcgctcgcccagttccgcctcaccggcgccaccaaggactacctcgtcgtcggctccgactccggccgcctcgtcatcctcgagtactcccccgaccgcaaccgcctcgacaaggtccaccaggagaccttcggcaagtccggctgccgccgcatcgtccccggccagctcctcgccgtcgaccccaagggccgcgccctctgcatcgccgccctcgagaagcagaagctcgtctacgtcctcaaccgtgacgccgccgcgcgcctcaccatctcgtctcctctcgaggcgcacaagtccaacacgctcaccttctccctcactgccctcgactgcgggttcgacaaccctgtcttcgccgccattgagcttgagtacgccgagtccgaccgcgaccccaccgggcaggctgccgagcaggcgcagaagcacctcacattctatgagctagacctggggctcaatcatgtctcgcgcaaggcctccgagccgatagataacggtgctaatctactggtgactgtgcctggtggtggtgatgggccaagcgggctcctcgtgtgctgcgacaactttgtgctttaccggaaccaggggcacccggaagtgcgggctgtcattccacgccgcgctgatctcccggctgagcggggtgtcctcatagtcgcagccgccacgcacaggcagaagagcttgttcttcttcttactacagactgagtacggcgatatcttcaaggttgacctcgaacacagtaatgacactgttactgagctcaggatcaagtactttgacaccatacctgtgacatctgctatctgtgtgctgcgctcaggttttctctttgctgcttctgagtttggcaaccatgcactttatcagttccgtgatattgggcgggatgtggatgttgagtcgtcttcagctacactgatggagacagatgaggggttccagcccgtattctttcagccaagagcactcaagaacctgtaccggatcgatgaaattgaaagtctcatgccaatcatggacatgcgtgttgcaaatctatttgatgaggaaacaccacaggtattcacagcctgcggccgtggtcctcggtccaccttgcgcatcctgaggcctgggcttgccattagtgagatggctcgatcgatgttgccggctgagcctattgctgtctggactgtaaagaagaatatcaatgacatgtttgatgcctacattgtcgtgtcctttgccaatgttacacttgtgctctccatcggtgagactattgaggaagtcagcgacagccagtttctggataccactcactccctggcagtttctctccttggcgaggactctctcatgcaggtccacccgaacggcatcaggcacatcagggaagatggccgtgtgaatgagtggaggacacctgggaagaaaactatcactaaggttggatcaaaccggctccaggtggtaatcgccctcagtggtggagagcttatctactttgagatggacatgacaggtcagcttatggaagtcgagaagcaggacatgtctggtgatgttgcatgcctggccattgcgccagttccagaggggagacagaggtcccgattccttgcagttggttcctttgataacaccatccgaatactctccgtggaccctgatgactgcttgcagcctctgagtgtccaaagtgtctcttcagccccagagtccctcatgtttctagaagttcaggcatcagttggcggtgaggacggtgcggaccatccagccaaccttttcctcaatgctggcctgcaaaatggtgtcctgttccgcaccaatgttgacatggtcactggtcagttatctgacacacgatctcggttccttggcctgagacctccaaaactgtttccgtgcatagttagccaccggcaagcaatgctttgcctgtccagccgtccctggcttggctacatacatcaaggtcacttcctattgactccactgtcctgtgatacacttgaatctgctgcatccttctcttctgatcagtgctcagaaggtgttgttgccgttgctggtgatgccctacgaattttcaccattgaacacctgggggagactttcaatgaaacagccatccctctgcgctacaccccaagaaaatttgtgattcttccaaaaaagaaataccttgctgtcattgagagtgataaaggtgcgctcagcgcagaagagcgagaagcggctaagaaggagtgccttgaggctgctggtgttacagaaaatggtaatgcaaataatggggatcagatggagaatggtgatggtcaagaagatggtgctgaggacagaaacacacttccagatgaacagtatggttatccaaaggcggaatcagaaaggtgggtttcttgcatcaggattcttgatccaaagagcagagacacgacttgtctgcttgaattgcaagacaatgaagcagctgttagcatttgcactgtgaactttcatgataaggagcatggtactctcttggctgttggtactgccaagggattgcaattctggccaaagaggaacctttcagctgggttcatccacatatacaagtttgtagatgaagggaggtcacttgaactgcttcacaagacacaggtggaggaagtacctcttgccttgtgccagttccaaggacggttgcttgctggtgttggttcagtcctcaggttatatgatcttgggaagaggaagttgctcaggaagtgtgaaaacaaacttttcccaaggacgatagtgtctatccatacttaccgagataggatctatgttggtgatatgcaagaggtatgctcgctacctttgattggttctgttgctcccctgtttgtcattttgtcacctgtagatgtatatcagtttttttggtagtctgtatgccaaggtgtcttctagaagataaactagcaacttgtcttgtgtgcaacatgatattgatctaaccataggctacagacatgtttttggtgtctacactgggtgagaaggaaattttaaattttattagttactcacatttactggttcagattgaaatatgtggtttgagagcaagtaataggagacaaattacccagcatattttctagatcatgttttcatcatccatctccttttttctttgtttcatcttaaagttttttgtggatatatgaaatttagatatttttgcctgtcctatgaatagtactccaaaataacaataataatgggttttacagttagattgtcccttccaaaataacaacaataatgggttttacctacttctggttgaaacatctctaatttatgaattctctgacagttatgttgcagtttcatatttttaaatatagtatagtatacatataatattcaccatatttcatataccttttttgtttgacaaatttctaacatttctttgtggtgccatctcctgcagtcatttcattattgcaagtacagaagggatgaaaaccaactgtacatcttcgctgatgatagtgttcccaggtggctcacagcagcaaatcacatagattttgatactatggcaggggcagataagtttgggaacatatattttgctcgccttcctcaggatctctcagatgagattgaagaagacccaactggggggaagattaaatgggagcaagggaagttgaatggggccccaaacaaagtagaggagattgttcagtttcatgttggtgatgttgtcacatgtttgcagaaagcctctttaataccgggaggcggcgaatgtcttatttatgggactgtgatgggcagtgttggggcactgcttgcattcacctccagggaagatgttgacttcttttctcacttggagatgcatctccgccaggagcatccaccattatgtggaagagatcacatggcctacagatctgcttattttccagtgaaggtgatatattattttttttgtttagattagctagtatgtcaaccaacacagatattatcacaaatgcatatatttataacttttttaccactttgtcggatagaatatccaggtgtaaaggcagttggcagtatctgttttatgtttgatgatggagtttcgttttggtttgtttcaggatgtgattgatggtgacctctgtgagcagtttccatccctcccagctgatatgcaaaggaagattgccgatgaactcgacagaactcctggtgaaatcctgaagaagctggaggacattaggaacaaaattatctgaaagatcattgcgcatagcgaaagaactagacaaactgttgggctctcaatggctgtaaaaacagaatctcctttcctgtccgagacctagcagcttcagatccgtggcacattcaagaaataagaaaacactagggccaatcgagtggagaggtggtaaagtccttaatggtctgatttgtagaattcttggtgctaatgacctggtgtctggaattcgttgttaatggtctgatttgtatatttcttagttaacaatggctaagttgacctttcagatcgaagcgagaataggtcacataactgcatcagcatcagagtgttcttctgtaactcttagagcatgctttagcctttgtgttagtatttgctgtgatgtagttggacaagttctttgttttgatggttgactcatctgtaggctgctgctactttcatgatgtacgatagaaccttttcattttttcaggtgatactgaagcagatgtattggtgctatccaatttgattttcctgtgataatattacacttttgatgatgaaatattctactgctagtagttcaatggcatataaacaatttcatccatagattttattggctggtaaaccatatataagtgcgtctatgtacgaaaagcttaaccccccctattttcaccaatgggaacgggtgaaaagtttgacctattttcactacaagagaggtaaaacaggggagacgcatctatttggtgaaatataaaatctcagcgacagtaactttctactccctccgtcggagatcgacatggtctccaatgtggcaatggcaacaaatagtagtatctgtagggataaattatttcaaatgaaaagaattgtataccatgataatttgtaaaaagataaatctataacactattcttacatcatcaatctattgatgttcaaagttaaaaagtataactcgacactatttcaaaactagttatatttgtgaaaagagcgagtacatccagatgggtaaaatctcatcgtagtaacttcttttagtacaacacgatgtacatggcacacacttcactctcgtatttcctagaatatcacgtttgcacatccttcctaaaagggagtggattataaatttgttctttttttgaaaaaaaaacacgtttgtatgtcctttttatatgtgtaaataaagggacccataattataggtggttagaaaagggaacaaaatattatacttcctccgttttatattataagactttctagcattgcccatattcatatatatgttaataaatctagacatatatttgtgcctagattcattaacacctatataaatatgggcaatggtaaaaaatcttataacttgaagcggagggagaaggcctttagtgcgtgagaaacatatgttcgtactaaagaaagatactccgtatgaatgcgtttttgatacgtgtgaaagtgcatggatccatgattctactcaagatacgtgtgatacattctataatcgtaacgtcaccaatgcgtggagctggatgtgaataatctctcaagctggataaacattctataactaattacgtttaaatatcattaacataccacaggcaagcggaatctttaaccataatatcactaattagtggtaaacacatgaaaccaaagacatcctacaacatatctaaccaatacgtgcgacaaatgaaatattcaccaaaaatattctcccccctttccatcctgaattcctgatttcacgtaagtttgccactgctttataaggccatttacactacactaatgtggcattcagcccaagccgaccagttcaaagattctatgtcacatatacttctcttgtaaccaaaataggttacccattcctcgtcagagattgtcagggaggggagaggaaatcctcgctcggctaccttctcgagctagttcgttgcctccaacacggagttgggagagacgacgaccatagttgggagggacataccgggaggtcatcgtcaccgcccaatatgcatcgtcgagctccgccgccaccgctcagacccccaccaaccatcgccctcgctgccggcagatccattgagaagagggaggggagcggctcctgccaaatctactccgccggtgggagaagaagagcaaggggggttcgccgccatcccctccccgcaaaattcggtgccaccccgctaatgtcctgatcagttactactattaaactttaaagtctgcccattatttcccaaaatggaattgctgccgaaccccctggccggcaggcatgacgttttaaagtactacactctctccgtagtagcagcatatagcatctcttcttcacttcacagacatgcgaccctgcgggtgttacgctcctcgctcgcacaccacgaccaccgttcacaccacacgtgcgaaaaaaaaaggaacccgaccccgagtccctctccccaaatcctagccgttggatccccatcgcacgcgcgaaactccccccgcggctgatttttcaccgtcttccacagcggcggggcccgcggccgccacgccccccgggcccacacgtcagcgacacgcggcctcgcgttccacacacacccccggatccgcgccgatccgcgattggtcgacgacgtcttcccctcccctcctctccttccttcctccctctctctctctctctctctctctcttcaccgcgtcgctaatccccacctcgtttccacccccaaatcacaccgccgccgctgcagccgccgtcgccgcagcagctgctgtctctcccccgtgctagtgggggggcgcctcaccccgcgggtgtacggacgtgcccggagtgggggggaacgggagggggggtggggaggcttggtggtatcgggtggggcccgctcggtttctagggtttcggccgcgctgacacctcggggcctccaattcggcggcggggctccgcggtggggtggcttgctgctcccgattgccgcccgccggttctgatcgctgtgggtgttgctcttgctgctgctggtggtgctggtgctggtgctggtgttgtgctgtttatgctgaattgggttgggttcgcggtcggattcgtggaggggtagtttgcctctactgttgctgcgctctggggttggggttggagagagaggctgcttcttttggaggtgctgtaaggcgagtggcggtgcgctcgcttgctgtcgctgcgtcatccagccgtgctgcacggcgatgatttttatgctctgaggctcggctggcggcaaatatgaatgtgggacaagcggcgcacctgtccgggcagatgtcggggcaggcgccgcagactaatcaggttggtggcagtggcgtcggtggcgctgacggactgccacagcagatgcaggacgtggtgggacttgggggccttgatacccagtttttgttaatgcgcaacactatgcgcgataggatgtaagcattctattactgcggcttctttgtcgggggactatttattagtcagggtgttaattgtacggagttaatgtcgccactcttactggctgatccactgcatatctacaaaattaatgcaaggatgacgacttgctaaaattgcgctggacctatattacctgtactgccttttacgctgctgtagttatttgcttctcaaactgtaaagtggaggataattataggactactgttatcgcttttgcgtcgcggatacatgggggctctgggtttagtttgatccccatccatattaccacaatttaggccttctgctgatggtttgagtgcaataggaggtgaagatagattttttgatctgatacttgtttgtaaactggcagattcgaatatataggaaggaagcaatcatcgactgattggcggcgacggctgccagaacttgctaaacggctcgaggagatcttgtatagaaaattcttaaacaaggtattgctctctgtccccataatacttttgtgcctttggtttaaattctgtttcggggcaaaagtagatctaactgttatgttattctatctgtttgattctttttgttgttgttggagcaggccgattacctcaatatgatgaggggaccagttgagccacaattgcagtttgctattaagactttgagtgctcagaaccaacaaaatcaacaaaaccaacaaatgccaaggcaaatggcatcttcctctggctatggcacgatgattccaacaccgggcatcacacaaagtgcaactggaaattctagaatgccctatgtaactgacaacactggccttccgtcatctggtgcaaccatggttcctcagggtgccaacactggtacctcacttccaggttcttattgttccactcagcttgtgctcatgcttttaggactgattgccttactttgtagtcttctatatccgtgctgtaggaattctagcatagaatgctaacagcaaccagcgactgccaaatatgtttgaaatttactaccccccttccactagactgtagttatatccatatgacagttggagcatgctctccaagctttctgttgttttgaactgaatatattacaggagtgagaaactaatgctgacctggtgtcaaacaggcgctctgtatactttgacttttttattgattgtccatttccacatgtgcttacttttatttgtccatacaggttcaatgtctaacggttaccagcatctaactaccagtgttccattaaattcaaccacaagcagcatcccatctacgatgggtcctgtgggtattcagcggcaagtgactcatatgatccccactccaggatttaataatcaacagaatgtgcctgtgaatcctgatttttcaaatggagctggatatttcaatggtgagccaactgtgacatcacaaatgcaacagcagaagcaatttcctagcaaccaaaacagtcatcaaatccagcatattggggggcacagtaattctggaatgcattcaaacatgctggagaattcttctgcatatggtttatcagatggacatgtgaatggtggaatgggtgtacatgggtcaaacatgcagctaacaaacagaagtgctgcatcagaagcatacattaacatatccacatatggaaattcacctaagcctgtgcaacaacaattcaaccagcaccctccacagaggataccgagtatgtcttcttttgattcacactgtcttctattcactttgttggaacttggaatgttcttcattagtttgggaagtgggaacaacacataattcataactcttgttttggttctttgttattagagtcaatggccttcatgttgttgtggttagagtccttgtgcccgagaatgaaatgatactgttgcaacattaaaacaattgccactagtttggatgtctgtatttagtatctattctttattagtgtcatattcattctgcaggcatgccaagaaagattttgtaagtttctgcagcctttatacactatatttttaactttttgaccacttaatgcagatagaagctcctaaacaataaggcagttttctatgcaacaaatttgaatatactgatgatttaagatcgtcattagttcagatttttaccatattttttaatcactaatagcgacaatgaggtgcttcacaattcactacagaaggctttaatatttattaggcacatatgcgtagcttacttttcctcgttcattacacccatttgatctgcacctggggaggtactgctttatttgttagtttagcatgcatggtagaagttgattgatattcatgtgtttcttttttttacaaaacagaactcatacgtgttcatcacattgtgacaaaggatgattgtgttgttttttgtgtgcagcaccagttgatatatctggttctgggaatttttacaatactggttcttctgctttaacagcagcgaataatcatagcatgggtgctacaaatttgccatctagatcaagaatgaattccatgttgcacacaaatcagttaaacatgcaatccattcaaccgcaacctcagataaaaactgaggttttggatcagccagaaaagatgaattttcaatcttctcagttgactcacgaacaacttatccgccagcaacattcaatgcagcaacatcaaatgcagcctagttcccagtttgtgcaaaaccagtaccatctgaatcaacagcagcctaactcacagcatcagcagtctatactgagaagcaattcccttaaacagccccaactgagttccagccattctatgcaattgtcagaacaaggagctctgccacacactgagctgatatcttcacaagctactgaacacgctgacattccaatttaccagggtcaataccagcaaagaagtgctcatgataatgtcaaaggagggcaagtgtttggacatctttccagctctcaaaattttcattctaatgcgtcccatgattctcagcaattgttgccaactaatcagcagcttgatgacagttcaaatgatgtaagttatgtcttgaaaggatctcagccagagcagatgcatcaggctcaatggcggcctcagacaatggaaaaagctcctgtcactaatgattcgtctcttgagaagcaaatacaggcagatttgtgtcagagaacaatgtctcaggatggagcacaacagccattttcatctgattggcgccttcctggttgtactgtgactccagctgatcctgcattgccaaagctccctagtggaggacttgaacaggctgctggaaatatctattattttcgtcagatgaagtggttacttttgctatttcatgcaaaatcatgcttaactcctgtcggaagttgtaaattccatcgctgttttcaggtacaggagctagtaaagcattttgagaactgtaaaaggaaagattgttcatacagggattgcaggaggtcaagaatggttactgaacattataaggcttgtgtcgatttgcagtgtcctgtatgcagtaatgcaaagaaacttctgcagcgttcagctgaactagcaagcaagcaaaagccccctgagcctagaaaaattgctcaacagaatacggctcaaagaatcatgaatggggtagagggtgacataatggacatcgacctagtgtcagatgaaatctttgatagtcagccttctgttccaaaacgcttaaagatgcagcctgtatcacccagtactgcagagcgtgaagtttctatgccctccaatgcagggcttatattgcaggaaacacattctgaactgcctgaccagaataacaaggtgggacaactgaaaatggatgtgaagattgacccacgaccactgcagaagcctgcaaagattggttatggtactgatggaaatgtgcccacagcgagacataatgtggcacctggaggctcaaatgagatcaagactcatgtcaagcaagaaatcatgccaattgacaaagagacaagtgagactgcccctgaagttaagaatgaagcaaatgattcaacagacatcacagtttctaaatcagggaaaccaaagataaaaggtgtctcaatgactgaattgttcaccccagaacaaattcaggaacatatcaatagtctaaggctgtgggttggtcaggtatgtgttcattttttttaataaaaaaatttattcataaccatttcagtagctatctaggttttcttgggagtgaaaaaagtgcagattaatttaaagtaaatagataggagtagtagaggacaaacactttttgatatgacatgacgcaaattgtgctatcataccccatttgggcatgcaaacaaggggcaaaaaaactagttcatttgtttttccagtgaatgaaaattcttcacctttgttactacttcaaatataatatgcaaagacaagggaaaaaatatttcatttgtttctccagctaatgagaattgtttccctttctcactactgcatcgaatatattactactagttactgtattagcttatatagtatttagcaggctaaagctttgccgagctctaaagcactgattgaattgaactgtatagaacaaaatgaaattttttcattgtcttcattagagacatgctggcattttgtaaggtactgtttttatgctcttgttatataattgtcatgatgaattactgccttgtcatctgacagagtaaagctaaagctgaaaagaatcagttgatggggcataatgaaaatgagaattcatgccagctctgcaaagtggaaaaacttacttttgaacccccaccaatatattgctccccttgtggtgctcggataaagcgaaatgcaccatactataccgttggtactggtgatactcgccattttttctgtattccatgctacaatgagtcccgtggtgacactattgaggttgaagggcaaaactttttgaaggccagattcgagaaaaaaaggaatgacgaggaaactgaagaatgggtaagttcctttttcatttttggtgattttgtgtctgtatcatcaaaatttgggtatcttccttttgtatattaaatctttttaaatgatgtattctgcagtgggttcagtgtgacaagtgtgaatgctggcagcaccagatatgtgctctatttaatggtagaaggaatgatggagggcaagcagagtacacctgcccaaattgttatgttgaagaggtgaaacgtgggttgcgtatgcctctaccacagagtgcagttcttggggcaaaagatctgcctagaactgtactaagcgatcatattgaagatcggctttttaaacggttgaagcaggagagacaggatagggcagctcaggagaggaaaagcattgaggaggttagttaaattaagtcatatttgtgaagtgaattttgttctctatttgttgctctaaatgtctttagattcgatcacagtgcacttcgctattacgcaactatgcattacatttttttttaaaaaaaaaattgtgctgcacggaagcatttttttataagtgccttcacagcgcatgaataatttgattgttccagccaatgttttatatcctaatttgaaatatatactgtttccaactaaattgtgaatcgtttctctcaatttcaactgattttttctgtagatattgatttcgaacaacatacatcatcaggcacttaccaaataatgcaaaaacagcccaaaacagcaaatgccaatcatgagttttgtcctaacactgaactcctacctgctatatagttaggtactattttggagtattaacctgtacaataatgatatattgtatgagttacctacagattgggaggtggtacttaaatgacatcttgctggcataataaactgaagcataccaaattaaattccattagtagtttggaatgtgttagttatattatcatattttgcaaacttatttaaacttattgttgaagactaactgaacaaccaaaaagtgtaaactacagggacaacataaaaaatatacaagaagcatatttcttttttaaaaacgtttagagtgtgtgtatgagattcacttctgcctgatttgtcagtttgaataaaatgcataataaagagcacaaagaaggtctaaatttaaatatcgaacattgcgaggattaagttttatacttctgtgagtatagtgttttgccatttcttttttatcttaccaaatttgacattgaatactgtgatgctttatgtgctaattctttctgcatagctgtgttaaatcgttaacatcatgagtttatcttgtgtgtgtatttgtgaagtaggcatgacttctctcctgtaattgagaatagaccactgacttttgccgtcatgaaggaaattattctcatcacttttaaattctatttattccttatttgttaggttcctggagccgaaggtcttgtggttagagttgtttcatcagtggacaagaagctggaagtaaaaccacgttttttggaaatttttcaagaagataactacccgacagagttcccatacaagtccaaggtaagaaattagtccagtattctttcaaaagaacaccaatcatttcaagcataaatcatacgtgaaactgttttttatcaaatgtttggcaggctgtccttttgttccagaaaatagaaggtgtagaagtgtgcctatttggaatgtatgttcaagaatttggtgcagaatgctcctacccgaaccagcgtcgtgtttatttgtcatacctggattctgttaaatacttcaggcctgagattagaacggtgtctggagaggcgttacgtacatttgtttatcatgaaattctggtaatgttctatgtttgctgagtttttctaaatttaaatgcgttgttttgccaggctggtcatactatttttgtatgcaactctttgggggggattctgccttcctccttaggctagcgtttttctgcactatctaatgctaggtctctatgtgttcagataggatatcttgaatattgcaagcagcgtggattcacaagctgttacatatgggcgtgcccacctttaaaaggtgaagattacattttgtactgccatcctgagattcagaagactccaaaatccgacaaattgagggagtggtaagacctttgttgacacttctgttactctgctcacttttagctcttctagtttacatgatttctgatgtactttacactcaggtacttatctatgcttcgaaaagctaccaaggaggagattgttgttgagctgacaaatctatatgaccatttcttcattactatgggggagtgcaaggctaaagtgactgcttctcgtttgccttactttgatggagattattggccaggagctgcagaagatatgatcaatcaacttcgtcaagaagaagatgaccggaagcagcagaagaagggcaagacaaagaagattattacaaaaagagctcttaaagctgctggccacaccgatctcagtgggaatgcttccaaggatgctatgctgatgcacaaggtaggattgtacagtggtttgcgtgctccttattttgatagatcacatggctgctagcactctacccctctttccctttctatcatccttgctcagtatttgtttttttcactttactggatggcatctttaccatgaacttgatttgttatgtgcagcttggggaaaccatttatccaatgaaggaagatttcattatggttcatttgcagtattcgtgtagtcactgttgtacccttatggtgtctggaaaacgttgggtttgccatcaatgcagaagcttttacatatgcgacaagtaagttattttctttaacaatattacacacgtgttattgatctatatgaggccacagtctgaagacatctgtgacatgccaaacaaatctataccagtattatttcacatggtcatgtttaatatggtgcccagcgaggagagttgactcatcaactggaaaattattcatcgaagaacagcagttcaagtaccacaatagactacacaaaaatttatccttgcccctcattattgaacccacagaagatcacaggtctttttgttgcatcaagttccttgtagaaaacaacaataccagcctttagtcccaagcaagttgaggggcaataagctcccagcaaaccagaaatactgaaaggcagatgtgctactctgtcctcaacatctgcataaactttgctaaggccatgactccccactttggtatagtagtcatatatcaagctatctcctcttttcatccccttgatcttggcaagcctctgaatgagcattgctgtctcatcaagcatgcacggatttagtcaatggtgaagttgacaccctatgcccaaagggttgctagtgaccctgttagtgccccgcctccaataattgatctccccatgtgccctccctgcaaactggggtgacacgtagaaagcccagacacgctcctaatcctctttaggcaagccaaggtgcccggatgtctgaccctacgagactagatgatttataataaatactttggaaaaagattgttgtctttagacagactttcgagctagatgatttttttgggggttctggtgaagtcattttgtcacattgagcattttgtttcaggtgttacgatgcagaacaacagcttgaagatagggagaggcacccaagtaacagtagagacacacatacgctccatccggtaactgactgaacttatattctcttcttgttgagaaaaggagcaaatagtaactaacgtataacttgatccttccatactttaggttgacattgttgggttgcccaaagataccaaggatagagatgatattctggaaagtgaattttttgacaccaggcaggccttccttagtctctgtcaaggaaatcattatcagtacgatacccttcgccgtgctaagcactcatcgatgatggtgttgtaccatctacataatccaaccgcaccagcgtttgtcactacatgcaacgtctgctgtcatgatattgaaactggtcagggttggcggtgtgaagtctgtccagattttgatgtatgcaattcttgttaccaaaaaggagcagtcaatcatgctcacaagttaacaaaccatccatcagctgctgatcgtgatgcccaaaataaggaagctcggcaaatgcgtgtccagcaggcaagttcttttaaatgttacccttagtgatcttcttcggacattgtcaaagatttttttttcctctttagttgaataaaaatatgcacttcgtgctaaaaaacatgacaactgtcgaacttaaattccatttataaatttatggtaaaccatatgataccattagcatggtaaatagcccacatagagaggataatatcaccttatggttatatcattattttaatttgcatccttttgtggaaaaactcaattctgtcattgtgttccattttctagaaacccttcaggatatagtatcacctaatgtgatgtttctttcatgacgctgcagctaaggaagatgcttgatcttctggtacatgcctcgacatgccgctctggcagttgtcaatacccaaactgccggaaagtcaagggactgtttcgtcatgggatgcagtgcaaaacacgtgcttcaggagggtgtgttctttgcaagaaaatgtggtacatgctccagctccatgcccgagcttgcagggactcaggatgcaacgtgccgagatgcaggtgtgttggtgcttctcacttttgttccgtcaccttgccttgtgcttgatctggaataacaccctgaccacttacggaaactatacactatgcagggatctcaaggagcatcttcgaaggttgcaacagcaatctgattctaggaggagggctgctgtaaatgaaatgatgagacagagagcagcagaagttgctgcaaacgagtagtggcatctgtacagctatatactgtggaaagaagatagggagcgcgcagtgtcgctgccctcgctcattcccactcccaagtagaagcttgggatatggttgaattagaggatctagctaagaagttgtctcagatggattcgtcccatgaaactgtcctggagatgcaagacgtcgcgcattcttccgccagttgttaacctatggcttggaagcctgcctctgcctcctcttcttcaaaggaaagaaatgaaatggatgaaaggggtgtaccacaataggtggtaactactgtgttctgtgctaactagttgcaccctgctgacggtgcccggtgaaatcgtcgtcgtcgataggacccccagcccttgggtgtggtgattcttttatttgacctcctgtactagtggaactaatcttgttttgctgcttgcctcctcttcatgtataataggtttctggaactcttattgttgatgaaaaattggtctagctgttccccctccagcaccttgttgttgttgttgcctccatcaggagtgagaggggtatagggaagaaaaaaggaagaagaagagggttgggcattggatatgaattgtttatttctgccccccattttgtaggaaccaatctttgttttaaagtataaaagcatagcatatcctgcattctgttgtatcattaacattacatctcctgcatttcttcttgtttcccctctgttgcatttcagctggctatttctgtgcaatattttctctctggaaatttatgttttatagtactatccgtcctagaaaataatgattttttttgacacggatattaagaaactccatctacttttgaaggcaatatttctaaatctgaaaattttacttttgatgggcatatttcaatccaaccagatatcttcttaatgactttctcggatttaatatgtaactatccattctttcacacaagattggcattattccacacaagattggctacatgctcatggagaaatgtaaatattaaggcaaatgaatcgtttatttacgatgaataactagtaacatgtttaaatgaatgataagtagaattacttatccttggtcattgtgctaagatgaaatataactatcaaaagtagatggagtgaacatgaaggttgtgattgtacgagggaaaaattaaatggtcgacaattatgattggttagaaaaataacgttcgtggacaaataaagaccaatgttgttatactccattacggaacggattgagcaagtttttttttggaatttcacctatataagtgtgtcctgcttctgttgtgccactgccagtaacatgtgcacccctacattaattgctgtgtttcctcccctactattatactctggtcactgtaaactgtgcgcattgagatttaaccaaaatttcgaaattcgcttgaatatcctatcagttcgaattttgataccaaaggcctcatgtttgaattacgatgagctcaaagcctcgaatccataacttcaagcccgaaccctgaaatcctggccgtccatttgttaatcgggcggttggcaaacaccctgcttgctgttctatccgcgccttgcccgccgtcgcgtgtggctctcgcctcgacgaccatggcgatgttcgcgcggcgcctcctcgtcttccacctccgcccgcccgcgcatcccctcgcagccgccattgccgctccccaccgccgccgcaagcacgacgccgtcgcgtgcagagccgctgcggggaaggggacgagcaaggccagggcgagggacaaggacggcagtaagcggcagcagaggcgggcgctggaggagcacctcaagcggcgcacgcgctccggcgccgccttcgacgccggcctctaccggcggcactcccacgcggagcacgtccccgtcatgctcggcgaggtcctcgccgcgttccgccgccctctcccgctccgctccttcgtcgactgcaccctcggcgcggccggccactcgctcgccgtcagtagtagttccccctcctgttctcccttacaattccagttacctttacattgctcgccgacgatagctgctcgacgaaatgctgcttcttcttcttggctctttagtgttatccgttgtgtgatcgttgatgcgcaccagctgtttgatagaatgcctattcggcttgtgcaatagatgatggaggcacacccggagatggaactgtacattgggatggatgtcgatccctctgcgctggagattggccggagccgtatcgaggccttccttgccaatagggaaactaatggagatgacgaagatgcctcgcagggaacactgcgtgcatacactcacgccaagaatttcaagtacatcaagcatgttcttggcagcgtggatgagaacattgctgttggaacgtctggagttgatggaatcctcattgaccttggcatgtcatccatgcaggtcaggtgttccgtaaaacgcagtgaaattgatggtaagcctcctttatttcccatttagtcatctgaatgccctgttgtactatccacaggtgaacagatcagacaggggatttagcgttcttcaggatgggccacttgacatgcgcatggatcctaaggtcagtgttgctttgctctagtttactgcccattccttccttccacttgcatacgaaaatgcattgccacaaaattttcttctagttgaagggctatgaacattgattgacaaaactacagtcttacatcttcatcttgttaaagtctagttttgctggagcttggaaaacatgatcccaaaacatttttatgcataatgcattcatattgcaatgcaaacttgtataaaatctttccagaaatttctaaaacattgaatcacactccagtccattttatttggatctgtcttgactgtagttacacttgtgttgacaattggtatttcactttttgcaaacaatgttaacccagtaaattaatacattatattacttgaagtgcaacacatccttaccaatggcctgttcttttccatatgaataaactaccgttagatttgccatgtccaaaaatttcaaaagaacgtagatttagtgccactttatcatttgcagtaatccataatcaactagcaaagtgacaaagccccaaaatagcacataatcttaatcttggttgccttgaaatctttgtactacacctaacctatatatgagattagacaggcaactttgaaagcagaagatatcttgaattcttggcctgatcttgaagttgggcgtatcctgcgtgattatggtgaggaaagtaattggcagtcccttcagaagcggattgttaaagcccgggctatggggggtttgcactcgacaggggagcttgtcaaacttatccaaagaacgtgtaccagttcagggggtatgtatgatgatggtatctctaaatgtggttatatgatttgtgtatgtatgacctgatgttttatgacaaacttataaactgcaggaaggcaaggttggattaagactgcaacaagggtgtttcaggccctaagaatcgcagttaatgatgaactccgaactctagaagatgcacttcatgcatgctttgattgcctagcaacagatggtcgccttgcagtaatctcattccacagtttggaggatagaatagtgaagcagacctttctggaacttattcatgaagatgaaatagatgatgatgaagacgacttggtgagtgctgacattgatagtgaagatgaaccctggtttaagcagagagtgcaaggaaagaatggaaccattctaacgaaaagaccaatatctccttcacaagaggaggaagaactgaatcagaggtgcagaagtgccaagctcagagttattcagaaggcgtgaacctggattaatcatatgatgactaaattctgagctctgaggagcagtgaggacatccatgcgtgaactcatataacatgtgaatgatcgcgcttgcagttgcaacaataataactggaaaaactagctcgagaggatgaaatggccatcctgtttctgcagttaacttagagagtagagcttaggtaagtccaaaaattaatctcactatttgcaccaccattttgtaccccattcatgtacactaaactctctaacaatagtttttactgcatctcttcttgttttttttttttggttatgcaggaagcctctgattaaattgcatattttaccagctaattaaacatatgatggttgtttgacttgggatttcttgctcatatcaattgtacttgtttacactcaagcagggtagggaaccaccacaaaataagtcaagttcagataaaaccaaaacatgcatattcagaatccaacgttggtgctcatcttgttcttggcagagatatggctacaaccttttcgtggctcacattgtcacccaatagttgatagtacaattaaagatcacctaaatttaagtcatttacttctcatatttcatattataagttgctttgacttttttctaatcaaattttaagtttaactaaattcataaaaagaatatagcaacatttcctacataaaataaacatattatcaaaatgtattaaaagttaattgtaatgaaaataagtttgtattgtaagtaatgctattttttaaaaaatttggtcgaactcaaaaagtttaacttagaatatattataatccgctttaacttttatctaagttaaaactctataagtttaactaaatttataaaaaaaatatcaattcttataacactaaattagttcattaaatctaatattgaatatattctaataatacatttatttggtgttgagaatattgaaggatttttctttaaatttaattaaatttaaagaagtttgattaaaaaaaaaaaaaggttaaaatgtcacgcggacgtacgcaggcaagccagcgacgagtccgtagccaccagcgagagcggtgaatccggcggagccacgtcgccggcgccgccgatcgccaagcccacaagccgccacgtcaccctctcctcctccgcgccacattttctttaaattatttttctccaactcttaaatcgtaccatgagtcactgcagcgtgggccccacctgctcttctgacaaccacatccacaagcaccagcagccgcgagattttcttttcttccatatataagcagtgaagcagcgcacacgagcagccaagaatctctctctcgcgcgcggatcgcctcgaattcgcgagctcgcggaaatggcggccatgtcgtcgcgctgtgcggcttcctcgtcctcatccgcgttcctcagagctccgcttcccggcggcaggcaccaccagggctcttgcggcttcgtcgccgccggcggcggtgctaagacgacggtgagggttgcggcggcgctcgacacggaggccacggcgaaggctggcaagtcgtcctcccgggcgcggcgggcgaggaaggacggcggcgagcccggtggctcctcctccaccgcgctgcttgctcctacccatcccgacggcggcggcggcggcggcgtggcgctcgacgacgtgatcgtgaacccggtggggctggggcggcggtcccggcagatcttcgacgaggtgtggcgcaagttctcgcggctcgggcagatgtcgacggtggcgtcgccggagcaggaggagcaggagggcgtcctcttccgcggcggcggcccgatgtgcgacttcgccgtccccggcgcgcaggacaccaccgtcctcgtcgtcggcgccaccagccgcatcggccgcatcgtcgtccgcaagctcatgctccgtggctacaacgtcaaggtcacttacttttacctcttctttcttgtcaagctttctcatgtcaaatcaacaaattttgatcaagggtgtgtttagatctttgggggtaaagcttttaaagtatactgacacatatttgaagtattaaacgtagactaataacaaaacattacagagtccatctgtagactgcaagataatcttattaaggctaattaatccgtcattagcaaatgtttacggtaacatcacattgtcaaattatggcgtaattaggctcaaaagattcgtcttgcaatttatctatgttattttttttttgaaacaggctctggtcagaaggaatgatcaagaagtgatcgacatgcttccaagatctgtggacattgtggttggtgatgttggcgatgcttcttcagttcaagctgccgtgtcaggctgcaacaaggtaatctactgcgcaactgcacggtcaacgattaccggtgatctcaacagagttgataaccaaggcgtgaggaatgtcaccaaggccttccaggtagttcttgtgaaaaatctttgaagaaacatgcaaatcaatcttatttagatttctgatatgtttactgaactgtgatttactttgcaattcaggattactacaatcagttggctcagtcaagggctggtaaaagcagcaagagcaaactgtcgattgccaagttcaaatctgccaaatctcttcaaggatgggaagtgaatcagggatcatactttcaggatatttatccttctagattcgatgaaggcaccgatgcatcgtttgaaatatctgaaaatggacaggctgttttctcaggtatcacctgatatgaaagctattacatcatgatctctgaattgtacactatagtgagattgccttttttaaaaaagtattcagatatattgcttcagttgatgatttttcatttgtttttaattctcttatcaaaattttctgtgattagggtttgttttcacaagaggtggatatgttgaagtgtcgaaacggctttcgctcccactaggttccaccctagacaggtgtgataagattcttcagtttattttttcttaataagtttgcctgatgttgcaaaatcatgacatgatctgttctttgttatgctgccatgttctacctgaagatacgacggcttacttctatccgtgggtggaaatggaagatcatatgttatcatccttgagactggtccactagctgacacctcacagagcaagaaatattttgctcggatgaacactaaagtagggttttgcagggtaagtggcaagtgatgatcccacttcactaaattacctgtttctgcattgctaatcggagtgatcagttaactaaatgctgaaaatattcttgttctgttcaggtgagagtgccgttctcagatttcaggccagtgaacccacaggaccctcctcttgacccttttcttgtgcacacattaaccataaggtttgaacccaaaaaacaggtcagtgcaaaatgatttgttgaatcaattggagataggcaatgcttctggaagttgttagtttaccaataaaatccttgtgcagagacctggtgactcgtctcaaggagctagtgacccaagaaatttccagcttataatggaatttataaaagctctacctgtaagtaattcacctgattctatcaattgatctgccatttaaatttccaatgttgcagatatttaccggaaatttcatttgttttttgcagactggtcaagaaacagacattgttttggtttcatgcacaggctctggaatcgaacctaacagaagagaacaagtcctcaaagcaaagaaggtatcacttctcataaccacacatcaaatgcaaactgttcttgatgcactcttgatacaaacattaaccagtttattatctctctaggctggagaggatgcactgaggagatccggcctcggatatacaattgtatgcccaggtcctctgcaggtacaacatctgaatgaattggattgtctttttttttcttttcctaaatgtatattttcagcaccagttgtttctcatgtagtgcattgcatattgatattgctgctgaatttcagtacaagctgtagctacataaaccttagtgtcaaaccgatgaaactaaatattcatcaagcaagcagccaagatttaagcatgcaagttgatcactaatcatagaattgagtgtgaaatttgagtataaattatgcttatttccaagccccaaatatactttcttcagtccatactacagtatagtataacatagtatcccttcttcattccaggaagaacctggcggtcagcgtgctctgatctttgatcaagggaacagaatctctcaggtgacatagcattcactgcgtgcaattatgcctgatataattgcatgttcaatgttagtatacatgctaaccattaggcttttcaactgaaatataaatgcagggtatcagctgtgccgacgtagcagatatctgtgtcaaggcattgcacgattcaacagcaagaaacaaaagctttgatgtaaggaaaaaaaaaaccttgtattgtgaactggccatttgtgcaacaggtagtgaaatgactaaccaggacaccaacctgatttgtgtaggtgtgctatgaacatgtctcaaagcaaggggatgagttgtatgaacttgtaagccccaaaactgaaacttcagtagattcatctttgtacagcaattcgcaaaatttcttctctgatctgtctgtgttttgcacttttgctaatgatctgtcgaattgttttcaggtggctcatttgcctgacaaggcgaacaattacctggcaccagctctctctgttcttgagaagaacacctgattgatcaaatgatcagtgacccatcaaattttatgtcattctgggtcagattattgtccatgtgtatatgattcatcttgtaaaggttttccttttctcatagaaaccgtgtggagtccacttgtgccatgatgaccgtctccagcacaaaagtgaaggagttgttgacaaaaaaaatccatggtcctactactttcccatctctgtaaaacttgtagaattttcataacaattgggcatgaattagggtgtgtttagttcacactaaaattgaaagtttggttgaaattagaacaatgtgacggaaaagttggaagtttgtgtatgtaggaaagttttaatgtgatgaaaaagttggaagtttgaagaaaaaatttgtaactaaactcggccttaggcccatcctatatagcaattttgagaactttgaagaagtaatgagcatgaggaaagtgcatttgtctaagaagtgaatatctcccaatttgtgtacatttgtatcgtttcttcaattttgtcacgctcaagaagctatgagtatgaattttagaatttaattctatgattaattaagggatgttcttcgtcacttttgttgcctagttctgtgataataatgctatcaaaacaagtaaaactcaacctaaaatttttttgaagtcaaactttattaggcataccaacttaagtttctttttcttgtttccatagcaaagccaaagggagtctaaatttacacctccatcgttgaaacattggcagtggctttgctaggcatgccaactcacgtatcaccctctggtaccacctttgtcatgccaactcatatttctttctctaactcgtgtttaggctcattttgatctgtatgagaaaaacctcgaaaatttagaggattttaatcctattgaaaaagtttctaagggtgtgttctatagtacaatttttcaacttctacttcctcaaatattgcgcgtacgcttcccgaagtgctaaatagtgcatgttttgtaaaaaaaatctatacaaaagttgattgaatgtatttttagctaatatttaattaaccatacgttaccatttatgtgacagaagtgttttcaatccttcttaccgaacctcagataagaagccctttgaaaaaaaagatagaaaaagattgaaccatatcaagtctatctctctcatcttttttttttgttttttcctatggtatattcaaacgacttatattttgcatttacatttgtatgaaaatactatgcttttatattcctttttttttcttaatccttcaattcaaaggatcccttaaatttaacatattatttaaaaaacagaatggagatatgttatactataaggacccacatgaaaagccatccaagtatttcattatacaccactcttcattagtactccatccatccattctaaaatataaatatttgaacttctttagaaaagattaaagttgagagaaaacgattttatttttagccacatctttgatcaaattctgaattttgaactagttagattctttctccaaccttctgattggtcgaaaaaatactgagattttggaactgctctcagccggccaggcaagtgttaccaaaagataaaacacggaaaggaaagaaaaaacccagagatgcgccctgccaggtcagctttccgccgcagtctgcccctctgccaccgggccccaccccccacccctgccacaggttactgcctctctctgaccccattgaccaactccgttgaccagtcaaacctctctctccctttcacattttcacccgcctctcgccgctgccgtcctcgctatgaaatgaaatgaaaccaccaccaccaacgacttcctcctccacccgcttcgtcttcgtcttcttcctcctccacctccacttgatcccagcatccgcatccgcagctgcagcagcagcggcgaggtggaggtagctagatccgtgggaggtggtggttgtggtggtgagggggagatgaggggggaggcgaacggggaggaggagcagcagccgccgcggcggaatcatctgcgggacgacgcggaggaggaggaggaggtggagcggagggcggcgaggccggtttccggtcagcagcagcagcagcagcggcggcgaccgacggatgtggggggaggggcggcgatgaggagcgtggggtacgtcgggaagcaccgcctctccgccgccatcgcccgcctcgaccaggagctccagtcgctgcaggtcagcgccacccccctccctcctcttcctctcatctcccatgaacttgattctccgtgtgcttattgcttatcaagcactagtatgtgtgcctttactgtctctgtgctgtggcctgtggatgtgtagcgagtcagcagttcaagctgtggcgcgatctagatcttgagaaaatccagaaaccgaagttttttttttccgttctatcaatgccttcttggcttcttctgttgcgtatgcatgtactgatgtatgtgtacaatcagtacatgcaaagggaaacaaaagagttcttcctttatccacagcttttgttcttacattgaaaaattatgaaagcgttgaaccaaatcacccagactactagacttatagtgctttaaaattaggagtttgtcctaatttgttttttttacattttgtccatgaaacatgtccaccattgcccatattaagccacataatctgcctacttttgtttaagcgggttgcgagtttgagagctttcagggggtattgacaagaacacaagtaacaggattctggtggtctcaatgcatatatagatgtctcctactggacagcttgagctgtgctgaaaatatgattctgcacaactttctgaagtgcagcaagtgttacgcataatgttccaccccctcagtgatttagatcctaaagcagcaccagtggacaagttgaggtacttgcatcccttgtcttcacttgctcttctggcctgtgaccctcagaaacacacatatgttgcttgcctctatatggtagctttctagagcttgttagtgaaacatttgatgggaactgttgactgaggcttataatttgaatggttgaatttgatgaatctactccattacaagtatttgttattttccactatgttctctgattttcagcttctctctcctaggaggaccttgtttttctcctaggggggtaggggatccacagtagtcttctattctcttgggtttaattctctgtattttttctaagttagtggaaaacaagctatgcgcagagagaactacatacattggcaagaagaaaattcagtttcccttaatattctgcatcatagacaggttggatagattattgtgcaatgcaagattcttcaagaatctctccaggctgcattcgtattaaaggttggtgtgcttagcgtaatcctaatagtataaccacctctataaaatcctattcggtccttctggtgctaggccctggaattggtaattaaagtcctggatttagtaatcggaatgaatatgtgctattactcaccagattacgtgtaattatttgtgagcacaatcagttcaactattcttctcatttctgttcgcaaaaacatcttgtttcatcatatcagttgaaactatacagtgagaaattcacttacattttctactggtattttgtttttacttagccacgtttattagaaatattaggctaaaaatcctaactaactcatcgagaggacttttcttatgatttcatttggtttattgtcgccatgctttagttttttttttttatttattgtgatgtatagtatatgtgcatttgacacaggatgaactgaacgagcttgaaaccatggaaccggcatctgctgcatgccaagggtaagtaaattctgagtgtagcatttgttttcccttgtacctaacgtttctctgttttgtgattcttttgtcctcttgatcatgccagagtgatcacaagtacagagggaaaatccgacccgcttcttcctgtgtaagtcgcgatgtttagctactcattctagtacctcaccctgcaagatctgaagatcgtactgcataaggacttgtgtaaccatgatctttctcatctttacagcaccattggtccagagaacgcttcttgggagagatggtttcagcgcgtgcgtagctctcgcagtaacaaatggtgggcatccaaaggctcagatttttcctagccccctcctgcaaagatgagactaccagctttgtgcagattaaaatcacctgaactgtatcatccacggatggcttggcagccaacaagaacacaacgtcgcttgccgccttgcgggctgtctagttcttctcaggacacgcaatagtttttggagagaattgctattgttgttaatgtatgtaatccctaacacgaacatggacgaatgtaccgacattatcttccagagctcttgattagctctgcttgattgattctaatgctttcctgcaatgccatgcaaaacattcagattgcgatgcacaatatgtccatggaaaggatctgggaagaaaaaaaaataacaccaggttctgacctttgacgctcagaattttacatgtgctgtgctgttaatcttcagtcactggccagctgtttatgcaggttatcaacttatcatgcaggtttagtctcgactctgaaatagagttgccgtggttgtgaacaaaatggacggcaaatcagctactccgtcctgaaatataaacatttttaaaatagtgttaagtcaaatatttttaataacaaaaatatagaaaagattaatcatcattaaacacagtatcataatatacaactctttttatttaaagctttttacttttaaacatattattagtcaaagtttcatttcgaaaactatgctaaattcaaaaataattatattttgggacggagatagaactcgctactcagcaccgccacccagcccagccatctcctctgctctctctgccatggcttccaccgtcgccttctccgtgtcgccaattgtccgccgcctgcactgcaggaggccggggaggggaggactcggaggagcacttctatgcccgtcccgagaaccaaggccgtggcccgaacgccgcggcggcgtccgtgcagaccaaggccggaaaagatcaccgacgagcgcggagtggccgcccggctgccgttcccgacgccgcgggcaccggagatcgatcaggcctggcatgctcccccatagaagcattggattcgcaaagggggagaaatctcttgctgtcttcgtaatggacaggtgagttaaccctattccggtcgatcgatatgagaagtttactggcaaccataggtgattgatatgtaacacaacctcctaaacaatccgcattaatcacattgtgttcatctatgcaacagtttagtacacaatccatggtttaacaacaattcaaagtggccaccgatgagttgattgcacatggtaaaaattgctgatagactttgggcttttatccctctaaaaaaagaattgagatgaaaaaaaaaaaagaagagctactacacctttcacgatgatggctgataacacacacgagcattttgtcttattttatttggatgcgaactctgaaataccagcggctgacttagattccattagtactgatacccaattacccattttgttacgcaatgcactggatagaaatagaataatggctgatatcatttgagatgtcagcggctgggttctattctccttttgacttgtatctgattggtactgatttctgttttgtcagcggctcaagattggagacattacttatttaccttctgtaccattagtgtcaattcccttttgttatgcaatgtaatggacatctatcttacacgaaattgaccatcatattataaagataaatcacaatgaaagtgaatacacaatgcaatagatttgatgcttctgaaagcatttctgttagtcttaacctcttatttttccatggtatgaactaatcagctgcctagagtgacccacagcactgctctgcctgcaacattgcatatagtaattcgagagcacatagtaaaccaaccataatgatttcccactttgacttttggtttattcatacgtatctcttgcatctctaggactttataaagcatcatttgttgttttatgcattgttactctacacagcaaggacctcagagaaacatacaagcaaggtgaaggttcccaagatgatgtcctcaattgctgtagcagcagctagcgctgggctacgaggactagcacagcccatcatcggcaatctcagcagttttgcatctcgctacgttggagtggacatggcacgtgagatggtagacctggagaccatcatccttccccagctcaacctgatcattgcatctgccgagagccaacctcagcatgtgaataacatagtgcagaaatgtctgcaaagactcaaggtagagctgtctcaagctgaagacctgcttgatgaacatgagtacgatcttctcaaacacaggatgaaacagaagaaattatctgtgttttctgtacatggtcagtgccagggtcctatttcaaatccttttatttgggttctcagtaatatatctagcttatcccctcacaacactaagatgttgaatcatttgaaagaggtcaagagcattttagaaaaagcaaaaaatttccttggtgttctttcagttgcaacacaagtgagtgctgacactgcaggaagcagggttattcaagacacaacaacctttcgtgaggaaaaggtttttggacgtgacaaagatcgagattctataatcaacctcttatttgatcctgccatggttggaggaggaaattccaatataaaaggctacagtagcatcgcaattgttggagctggaggcgcaggtaaaactactcttttgcaatatatctgctctgatgatagagtacagaacaatttccatgttatttgggtatgtatgtcacacaagcttgatattcgcaagcatacgacagaggttattgagtctctggccactgaggaaactcctaagatacaaaatctcgatactcttcaaagaaaactcaagaatttgctcctggaaaaaagggaaaaggaattattacttgtactggatgatgtttggtttgaacaaaggcaccatagtgagtgggaacaatttctggcaccactcatctcggctgaatttaacaagggcatcaggattcttgtttctagtcgttccaaagaacttccttcagttctaaactgcaggaaaacagtttctttagaggacatagaggagaatgatttcctaacatttttcaggtactattcccttggtcatgtcctgatagggaacgaagaactagaagaggaactacaaggaatcggagatgatattgccaagaagctccgacggtcccctcttgaagcaaaagctgtagcatctcggttgagcagaatgttagatgttgaaatctggaagcatgcacgggatagcaaacaactggatgggaacataatggaaaatctactgtggagctaccagcgtcttgacccacaggtgcaaaggtgcttcttgtactgcagtatattcccaaaaggatacatgtttcacattgatgagattatcttactctgggaagcagaaggcttcgtgagttctaatggccgttcggagagagcagagggaattaccagacagtacttttacgagctgtcgttatctggttttttcggcaagcaatcacatgggaaagacagtcatgttgggtatagaatgcatgacctctttcatgatttagcagaaaatctttctatagatgatggctacaggatagagactgaagaaaatactgaaataccacaatttgtccggcatatatctatctctgtccccagtcttgagaggcatgctgcaagcatttgcaagcttgaacagcttcacacgctgatctttttcaaccctgtagcagatattggcaaatttctcaagccaatgctgaagaagctgaagaaactccgtgtgctgtccctctgctttttcagcagttacacactaccaaagcacataggcaagttgaagcatctcagatacttgaatctggaaaggacgtccatttccaagttgccaaaatcttcgtgcaaactataccacttgctagtactcaaaatgaacaaaaaggtgcccaaaacattgccaaagaaagcaaacaatctcatcagtttgaggcgcatcaacggccctttgaaagacgtatgtaatgtcgggatgcttacttctcttgaagatatgaaagaattccaagtgaagaaagagaagggatatgaaataggtcagctaggcagcctgaccaaacttcgaggacatctccatatcatgaatcttgagaatgtgcaaaataggaatgcggcaaaggatgcaaagctccaagaaaaagccaatcttgatgcattgcggttggtgtggaaccatgacacatacaagaacaacaatgttgacttggaggtactcgagggacttgagccttcttcaagactgaatgaacttgcaatagaaggttacagatccacttcatacccaaagtggttaagcggttgctctcaaagtttgaggtctcttgagctcttgaactgtacctttctagagaacctcccatccaatcttcaatgcttcgcccgctgccgtagtctagctcttctgaatctcacagggctcaagaggctgtcacctctcccagaaaatctcacaagtttaaaattcggtggatgctcgtcactctgcttcatttcaaaggaggaagaagaacatggagtaaacccggccagggagaaagctttgcagcctctgacgagctctaccgagctggaaacacttactgaaatcctaagactggatgggtcagaactggagcagtttcaggcatgcttccaggagctccagtatccagtaagcacaatttctgccagacgccgtgatgttgcgcaactggtcctgccattaacgctccggaggctcgagctatcaagctgcaacatcacagatcaggccttgtctgaatgcctgcgaagcctcacctctctgaaagacctggcactgttgcatatcaccaccttatctgcactcccgtcaaagcaggttatggagaatttgtccatgctttcatcggtgggcataacttcatgccggtctctctgctccgtggctggcttgggagccattgcttcacttgagaagttcgcaataagcttctgtccctcactagagctctcggaccgccgcatccttccctcccagctgaaggaggtcacggttcgtggctgcacgatccatgatggttttctgcatgatgatctaccatttctggtcaaccttgagatatccaaatgcagaaccccctcggttctacaagtcggtgcatggccttctctcaaatgcctgaagctgtgtgattgcctggatgtttgcttcctagtagggttacctgctctggagtcactccaagaagtgcagttggtgctcccaaaccttggagctgattcttttaccggatgcaaagggaactggagatcactccgagttaggacatcatctctgctccatgatttgtctgaactagagggctttgcgcccccgatgctgctgacaattgagggttgccaagagccagacttctcgttggagggcattcaaaatctctcatcaatcatcggcctgagtttcatgaactgcaaagtccaatccatttcagcaatgaaagacctcgcgtctttggagactcttgccttctttgactgcccattgctgatttcattgcctgaactgcctccatcagttcaatatctggacataattggctgccaaatcctggagaagagttgccgatcccgtcgtggggaagaccggcgaaagatttctcagatccctcacgtggtaatgtatgagtaatggtgatgcttggaacgctgcgagcattctgcaaggttgcaattggtgttcacttgtttatcctagatatcctgcaaggttacttggagaaatgaacttttcaccaattacactcgcagatagatttagtgattttttgaaagattaactgtaagatttcgtccttcagtagatagatacccctctatgaatattgtcaaaatcagtgagtgaattggggatttaactgttgatccattgagttggcccttagggctaatatgagatgaatacaacgtgaaaagacagaaataccccttaacatatacacactaagggcctggagctggagctcagccaaacagtttcagctccaccgaaatagggagtggagttgggtgaagctctctcacaaaatgtaccacaactccactctagacctaactgctgaagctaaatttaggagttagagctgtaccgaacaggcccttaaatcttggtagctcaactcctaatatggtgaaaaattgcctctcaactctgaaaactgcttaaaacttcatttaaaatctgatgaaaggggagacataacgattaacgtgggacgaaatccctatatgacaagtgaatactttcgtcaggttttcagttcttcctgtccttctcttcgattcctcgtggtctggtctgccatggctaccaccgtcgcattctccccggccgtcgccaatgctctaggagagggaggaggagcgattctctgcctgccttgagaaccagagccacggtcgttagggccggcgaggtcggggaggaccatcgaggagtgcgaggcggacgtggtcgccggaaatgttaggaaatgataggcaacaaacgataaaaaacaatagatcaatcacaaaagacacgagatttaacgtggaaaaccctcccaaaacaggagagaaaaaaccacgggcgccaaccaggaaaatatcttcactatatctggggtgaggttacaacgccgcacggcggcttacaagaggtatatatatggtagaaccctaaaagggatgacgatctgtttcgcgggggcctccgctccactacggcagaagttaccctttattaagtgcaaatgaatttgtatcagacctctgaatttgtaagttatcacatgaacccaacaagttacagagagcaatgtttcatctgctaggtgaagcctggatgtcctccggctgcaaaatctgatgatattttcctagtgtattactcatgttcagtacaattttctctagcataactgtccttgaaacctgtgtatatgtaaaagtataatttcccccaaagctgccgaatgagcttgtcccataatgacatcaaggctatgaaactttcccattccagccaggattgacaatgtgtgtagcagtccttgaaacttgaattaatgaaatgcacatatgatgcctgatcatttgtcacatatgtgcagctgccaagttctatgtgtgtcttatctcgtttcttgaatggtcgtattcgcaacgacattaaccatggtattgtcttgtaggtctccggcgagtactcgatgatcaaagccggcggcgcgctgaagatggtggacgacgagagggtgatgatggagtcgctgctgtgcctgcctccggcgagccggcgccgacatcatcctcacctacttcgccggccgccaggccgccaacctcctctccggcatgcgccccgtctcatccaactgatgcccaactgtactgtacgtgtgctcctctcttttcccctctgcatcgcgtattcgcggtacgtcgtcatcaatgtgttgcgatgcctggacattggggatgaataggatacgagatttgataggatcctatactcgtggggttcacatggtcattgacaggtggggcccacgctcctgctcccgccagtacgtggccctggcttccagtggccgcgctctactggatagagactggagtacctctgactcccaagcaggattcaccaaatcgttttgggtagagttaccgtcatcccgcggtttagcggttatcgtgaaaaccatgtgattattatggggtatactatgattttaaaaattgagaaggttaccgcacgtgtgataaccataataacagcactgttttataaatcctatgtcagcatgacgtatcggtgacgtcatcatctatgaattaccactaccctggttaattactccgttaattaattttgtcaaggtaacagcggcgtggcggcgcgaccaagctattcccagtggccgcatctgcgccatccagcccactaccaatgctactgtcctccaatcaaaccggctcattgttgctaagaaactagtaagtcagctgcaaacatattttaaaaagataaataaggagagagaagtgcagcgggctacttgtagccagctgtagcacgaactccaagacacagtgtgtgtatgataggtgggattagatattaatagtgtagtatgtaactattgtataaatgagctactagattagctattgataaactgaagctagtagttggcaatactattgaacttgctcgtagcagtgtcacgttatctgcagacagccggatgcacacgtcgtgttgttcgatgtgcaatcatcgagaagattgcactactgggggcacagggtagcgtagttggcactttgtgaaatgaacatggttcaccggtcccaacagccgatccattcgattcgagcaccctccaacactagctttgccgtacgccatcaggaaggaaggaggatgacacaaactgcaatgcctagcagagggttcccagatctcgagctggtgcgaacaacacaccttccaatcttccatatctcgtagtcctatatatgcactccccccttttcgtttggatgataagtgaaaaagacaatgctacctccgtcccaaaataagtgcagccatatgaatccatgtctaatatttgaccatccgtcttatttgaaaaaaatttatgagaaaattaaaataagttagtcacacatagagtactattcatgttttatcatctaataacaataaaaatattaatcgtaaaaaaaattcaaataaaacgaacgatcaaacgtgagacatgaacagtgtaaaactgcacttattttgggacggaggtagtacaacatactcgtttactttgaataaaaattttatatacttattcttaacgatgaaatagtaaaggctaaaaaaataaactttgacaaaaaaaaatcaaaataaactttaaaattaaagttgaaaatttaaattttctttaataagcataaacgaaaagatgaggcctcgcacacaaacaagaggatctttagtatatcctccatcttgttgcacgtacaatatgtgtttctaactctttgatagacgggttttttctccgaaacaggatagatttatgctaagaagatattacagtagatctttgttgttaaaagaaagagagagaaaaacatatgaacacttcaaacaaacgggttctacattttgaaatgtcgcaagagctgcaagaagacaaaccataacgctcgtagactctggtacatacaaaagtataagagcgagtatggaataataccgttttcactcttcaatcacctgatagatctataaaacggatggcactgatcaagttagcgtcttttgaaacaggtgctaccgattggattatcgacaacataacatgcatgcattggtattttatctgaaatattgatcatggtacaaaaagaatagtttaccactccacaaaatgggaaccgactatttcccatgctgggtcacttggacagttccatatgccaatgtcatcgagtgacagcataatcaaagtgacaacctttgggccaacgaatcatcaacttttttcctcaaaaatatcatcaaccctgtccttcccctagcataaatcggtctggctgattgtattgtgtattatatattaacgtgcaatcttttttgccgaaaaaaatcatcaaccttggtctaatgctttttagagaaaaaccacctgggctaatgttggctttggcaggagtcatagctacgcgatccaaaggttgggccagagactgaacgtaattatgtaacgtgatcgaacccaaccacacaaatacaggcggtcgctagcagcagcacatgacccccaggtcagaaacgcggagcaacgtgaccgcacgtgggccccggaccgaccgaccgaccgacggacgatccacggccaccggcgtcagccggccacgtgcggccgggatcatcctggccgtccatggcacctacttggcccacatgaacagccacgatgccgctgtggcgcttcgaccacggcgtctaccggaccaccgaccacagtggcacagtgttacgcacccctctctctcactgacccttgggcccaaccatgtaagagctagttcaataatataaccaactgctagcttaaaaaaggttaaaacataagtaatctataaccaacatactaacaatctactcatataataattagttatatatatatatatagcatataggagtataatatatcgtatcattaatacatacctcttccgctaaaaaagtttcaattctaagaatgaatttggacaatccatctttagaattttttttattggataaggagggagtaattcaatcatctctcacatactgtagtagcttgttttctctcttctccatataagggcatatttagttcccaaaaagttttttcctaaaacatcatatcgaatctttggacacatacatgtagcattaaatatagattttttaaaaaactaattgcacagttagagagaaaatcgcgagacgaatattttgagtctaattagtccatgattagccataagtgctacagtaacccgcatgtactaatgaccgattaattaagctcaagagattcgtctcgcactttctaggtgagttatgaaattaatttttttattcgtgtccgaaaacttcttctgatatccggtcaaatgtccgataagacaaccaaaaattttctcagagcctcagaggtctttagctcttaatccaggtgattatccttggaaagatggcacgagcccacgagagccatggacacatgcatatgatccatcgctgatggcgacagcgagaacaggaggcacacacgaagtacaagacgatgcccacttcactccctcctcggtttccagtcacgggcgccgatctcatcaaccacctgcatctcatctcattgattctgattctctcatctctctcactctctctcatcgcgtagctgaagacaaacgccatttcgatcctgatttgacaatcaccttgccctttgagatccttgtgaaggcagcaaaaaatttgagatcgcctctctcatgcaaacattctcatgtcattttgcatgaaccttaacgagaaactaatccatgctaaacatgagctgtcgtagatgtcatgtcatgtaattaagctcaaaattacaccgaaattaattaattaataaatccgatgatttgattcagatttgagaacgaggaaggaatcaaagaaagaaggaagaaagaatacatagcggagctcttttaatccaatttttcatccaatactcgcgaggaagaagaaatgaaaagaaaaaaaagaagaaagaaagcaaaaaaaaaaataaaaatcaagaagcaaaattactacagggagatcgaggtattatactggcgggcgccgctcgatccgccggcggcgactagttgtacggcttcaccggcggcggcggcgacgcgtacgacacgccgtacaccggcgggaacgggagcttcccgccgggcggcgttgacgtcgacggcgggtgtccaccaccgtggccgccgccggtgctgctaccgtgagacggcggcgagcagttgtgcggcgtcggcggcgggtggaagcttggccccgatggcgatggcggggtggatggatgcgagtgcgatggtggcgtggtggtcggggtccccgctcccggcacgtgctgcgtcggcggcgacgcgccgggctggcccgacggcggctggtagccggaggaaggcgacggcggcgagccggaggacggaggggtcgaggggatggggccgtacgagccaggcggcggcgcgaaccgcacgtctggtctgtcggccgaggtcggcggaggaggcgtgtatgtcaccggcggcgaagggtaggacggatgagtaggcgtgctctgcggcggcgagtgggacggcggagcggtggagctcgacggcggtgacgggtgtgatggggtggtgtggccctgcggcggcgagtggtaggacggggtcgtggagctcgacggcggcgaggggtaggacggagtggtggatcccggcggcgaggggtgcgacggtgtactgggcttgccaccattgggcgacgggtaggacggtgtggtcgagctcgagccccccggcggcgagtgggacgacggtgtggtggcgctggatggcggcgacgggtaggacggggtgttcgaccccggtggcgccgggtaggacgacgacggcgaggggtatgacggggtaggagagctcgatggcggctgcgggtacggacctctgcgccgtggcggcgagctcaccggcgccggtggcccttggccaccacgtccagggctaccaccgggcgtcggggtgtaggacgcggcctggcattgcgccttgctgcagtcgaacgggtgcgccgcagcggcggcgcactgcgacggcggccgctgccccggcgcgccggggatgcagttccacacgccgtcggcggtggccacgccgcagcccgggcgcgaggtgatgaagttgtccgtgtaggtgaagttcttgaggctggcgaggccgcagacgccggccggcacggccccctcgaagaggttcctggcgacgtcgagctgctcgacggcggccatcccggcaacgctcgccgggatcgggccctgcaggtggttgtcgctgacgtcgaacaccgtcaccttcctgagcagccccacctgcgtggggacgcagccggtgagctcgtcggcgatgagcacgatctcgttgagcgtgtccgccatcttgccgatggacggcgggatgcatcccccgaggttgttgtgcgcgagcacgacgacgctcgccggcgagttgccgaggttggccgggatggggttgcggaggcggttggagttgaggaagatggcgtcgagcgggcggtcgaacagcgcgggcgggatggagccctcgaagtcgttgaacctgaggtcgaggtagcggagcgaggggagcgcgagcaccacctccgggaacgcgccgacgaagcggttgttgctgaggtcgagctcgtggagcaagcggaggcggcggaacgtgtcgggcacgacgccgcagaagcggttggagttgaggtggatgagggcgaggtcggggagccccagcgggagcgacgccggcaggtacccggcgatgtcggcgtggttgaggtcaatgccggcgacgacgagacctccacctccgccgccgccgtagccgggcgacggcgcgcagtagacgccgttgtaggcgcagacgttggcgccgacccagctggcggtgaagttggaggggtcggagaagatggccgtctgcttccacgcctggagcgcggcgtacgcggcgcggaggcgcgggttggggaacgcccacgacggcggcgcgtcgtaccgcgacgcgaacgacgccgcgtactcctccgacacgttgccctcgtgctgtgccaccgccgccccgagcagcagcagcagcagcgcccacgccgcggcggcgtggccgcgagagatcatcgtggaacgacgcggcggcgacaggagcttcgctagtgggaggcgagtgtgcagtgtgtggcagtgtgtgggggagcgtgggggtgtgatgtgtgaggagagggagtgggcattcagagcgggtcacatgggtggagaggggtcacatggggggtggcggtgcggcggtggaggacgaggcacggacgaagaggagcgcgaagggagcgttttaacgtgggggagtttgatgattttttcccattttttgaatttttaaatttaaaaaacaaatattttcaagacttattttctactcccttcgtaaaaaaaaatcaatcctaaattaattattttgggactgatggagtagatcagaacatttttccgctccagctcaacagcagctcaacaacactgttacaccggtctaaatggcgtgaccagtgctatttgatcacgttgattcatggatacaccaattataatgttgttaggataatactatcacactaattatagattgtgtgacaattttattttagcacgctagacagtattggtgccatggtgtggctgaaagtttacagattttgaaaataagtttttgaattgtttattttttgaataagaaataaaaattcgagtttggtggtttggcggtgtgattggggacgtggacggatggatgggttgcaatgtggaggtacgtgttggttgctgcgttggagtagtgctgggctgctggctggtttggcgagctggatggagttgtttacgcatccccatgtatggccgtggcgtgatatggtactacgcgtcggtgtttgtgttcgaattagtaattcaaaaggttcgcgcctgtggcggcgcagagcagacagccaccatggatttcagtattctcccgccatctactttttaatagttatattttatcttaaaaaacagaccaacgatgagtcattctacttattatctatttaaatacactactagcatttctcgtaaacaagcgattcattaatatttacatttttcgatacccatgtagccaatcttgtgtggaagaatggagagtcacgcattaaatttaagaaagccattaagatgataatttgttggattaaaatatgtctatcaaaaataaattttttagatttggaaatatgactatcaaaaatagatggagggagtatttcactagccgtatccagagtttgcaaaaccgctcggtttcagtcttaaaaatcaaacgatttttaaatttttttgacaacaatttaaccacatttcgccaggagataaaggttttcaaaaaacttctaaggatgtgtttagttcacgccaaaatttaaagtttggttgaaattggaacgatgtggcggaaaagttagaagtttgtgtgtgtaggaaagttttgatgtgatggaaaagttagaagtttggaactaaactcggcctaaaccttttttttttactcgggaacggtttgatgaaatcctggctgtattgctgttttagaaaactctttttggtgaaaatgtaaatttaagcatataatccgtctatgcttctgtgtggaaccaagcgagcgatgaatatgaaatctcacagatattgagctgattttaacaaggttcatatagaatcaatgctttcctgatggacgtagcccttgtttagttctaaattttttcttcaaactttcaatttttctatcacatcaaaactttcctacacacataaattttcaacttttctgtcacatcgttttaatttcaaacaaacttttaattttaacgtgaactaaacatacctgtagtgcaattcatgcataacaaaaggacgacctcagattccagcgacaagaactgtcctgagcccaaaattgatggtgttcacctacggagtacgttgcaagaaatggaaacttgaaagtgatgtggtggagacaaggcttaacacatgcccagctcaatttactctccagttcaattagccagtcttgactaaactaattactactattactactaactgggaatcagatcatggaccatgcctgcattaactggaccacttggttacttacaaggattaattaccaccagctagagtcgtcgcccatgaagtcgttgcagttaattatgcaaggtaagagggtaattaagaggcgcatgattaggtaaggatcagatccagagaacctaacgtgccggccaggttagagtaatagttgcactagtaatacatctccattccgtactgtttcctctcaaacgatttcaaaggcatccagcttcaaaactttttgaaagcaatgagaatgcaagaggaaacagcttgttgatgcagacaaaggtgtcagtaatttaacctaaacttcttggaagctggtgcattattgtatttgtccttttgggttccaactccagtctccagtgctcttaaacttttgatttcttttttcaacatctgataataatcccttcatcatccagagatcaatccagtgtttccacaggaagctctgacaccctctcccttgttcaattgctaattagagggtcccacagctccttgattgcattggctccagttgtactactacactgaagctctgcaatagtacagtaaaattaaatggaaaaacttagtggtattttcaattttacaggagagagaattagagaagacagtggcatattcatgagtaattagtcaggcagtagactaccaaaatcttctgcagtaatagcaatggagtctcttgcactcaatgatactacaatttgcaaagctgatcaatgaaataaagctagctagcttagactgtaaacgtgtacgaggtagtactacaaaagctatatataatgctactaccagtataattatactggactgccaagtagttgctgtttttttttctctttccaagagtgtttatataattagtaccccacttcagtacttcagtaggagatctatatacatgttcatgtactgtgctgtacttttcatccgagttggcgacaccttacagaatacagagagatatgcaaggacgtaatagcagccttcaatatgcagttatgccaatttgcaacatggagtagtagtaatgatcatggcaaagtataaagccgtatgtatgctagtatggctgtaacatggagagatgaatgtagttcacatgatcttgtctccaaattcaactgaaaaaaaaataaacgtacgaatcgtttggtttggtttggtcctttttattcggagttattaagatccatgtgatgaccatgtatgcatactctagttagcagttacttcctccgttgcatctatatgaatgtgaacaatgctagaatgacttacattacgaaatagagggaatactagtttagtattaaattaaactttgattcaccgtacaaatgaagctgggagatatcaatgaaatagacggtatcaaacagtagagtagaggtggtgaacagtacgacgactggtactcctgtagagtaccatatgtcatttttttcatgtatcatttttttcatgtatatatctgcatttccggcgcatttaataggcatgaaaaatgcaattagcagggcgagatgagattaatttggtttacacgtcacctcatgcacttcgttgttgatggaggcatggccatgtgcattaatcgtcgttggatcaaagatatgagaagcgttttgatcaatctgcattgatgctttacgtttgtatggtactccctccatctctttttatccttttttatatgatactatattggttagtttaaaatcaacatcaaacaattttttttaaaaaaatcaatggtattatattgtaactatgggatcgatctgaggtattgtggtggattggggatcagtattctaatccatcgaggagatgtcttcttattcagtttttttctccttaattacattttttctggaaaatataatgtgtatagttatgaaatttataaaaatgtgtgacaacattaattctagtgatgtaccctactacctttgtttcagtttataaaactttctagcattacctatatttatataaatgttaatgaatctatgcacacttatatatctagatttattaacgtatatatgaatatggacaatgttaaaaagtcttataatatgaaacggatgaagtatattccaataaaaaaccaggtcaaagatcgatatatccaatgagaaacaaatagaaacagtttagacttgagactttatcagatggtttatatctattgtagtatgagttcgattgggctgaatggattggctttttcacggcatgcaaaaagagaaaagcttagcgcattataattgaccattaataattatgaacttaaataatgaatttgtttaatttctaaaaaaagtctattaaaaattctatgaaaaacacaccgtttaacaatttagcgagcatgcttatagaaaacgagatagccactagccaacttaagaagctgcctcgaactcagctaaattgttttacattatttttataactatttacattatcatttaaggtaattagagacatccacttagggattcttggaaatggaggaaatttggagagattctgtataattaaactgaactgaaaaacgtgcattcggaaggaactcttgaagttaaaacaaaacagtttcccatgaattgaacgggaccatggaatgatcgatctgagcacgagcagcagatacgcgagctcagctagcagctagctgtagcgccaaacgctgcccttccctgcaacttgcgatgatctctggcccttttctgctttctaccacggcgacgcgtaaagagaggagaagacagaagacgcgttttgatccacctatagctatcaatcatcacgcattgcttgcagctgagctgtgatcgagtttgcctttttctctcctttctctgttcgctgcatatgctgttgctgatcgagtactgtacatgcatgcagcgtctgatgcgattgcgagaaagttcaggacatttttcggcttgtctcccattctgccattttcatcctcctcactatcgatccactccaaagtccaaaccgtcactgggagagtccatttctcacaagccaaattgggacaaagtccaaatcgtactactccctctgtcaaaaatatatataatatttatattaatatttaccattattctttatactctctccgtttatattataaaccgtgttaactttttcctaattcaaattcatttaaatttatagaaaatatagcaacatcaatgacactaaattagtttcattatatttattattaaatatatttttatagtacatatattttgtgttgaaaattttattacgttttctataattttagtcagacttagaactttgacgttaattacgatacaaaatggagatagtatcaaaataagtacagttttatctccttacctttattccgcaaaataatttcctgttaatataggatatttcagtctttctttgaatattaagccgttagtagagtaaaaatttaaacagggaaaagaactgcacagctggttggtatgcttatatcaccatattcgagtgcaggtattctccaggtacaatgcaggtcgatttcgattcgattcgatttcagcgtacactggtggaaaaatgttttttactaccaatttagaacgtgactaaatatcgctatctttagttccgggatcaatctttagtctcggttggtaacaccaactgggaataaagagggggaatctttagtcccggtcggtgggaagcgacagttcctcgagatcttttttttattttattgttgaattgctaatggctagtgttaatccctgtattttctcccgaatcaattttctcccgaatcaaatgggatgcacctccccaaatcaacatcccaaatattaagttacttatacgcacagatcaaatacatcacaaatcctatacacaaatcaaatacatcacaaatcctaaaaaactacacacaaattaaatacatcacagattatacaaattatacataccagatccatgcgatgcaatgaatcacaaaatctaaaaaattatacatccagtgaaacacaaattaaaaaaaaaaagaaaagcaaacaagccggcaccctaccgcagtcgtggccgccgcccgcctgcccgcgcgcggccgcgccgccgccacccgccgcccgcctgcctgccgccgctgcctccccccgcgcggccgcgcagccgcctcccaccgccggccggctgatgggagggaggagaggggaggaggagaagaggaaggggaggggaggaggaagaggattggatgtgagaagaggaagagaggggatgtttcaatcttatctaaatatctgtctgggacttaaccgatcagatgtgggagagaaatatttactcccggttgataactccaaccgggactaaagatcaatctttagtcccggttgataccgggagtaaaaatcaatcgatctttactcccggttggtatcaccaatcgggactaaagtggtaatctttagtcccggttggtagtataaaccgggactaaagattctcgaccccctgacatacatctgataggggatgaaccgggactaaagatcctggatctttagtccagatcaaaaaatttttaaccaggactaaaaatcgtttttagtctcggtttttaatggaaccgggactattgtgggatttggttgaccgaccaaagatggtttctccaccagtggtagtaggcaagtaaaaccaggtggttggttattcacagaagatggacacatgcatgggcagaacgaaagagagatgagccggggagacgacaggcgagaggtggtgaacatgcgtctcccatatgcgaatgttctccaactacacgtacagttggcacttggcagactcacacacgctagctagcagcatcataacaacctcattgtaaatttagctattatgtctatttcaaaatataattaattttaactataatatagataaattatgataaatattgtttagatttatagctaaaagtattatattttagaacgaatgtgtcaggctagcaactgctactgctattggtacgtcagctcgcttgccttggctagctagctgcgctgggctgggttggcttcctctagctaaggctgtgtttagttcatactgaagtttgaaggtttggttgaaattgaaacgatatgattgaaaagtcgtgtgtgtataaaaagtttaatatgatggaaagttgaaagtttgaaaaaaaactttgaaactaaacaaggcttaggttcaattcgttccttgccaagcatgctatactttgctttgatgcccgaaataatggcaccgccctccttcctgatccaatgatagatactccattcttcctaaaatataaaaagatttaggtacatgtgatacattatagtatcatgaatttatgatatatcacatccacttaaaactctttatattttaggacggagagactaataaacatgtcccatgttagttcgacacaaaaaaaaaattatgggtattttggatcgctgtaccaccatttagagcccatcggttgccctaaaacaataagctaaagttaaaatataaatttaaaaacttaaatttaaatttaatttcaaaatattttaactatagattattttcagtattactttttaagtcacgaagaacacatatacaagagttttgcatattatttttttatcactaataagccactacggcttataattagcttttgatcaacaaatgaaactcttagatatgcctgaatttttaataagatagttttaataaagcattgaaccaaatcagctcctagcatacctgtattgtggtatcaccctgtattttaaggacggtttaatttttctagctttttggtgatgggaagagacgaacatggggagtatccgtatcagtttgtgatagcttcacgaatcacgattaatgatggagtactggtcataatctaacagcgcgagacgtttgttcttcactgaaaatattgagtatggatggagttgttgggcacatcccgcacatgtataaagtttggtgcaggaatctcacatgcatgtagccataatttcatctaatttctcataaattagaaccgtctagcactctagcattgttgttttcttcagctttcttcagaaaccgaaacaattgtgctcgcaatcgtcagtgcacacctgtgttcagtactgtcagtgcacgcctgtaccatttcctgtgatctgaatgctgctagctgtgtgttgcttgaatcagacaggagtattcagctcaggatgcttggctgccaagaagaaatgagacactttcgccgtgtttagttccaaaatgtttcttcaaacttctaacttttttatcacattaaaatttttctacacacataaacttctaactttttcgttacatcattctaattttaactaaacttccaattttaacgtaaactaaacacagcctttggagtagtttgtgtcaatggttgttggacgacatgcatctgcatgtgacattgtgtgcacattgccgtacgtactgcagatcgatggagggatgggatacaggtgtgcactgacagtactgaactgcaaagtttcggtgtgaggcaaggacatgttcgatcagcttcctttccaaccaagcgagtgaacacagaacagaatggcatataatgtttggttggtaactaaatttgtcacatctaaccttagtcaagtcacagttttagtaggtagtatttgactcttgccataagtctattttgtctaactcttagccacctagcccacatgtcatacactctattttcttgccaaacgttgcctaagcttagtttgtcattttgtttgccacaaaagtatggctagactaagcttagctaccttagtaaaaaaatgtgtcacaatattagtcccaaccaaacagaccccactcatcaagaatcttaattgaccacaccacaatttggctaactgaaatcgtgtatttgtaaaacaaaaatagcatggtgacccgcgcagattgcatggctagcatcattatattatctcatataatagcatatatgttttctcattatattattcaaatatattaaaatgacatcataattttaaatttcgtaataactttgcaaaactacaaatgtgtaatattcatattgtattttatatacgtgttatttattaattatttttaatatcaaattttagttatttgtaaattatatatattcctatatggactctagactcgtcttttaatatttttttaattctgaattttctgtaaattgtatttctatatggctcttcttccaatattatttatttttatttatgattttttattatttctaattgtatttctatgtggactctaaactcatctctcaatattctttaatttttaatttcgaatttcagttacttttaaatggtattcctatattgactttaaacttttcttcccatgtttttcttaatttcgaattttagttatttgtaaattatatttttatacggactcaaaactctacttttaattttattatgtttattccaaattttagttagttttaaattcctatatggactctatactttacttctaatatttcttattttttaattccgaatttctatttttttcttaattgtatttctatatggactcttatactctacttctaatattacttatttttaattccaaatttctattatttactaattgtatttctatatgaactctatactctacttctaatattccttatttttaattccgaatttcagttatttcctaattgtatttctatatggactctagtctccttttctaatatttcttattttttaattccgaattttaactatttctaaattgtatttctatatggattctagtctcctcttctaatatttcttattttttaattctgaatttcagctatttctaaattgtatttctactagcaaaaatgcccgtgcgttgcaacgggtaaaaaaattctaataataatatacttttttcatgcataatgatgtcaatgacaatgtttctattttaatgagcagcttgtttttttataaacagtgtttttttttcttttgcgattttctcaaaccatttttcagaaatggcgcatttctttctaacagttttttcctaccatgttttttttctttttttacttatgaagaaaaccatatttttctccctttttttgcttttcttttctcgtgtgtttttttttcttgttttctcgcacgtttttttgcttgttttttttcgaaggttcttttttgcttttttccaacacaggagaatatatgacaaaataaagccatgtagtagatggcaaaaaatcgatgtatcctatccgactcaagcgtccatcaatttagcttttttctgacagttttttcagagcgattttttaatagacggtatttttttcttgcccggttttttaaaaccattttttttagaaatggtgtgttttttcgatagttttttcctcgcatgtttttttttaaatattttaccgacaatggaaataatttttctcgcgcgtctttttattttttttattgatgatggagaacctttttagtgtgttttttgcgctttttttctgacttttgccccacacgttattttaaccttttttattttctcatgcattttctctttttaaatagttagattagagatagagaagagatatatactggttagaaatcagatttggtttcgccctttccatttttttctctcttgcattttttattttatacgaaccagctttttattttttacgaaccattttttcaccattttcttagggaatcgaacggacttttttagatgtttttttgcctctataggaatcagactttttttttccgtttttaaaggattcggatctagcgtttttttgtcaccacttttttttttgccttttatatgaatcagattttgttttccgtcggatctacagtttttttcaccactcagggaaaaaacttttgttgttgttgtttttctttattttctttattgtgcggtttttcttttttccttttatgcacctttctttctgtctttgttctctttctcttttattattttttaacaaaaacgacctcaagtagcttgttgcaagattatagggactcaaatgtaaatataaaaaatatagggactcaaatataaaagtacaaatccaaaaattaaaatcatataaaaatggaatgctctcgacatgtagattctatttttgcaaacagatctctggcacatcaatttttttcaccaatctgagtcagactttttttttggcttttctttttctttttatgcacctttgcctttgttctctttctcttttattattttttttaacaaaaacgacctcaagtagcttgttgcaagattatagggactcaaatgtaaatataaaattacagggactcaaatataaaagtataaatccaaaaattaaaatcatataaaaatagaatgctctcaacatgtagattccgtttttgcaaacagatcttcaatccggcacattaatttttttttcaccaatctgagtcagtttttgtttgtaacagtgaatctatatccggatacaggagtcggattttttttttggttttttttatcggacaaacctggtttttttccgtccgttttttttggtttttttcgccccttttttcttctggatcggacttcttttttccattccggttttttatcggacaaacatggttttttctgttcggtttttttcacccggtttttttaacggacgatggaagcacctcttattttttaagtagtagtagatagatagatatggactcttaatgtgagaatttgtaggccatgagagcgaacgtggagattcttttttctatccttttaataatataatagatgtggagtactcccgggaaaaaatatattaaaatacacctttttgcccgatgatttaataggaatatacacgtttagaagtgaatagcagaagtataccactgtcgcagaatgtaagtgtgagacggcgcgatctcacgcgactaatagattaattagtgcaattagcaattaatcaattattattattttaattaacatcgttagtaattaaattaatcactaatcagtatgattagttacattagcgtcaactcgagccatctcgcttggccaaccagcgagactgaacgttctcacgctctcgccttacgagaccttcgcgcgttggtctcgtgatttcgcactaccgaaccgcaacaacggtgtattcgtgtaaatccattcaaatcttatatatttctgagacaaaaaattcaaaagtataatttcaaaattttctggattgtgtttttcttttttttcttttttacatgaaacatagaggaattgtcccaaatctgcctggactggaagaacagtagaagactctaccagggaagagatgcagttgggctgtggagagtccacgtaggctcactaaagcctgaggctatccacccttgggaaatgcctctgctgccttctccctccacagaatggcctcgatgtgggccccactggatcccggtgggcccgggccaaacgaaccagtaaactaatagcttcgcttccgagttcgagcctctcatgaccatggccgccgccgccgccgccgccgagctcgacgagacaagctagacgtacagaaaccgcgcgaagaagaataagaatgcggccgtggcttgtgccgccgccgccgccggcgtggcacggcgtggtgatcaggatgctgcaggcgccggcggtggtggcgctggccgccgtgctcgcggcgtcgacgtcgccagcgacggcggcggcggctgctgctgatccggctccgcaggaggaggcggcggcggagggcggcgcggcgagcacgctgtgcaacgtgccgccgacgctgtcgggggaggacaagcaggcggagaagataaagcacccaaagtcggcgagcgccatgcggtgcacctccaagtgcgtcagcacctgcgtcctcggcggcgccggctcgcccggcgtcgacggccccttcaacatcaggaggtagcttcattggtcgccttatcttgtcgatcttaactaatcaatcattcagagttaacgagatgaacacttcaatgcttctgctgatctcttcaactaattccttctgctccgttcatggatggatcgaaatatatgcagaccactggtggtgttcaaggaggattttcgcagccgtcagtactggtacacgcaattttcctgtttcaattcgcatgcaaatcctcatcaattcacacgcaaaaaaagaaaagaaaagaaaagcatcagttcatcttcatcttgtgcatgtgtagccttctggaatgctcggacatctgcaacctaatcaaggacggagaagatggccaatgactcgagatgtattatgctgcttcaccaagcagattagcagctaagacacgcgtgaatccgtcaaggaagcaatcaagcattacagaatggatgatttagaagcaaacaagtgattagcttggaacaaacgtgcatgccggcccagattaactgaagaaccatggcgtcggacctgtcaactgaatcgtgatacggatgaacacaagtccggtccatactgtatactgtacagttgcattaggtctctaacaacaccgagttagcttgatgtagccagctccctacgtagtgcgaaatcccgagttaaatttaagattggattaagtacacatctccttgtcaagttgttcaaacccgtctctttgcatacgcatttgcacttacatgtttgtatatgcagaatagcttgcaaacttataattagacctttttttttgaactgatgatcacactgtttgcctaaattgtttgatctgcgcaatttggcatcttaaattgttgacgaactatgtttaatgcacagcagaccgtccatccagcagtccacataaatggccaaaaccaagcccagtagcccatatcgctatatgggccggcccatgaagcaggcagtctaacgatacagcccgctagcccgctaggtcacacgattgacaagcgattccccttcgtagttgtccgcactcgcgcgtcgctcgccggccatcgccgccgccgccgccgccgtcgccggtcgcaggcccgcctcggcctcccctgtctctgtctccatcctcgtctgccctccgcctggcgcccatcgccttccgccgtccatccgcggtgcttccgtactctgttcccatggcggcggcggcggtggaggagggaggcggcggtggtgccgtggcgcggatcttcgtgggtggtatttcggagggcgtggcggccgccgacctggaggccatgttcgcctccgtcggccgcgtcgccggcgtcgagttcgtgcgcaccaacggccgcagcttcgcctacgtcgacttccactgcccctccgacaaggctctcgccaagctcttctccaccgtacgcatcgcccccccccaatcttctcgtctctccactccagtagcagccatcaacaattcgatttctagcttatgtctgttcgtggtaggaatcctagtgtgtactagtggagatcaaattacgattaattttggatttattagatgattttacctattatgatttgtgccatgcttgctgaattgttgttggcctaagactgtttgagactgatgcttgtgtgcagtacaatgggtgtaagtggaaagggggaaaacttaggctggagaaggctaaggagcactaccttactcgcctgaagcgtgaatgggagcaggaagcggcagcggcgcaggaaatgccagctagtgctgatgtggagagcaagaaggagaagctcgagctgaataaggctgttttggatagtacgaagattaacatctacttcccaaaactgaggaaggtgagcaattggtcaggctgtgagaaacttttcttatgctcagcacttatgctgttcatgcatcattatgtgctctatagccacttagtcctgattcctgaatgggtgtgactgaacaagtaaattgtattccatccattaatatgcagaataacatgatctttgtgaactttaggttttctctatattttacattagtgtaaactgcatccttttatcagacatgctaatcatatcttttgtctttcagaatttgggctaaactaagcaggtgtaatttttaagatcaattgttgaattaagaactgaatcagaaactgggtatacattaactccttacataaacttacttggatacacatcccattgaaactatgcttgtaaaaaatgaagaggtgatatgtattgacaatgtttattcaatatgtcgattaattcctaaacatgcattgacctaatcaagatttcacttgacaggtgaaagccttgccttttaaaggcactggaaagcacaaatacagtttccggcatatcgaagtcccttcttacccaattcatttttgtgactgtgaggagcactgtggacctccagaggcagctaatgatgaatatgcttctgttcttgatgctgctgcatatgaaaaggagcgcagtattatgaattctgtgatgagcaagctctttgagaaggagaatgaccatttagattcaatggaaattcagaatcatggtgtcgattttgatgccgcggaaccctctaacgccaggaatgagttgcaaatggataaaagagaagaaacttctgaggaagatttggatgaccaaatggaagaaacagaagatccttctgaggaagaattggatgatctcgtgcttaacatcgtgacttgcaagccaaaaagctctgtagcacaattgaatagcgaaaagcaagcagcggataaggtatgcacattgcaagtatttcgaacattattctgtgatgaactactctgttgtgcagttatgttcattaacattttctgcattttcaggactcgcgcttcagaaaacgtcaacaatttgaagaatcttctctgcagaagaggcataaatcctctgatttctctgaaactagaaataggaaacagtctttccctgctatatcaggagccatccaaaatgaacaaaaatcttcagatttgtcaggaaaaggtacacatgagttctcatcagaactcgatggagataaaagttctgctagtgtccaagatgttgaagcactagcagattcttctaccagaaatgggagtgaacaaaattcgcttgctagtgaacctaaaagagtttccttgtggactcagaaatctgcctggagggatcttgttggtggcatggggagtgcatctttcagtctatcacaaatattgccaaacaccaatccagcaccaccaaaagtttcaaatgctaccgaggcctctgcttcacatgctgagtccaggacgaaagtgaaaccaagcgggaaatctttgaaaccctcggaagctgcaactcagctcttgcctgagcagaagatgcctacaagttccatggcaatgctgtctagtgagcgtaaggagaataataagctggaaaaggagagggtggttccaaagatcactattggtgaagtgtgtccgttcatgagaaattcagagtcagaaaagcaatggtcaaaggcaaagaaggttctgactggtttcatcaagaagggcaatgagagcactggatcgaatgtcgggaaagggaagccatcaacaaggagataacaacgtagcatgtcattccagcttcatcttgttgaactacaagctcggtagcatgtcattccagcttcatcttgttgaactacaagctcggtggtttcgtgtctcataggaacatgtgttattttgttgattggtctcatagtctgcctgttaagaatgatctgtctttgtttgtgaagcacaatgctatgtacgagttttgttcaaattgttattattctttgtacgagcaatttaaagtcaaacatgtttcaaaaagtgacatctaacgtgcaatttaaaaacgaacggtcaaacatgtttaaaaaagtccaatatattttaaaaagtcaacggcgttaaatattgggaaaattataaaaaccatccaaatatcactctgagtttgagatgcctctccataagaagatttattgcaaatacccacctcctaaaccttggtttgatttaggcacattctctccacacacgcgtgattcctaaataatctcgtggcgaaatcaaccgagtcccactcagcgggagcaagagattatgttgttttctatataagacgatcatttcgttgcgttatcatggccatttcattgtgtttttcatgatatactagctatatattccaaactaatatcatgtgtactgaacaacatatccgttttttagaatgtaatgggcatatagaaacatttaagcatgaagcagtaatcatatagccagattataactacatgacttcatctgttgcaattggtcagatgacccaaaacagcaggtttcattacagtttaatcagaaattaaggccacacaatctaatgcaaaagagacttgttgacaaatcatcacgatgagtggaacttggctaatttcgccacgagatgctccaggaatcacgcatgtgtagagagaaggtgcctaaatcaaagcaaggtgaattaggacgtgtggatttgcaacaaatcttcttatagggggcatctcaaacttagagtgatatttggggtggtttttgcaattttcccttaaatattttgtgacagaggaaggaccaatgtgtaattaacagaacagagggggcctttttgcaaaagtgaacgtggcacccctaactaactctccggcaatcccggtgttttaagtagacaaatgtattcgaactcctgcgggctgtggcgctcgtgctcgccgtgctcgccgaaatggttctccggtggctcaccaccgcactaccgctcgccgccgctgccgctcgccacgcggccgcggctccctcctccgcggccacgctcgccgccgccgccgctcgccacgcggccgcggcttcctcttcctccgccgctcgccacgccgccgcggctccctcctccgcggccacgctcgccaccgccgcggctccctcttcctcctccgcggccacgcttgccgccgccgcggctccctcctccgctgccgtggcggttctaccggaggcggcgcggcgagtctccgcggcttccctcctcgaggagttaaacgccttcccggagatgtccctagtggtccggtggctcggcgccgctcgccgcccgggagcggaggtcgtctccaaaattgcggggcgccgccaccacctcaccaccaccgccgccgccgcggctccctcctccgctgccgtggcggttctaccggaggcggcgcggcgagtctccgcggcttccctcctcgaggagttaaacgccttcccggagatgtccctagtggtccggtggctcggcgccgctcgccgcccgggagcggaggtcgtctccaaaattgcggggcgccgccaccacctcaccaccaccgccgccgccgactcgaaccttccaagtcaagcgcccggacgactcgtcaatcgggggggtgctcaagtgatcggcgcgggcgacttcttcggctgggagagcaatgattgcggctgcctcgccgacctcgcgccgttccctcaccgcggcgcgccgttccctcgccgccgctgcggtgctgcatcgccttctcttccctggtggttcgcggcagagcaggtgcgcttcggcgtgggcgaccccttcgagagcgatgatggcggcatactccccgatctcgcggcatttcttcgtcgccgccgccgctgcgcccacagcagaagaatcttcgaattcgagagcacccaccacggctttggcaagagcaacaatggcatgagcggcggttttcgttttatgttggatgacaccgacaagaggtttcgccatgtccgagctcggagaaatcggtggcaacagctggtgataaggaagatgttctcaagttcagggaagcgcagctcgtcgacttcaaggcaacagacgccttcgccgacctctttaccagcggccatccccagccaaccagcagcggcgatttcttcctcttcatctgagactaattcatccagtgagcaggaaaaaggggcttcctcgtcagcatgctacattgatgaatcattcggtaatcaggagataattgacgctgagacttatgtcaaggcaaatcctatgcttgttaaggcgaatgtactgggctcagcgaagacattctggagaatgtcggatatagcagtgagactcattcggcgacttgcgaggattctgaaaattctgcacgaacagaagcgttatctcctggccccgctctcagtgcaaaatctagtaattgtctcgggtgaacttaagctcaggaatgtcacccttgcagatgatgatttcagttttgatcggattaaatgtgattatcagtatatgtccgttgtgctggaagagttgatcatgttatctgtcggacaaaatggattgtccaatatccctcctgattttggcaaatacttgggtttgcttaaaggactagtcaaacctgatgacgaatttctgataaccaaccatgcttcgttattgcccatggcaaacaggtacacccgaatgtttttacatactttagttacttcaattagatccagtaagttatccaaaatcagtactcaagtaacacctagatgaagttttgcttagtaaactgtgtttgctactgctgtccttatttagttcgtagttagtactagctaaatacacgtatcttgctagctaatatgatttatgctactgttgtccttattatttagttcgtactacctaaatacacgtgtcttgttaatatgatttacgcatgctacattggttcgaaccaatttggtagtatatatattagtggcgaaaattgataagaaagcaacgacattgctgaaatttggtagggtaaaattgatttcgcgaacgctttttctgtgattttgctctattcatgatttgattgttcttattaacaagtttggtactagtagatatagagtttgtattagtgcgggaaaaaattggtagcaaagcaaacatatatgtgatagtactaaagttgccgaaatttcagtagggtgtaattgctttcaattaaacaagtccatcatgcacatgtttttgtgattttgctctattcatgattaagtgattgtttacattatttgggttcatttttttcatcagtatgcatctctactacatgtgtaggacggatgcatttatgatgatgtacaatcatattatgggctatcttggccgcaaagatcctaaaaagaagatatacattctatcacacctgaagtatgacacagactggcttcgcacagcgtcaggaaacagtgagatagggaaatggctttggcgccggagatacggccagactgttaaggagtttctgcacttaaatcggaatatcaggtcccatccatatgaacattccgaggaaaagatcgaagaagctctatacggtgaatggccggaactgctagttgaaatgcaagaaaaactgcacaaagagggtgaattacaaaacactgagatggagtcgaaatttgggcagcagtgattttctgcattgagtctgcatcatggagaaacatatgttctattggcgctgaaaatgaagacatataacatctgtgacatgtaaacaaatctttcatacatgcagacattgatcttgcaacatagtgcacattaatatcataaaagtgcctcagtgttttttttttctctcttgagcggaaatgatgttgatgtgcaaatgaacaatcagtttaatcttgggatcaatgatcgaggcacttgttgggtgtccatgcatgaggctcatgagcacaagattatgcaaaacgaacaggaagaaatatgtatggttcgtgtgcaaatgactgttgattgtcagcccaatattcatggagatggcgtacttccgttggcacaaattacttaattaattattcatgcatgggcgggcgcagcctattacacttgttaattaggcccacacggccggagttgagttaataacctgcgcgtatggctggattgttgtacttgtatcttggactcttggtttgggcgtgagcgagccgaacgatcaatttgttggtgaactgactgatttccggccggctgtctgctcatttattagcaggaggtagtttttttttaacggaaaatagcactagagtgccttttcattgaatagaggaggagaaaatacaacccctagggacaacaggaaaaaatcgaggaactgtagctatacactatacatagtgcgggattaactcgcgcagccgcttagcccctgctaaagcccaaaggctagcctcttctttaattcttgacaggaggaaactcgttgccacctctttgtggtcaaagattcgccgatttctttccttctagatttcccatacaactagtaggatgagtgatcggagttctttcttcggaacatttggcgtgtttgcgatgctctcccaccactgttgtactgactgtgcctcctctcattgagccggctcaatttgctgatatcccacccatccagcaacaaggcctcacattcttttagtgtatctacaagtggcaacgaggtgcaaggaggtagtttgatcactttggcggcggcggcggcgacaggcactgatcgatccatgcttctgctataaaatttggcctgaactcgaagagaagcgctggctctcacaaacacaaccaatacattgtcaaattaagcctgagctcgaagagaacggctctcacatacacaatcaacacactctcttgcctattctcaaaaaatacactctcttcccttccctctcactctcgatcctcaccacaaccacatgcacgcacggcactagctagctgccgtcgtcatcaccatctcacacgtgcacaccatttttctttcatcccgatctccattaagtacactattgctctctctctctcatctattcctttgggcttcccttaagctcgtccttgtccaccgtccacgcggctggtttctggtgttgtcaacttggcaacaaatatgatggcggaatgcaagacagagacaagtgtcttttaaaccatacaagattaatagctgcgacaacaagcccaaaccatcattaaaaaatatagttttattccattattttcattttttttcatcctcatacaaccatgttttcattttattgaggataaaagttgttgctgagcagttattacctacagtagcaatattttatctcttttctttctcttttccatgtcagcaaatattcataattagcaacattaagagatcatgtcgtgttaatgaccattgtacatgtctttaggggaggggaataagttcatctgaggtcctttaacttgtcaacgaatccgattttcgtccctcaaccggaaaaccagacacaacgggtccctcaactatcaaaaccggtgcagatgaagtccctcggtggttttgaaggcggttttggctgatgtggcgcctacgtggctaatttgactcggtcttcatctgacgtggcgcttagtggcaattcgagctgaaaaaataataaaactcgtggaacctacatgtcagttccacacacaaaataataaaaaaatggtgggacccacatggccccacatgtcatcctcactcctcctccctctctgtatcctctctctcccctctcctcggcgccgacgcttccatccacgcattactcaacgtggtggccgccgacgccgacccacctcgcgtcgtcctcgtcttcggcggcaggcccatccgcgttggcgccgagctcctcgacgccgtcccgtcgctccgctgcatcatcaccatcagcgcggggatcaaccacatcgacctccacactttaggaggcaacaggggtggaccccaggccttgggccgcccggtccatggctcgaggcctaggatgcaatctctattataaagtctattttttcaccatgtaatggtccaaactataatgggctggcccaaatcgtgggccaatcctgggtccaaccctgagaggcactagtgactagtgaggtcgtgtatgtttattgtgaataggttaagtttatagtatatatttttcactatttttctgggtcatttattttacttcgtttagttagcagcaatatctttttcccctttgttagtacctactatcgaccattaagagaaagatggaaaaaccacttaagaaaaagagagagggaaaataattgagaaacgcgagcaaggcaagaagatgacttgggagaggcgaggattttgtgccgtgaggaaaactatcacatcctgatttttgtttcaggatttataaattatttaataaattaataatagaatttatattaaatgttctttaatttacaagtgaagttaaatgtgggaaataaaatttcctaaatataaagcatggatggatttaatttttattaaattctccatgattaagtaaactctctgaaattttctcggatttttcagagctcaattcctaaatgatacaaagaacagttcagtaattatttgatcattaatgatctaattataattgttaagtgcttttcttgtttaaaatccttaaattataaattgttgtttaaaaggaattattagaaatgatttcaaaagcctagaagagaagatcttttttttaatttgctaaatctcaatataaaatggggccagataaaatttcattaaatactttgcttaattctataattcctagatttttctgggatttatttgagctaaggaagtatttttaataaatagaattgcatttcatgaataatttaaattgaaaaaggtttttaaaagtctcttttggctttgggccgaaagccggcccaaaatctctctctctctctccctcggcccagtccggcccagtccgacgagccgccgctctcttctctctctctgtcactgacaggtggggcccgcctgtcagacccgtcgtcttccttcggccgccgccgccgagccgcgccgccgagccgcgccgccgtctctttccaaattccgtcgctcctttccatctccggccgaattgatagaggggaaatgatcctctcgatctcctcttccttttctcttttggaatcatcacctaattcggtttggaaactcgtggattcgatctcgaatcggatcgacttctctcctccgaaccctacctttccttctcgtcgccggtcgccgtgggccttcgccgccgccttccaacccctataaaaggatccccggtgtctcctctacccgccgccaccctcgccttcgtctctcgccgtcggaagcgctctagcgccgtgtagcctagcgccgccgtcgccgccgtcgctccagccgcgcgccgccgccgttccagacgtcgccgtcgctcgggaagaccgccgtcgtggtcgccgtagcgtcgccgtcctcgtccgccccttcgccgccgccgaagaccaccggagcaccgccgtcaccgtcgacccgaagaccgccgccgcttttcctcgtcgccggcgccgtccgttgcccttccgccgttgttttggtcaccggtgagttcgccgagtcgccctctacccgttggtgccttccgtttgcgtcctcgcgccgtcgttcgccggcgagcttgcgctcccgagccgccgccggtgctgacgtcatcgtcgccctctcccgtgagccagtcgtggaccgatcgatctcggccgtccgttttggatggatcgatctcggccgtccgttcccgtgaaccgccgccgtgcacccggtccaccgcaaaccctagccgctgacgcaataatccttcttttccttttcaaaaataattcattattgcgtcataattcaattaaaatccatataagtgttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgtcggaagtgttcaagaagattatttgaagaccgattattgcaaggcaagtcacacagatcctaaacacaatcctttgagcatgttgatcctatatttaaattctctatttatttcaactgtgcatttgttttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggataacttatgactcattattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggcggagataagcccacgggggtcgctggggagtccatgcctctggtttttgagggggtgattatgatccaggaatggtgcgctgcggtgggttgtgttatgcaaggggtaatgtcacagctcctttccgaggtaccgtggtggtactgaggcacatggtgacatgatgtggagctgtgtcttgtgggtacagtggtacacctctggccagagtaaaactattcgaatagccgtgcccgcggttatgggcgggttgagcaatgtttttcgtgattagtctcacacctctcacaataattatggatgttatacctgataataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagccaatattatgccattctttggtatccttgtgcacttgcgtatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatgacgaggactaagtgcctcataagtaagtatttatcgttttagttaatttgatgaatctgtatattaaattgtcagtttgtgtacctcggctgattcctggacgaggattttatgcacaaataagttcggaaattactagtgaatttctgggcgtgacaaaaactagaaaggaatgtgcggcgacacgccgcgcacacaaatatgacttacatcaaaacttcttttaaacacaaatcagctatgggctatttagttttttaaaaaataggagtcataggttatttggttaaaaaaatcagagaaaggacaaaacaagatgcagacaatgccagtcgggcactaagatgcaagtgatggtctgatgagtgatgaatgccagatggaagcaggcaagcagcaacgagtgcagggtttcccaaaccgacggggccagggttatcgcgcccccgtaaccgtatgtaaccgtgtaaaatttatcaaaaatttaaattatttttaaaatttatttgaatttaaggaggtaaccgcggtttttctattatggtactcccgcggttaccgatggtaagtcaaacctagcaacaactggacaaacgactctacacgtctgaacaccctgttaatctttactaaggtggtgattgggaaggagggactaaattttaatccctcttacaaaagcataagtttctatgggaggaactaaaatttttgtgagagtccctcctttctaaacaccacctaaataatatgccaacgtgtatgtaccagtcgcctaagcaaaggaggtcgttctctcatctcgtgtgcttttgttcgtcaatgcaaccgagattcaatttattgccaattcagtctgcaatataatcctaaaagaatgtgtaattgtgtagtgggagggtgtcacaaaactgatagctcttctggtgggattagagtagaagtagccctcttccttgggtttgtcaggaataatctgcgtcctagatgacgcgtccatgcggctgctatgtggtgcattcacagcggaggagaaacggtcccatctcattgtgccgttttttttactgatcaacgagttcaactataagctcggcttgctgttactctaagctttcaatataagctgggccttgtgccttttatctcaaattagaaaggtaccccgcgtatgatagattttgaaaagcactatttctcaataatttttctacatcataatttttccaaactatttattagcttttaaaatatatgatatttaatacattcctataaataattatctatgatctcttcagtacagagctatatttagtttgtttagaaaacatttctaatttaaaagtaatatgttttgtcttatttaattgaatgtttagtggccttttgttaacaaattaaaaactattattattaataaatatgttttatttgtagaatcaagttatgcatccttttagttggtttttattgacgcaagttattacatacttagtatacactggtaccttagtgtggcttcttatatatgtaataatatgtggaaaaactcataatgctatggtatggtatagtatagatttaaagccattaatatctaagcatttaaaaattgttatgaaaatgaaacatgcaaaggttggttcaattttagtaaaaagtaagaactatttttttctgaacttattagactttctccaaataattcaatttagtccttttggcattttacttctatcattatagatctaatttaattattgtgcagttatatagaacgataaaatctatatcattttttttcataatttcagaattgtttgaatgtcatgctaaagtaaaaaaaatataaccccaaagtggcatatgaaaagttaaattacagtgaatatgggtttctaaatgtaaaacaatctaaagacataaacggatcgcgtgatttagatgttatagttatttatttttttagtataagtttggcagcattgctcatagttatattcattttacttttctgagatctaatttaaattgtgaagttaagtacgatgataaaattattactattattattgttgttgttgttgttgtagttgttgttgttgttgttgttgttgttgttgttgttgtttttgttgttgttgttcttgttgttgttgttgttgttgttgttgttgttataataataataataataataataataataataataataataataataataataataataataataataataataataataataataataataattattattattattattattattattattattattattattattattattattattattattattattattattttcatattttttataattgcccgagtgacacgcaaaagtctgaaaataaaacccaaaatgacatttcttttcaaagttgaattatagttaaatttgttcttcaactgtaaatttagtcataagaataagcggatcaaaaattagttatatgatttagattttacaaaacatattttttgcttttctaactaataaaacatgtaaataggagaaggaacagggagaaaagaggtcatattttttcttaaaaaaagtaacatacgtaagtacatacatgcctaggtgggcccaattttaggaggtaattttttttcgttaagattgtcagagggtgaactcctcaagcgggggacagtgaggccccccttgttgattcggtcgggggcagcgggtgaaaatcgaggactctatgaaacaggtgatgtagaggaggtcgggcccctcgtaaacgatgaaaccaaaggggtttatataggttcgggccgctgagaaacgtaataccctactcttgtgcttgactgatcgactgaggaatacatacgcttgaatcactgagaaccaagcgtgagttagccaaagaaccgatctccccctcccactaggcttggacctctttttatatctcaagagactgccatatgtgcctagaggtctacctaaggttgagggaggatactctccacattaaatgcatgtcttgttgcttggcctcgaagccacacgcacaggtgccgcggcatggggtccgtcaaatccaaacggctaacatgggggactctcatgtcattcaccatttaatgggtgaagatatttgggtcctcacttgcgccgggatatggaaaccctgctctaatcgggtcagacgaatcgactccggctgggatgagaggataaaaagcctctcatcatcacgatgtgacaggccgactgacatgcaaccagtgcgcaggcacactaccctggtcccattggtcattcgaccagtcagtctcaccacacgctgcatttaatgcggcgtgtcgcgcccgctcatgccgccttgaatgtggttaggtaggcgttgaggggcgcccacctaaccctacacacgtggcgttatgcggtggggggtcgggacagcatggagggggcggtcgccgccctacctcgggcccgacccccctcgggggagtgccacatgggtaccggggcaacctcctccctttgggcttgataccccagggcctgtatcaccgacaaagataattataggctgtaacgatttcaagtttttcttatccataataatgacatacttatatcataaatatgggttttatactgtaaatttattaatgataaattatctgaaaacataagctgatcaaatacatgtataatttagatactacatataaataatctaacaacataagcatataagaatacatgcatgatttaaattctttcgatggtgttcataggggtagggtatacgtgtgtgcatcctagggggtgagtgtgcatgtgttgtgagtgcccgcatttgttttgtgtttctaaaaaaaatactatagttgcttaaacgtttttatataaattttgctttccaactaatagaaggaaaataagagagataatagagtgaaaagagtagaacagaataggatggtacggagtacctacgtacacgaacgtccattcaaatagggtggggcccaatttagaggtagattggtttttcttttccatctaatctaatagttcaaaagaatgggtccaccaatttaaatgaaaatcgatggttagatgtttttctgccacgtggcagcttagaagtgctcgtagaaagtttaatggacttttagtatataatagatagataatagatagatagactataagctcggcagtagtcttcttgaagaccagtatctgtgcacatagaaacaagaaagaaggatccaattagcaggtgatttttttagataattattagcagatgaataggaaaggagataaaaaggattattcagagtttcagacacaataagtttcagcttagaacataacagttgctaagaatgcaaagactatatacacaaagcatccagttttgatctgtaattattccaacgatgtcgagtggagcctctcggtgtagcattagttgaggatttgagaacatccttccattgaaagaaaaggttgagatcacgcagcatgacatgggctgccatttaggcgggcaaatggtggaggtactaacttttgatagcaagggatagtgtaggctggcagttgtttctcaggtgttgtgtggcaaaagtactaagcaagatgttaccaggaatgaatttatcagcagtacctgtgatgaccgcccacaacttttgccatcataagtggggatgaaaatatcactctccaaggacaatataatctaacgctaccatctgggaggaatggttctggaaaaaacctgagatatctgaaggcaataatgtctcttttctcacctgaccatcaacaatgagaaaggaaattttataaatatgagatatgaaaggaatgcgcaatcagtagcattggagaagataaactgaccacattgggataagctgaggtaagggcagccattcttctttggccaccgtatatttcaccatcggcaatgtatatttgataactcctatcaatgtctagtgccttcaataccattgcagcctcctccattgttaatgggcagagctcatctttcctctttgcattcgagtcaatcaccttctctttccaccatgggtaagtatatctttcaattttcaaacacaatgtagttgttaatacagattgcaaaaattacttgagaaaattttagacaaaactaaatacctcattattgtgaactactccgtctcctcgttgttgcaaccatgtgcgcaaccagaggaaggcaaagcatgcccatttcatatcgctcgcaagtgaagaaccacaaaaaggcccattattacgaagaatttgaaccacacgtctacccacctcttctatttcaggggtaaatcacaatgcagcaaaattgacacaacacctcaaattctgaatctccataggcaggcaattgcaaggtgtgcatcggttttgttcaaatgaagaatcctgtacttccatatcagtggtagagtcagttttccacaaataaacacttacaatcttcaactgattttacacgtgattttgagttcatgacgaaaaaccaatggaaatgagagatgaaaccaaacctgactatggcaataagatatatcagaccaactgacaggcggcatggagcggacatatccaagctcaactcttctttacagccttagaggcagctctttcagtttcagtacccggaccactatcaataatgcaatgaagtaatcgacatcacattatactaactgaaacaaaagaaccacaagaggttgagtaatgagtcaggaccattcttaattgaattctggtgagtgccaactgcaaaaagaaggctcaccttggatcagcccaagatgaggttatgtccaattctaacacgataagggtgttgttgagggatatatcacatatctgacagacaaacaattaaaatttttgttcggccgcgtgatttgccctctcgtcgcagggtggcgagctccgggaagtcaacctcctccgcgcgaagctcgcggcggcgcgacgtgtcacgccccgaactagccccgagcggaactagcccgtgacgctccaatttaacccattaatcgataccagtcccaggaaacagtgctggtatcacagggagacagaatatcacagcaacagaggtctctttattatagagtaggagtacagtcatgttgggctgcggacccgagctcacaactgcattacgaaagggaagcggaagccaagacttggaccaaacatcataggcgcgacttgggaactaggccgaaaccctaaaactcatcgtagccgacttgctcctggaagaactcctcgtcagcgggatccgcttcatcttccttagcaactgggggggttatttatatagagcaagggtgagtacgggagtactcagcaagccatgggaaataagtgtttaatgcaggcttcaaggaaaggctgttgtttttgcaattgattttatttaaactcttttctgaaacaattaagtgagtgcttctcaaacgacacgaatgagaccgtgcgtctcgtccggtcggagtatgtgcaaggtatcagtcttttgaattgatcatggttggcacccggccaacggcttttaaacggccacccgggcctggctgatcccatcagccgcagattttccaaacatcgaacccaaaccacatcagcaaatttcacaagcagtaggcaaacaaaactacgctaggaatcacctcacatccacccatgaccgtgggcatggctgttcgaacagtttaataacctctacagagggggtacactttacccacacgacattactaacccggatcatccagcccgtgcagaacggccacgactagagaccttaaggctttcatgacaaggcatttcgaaagccgacacaggttcaccatatgccaacaagaggggtcccagaccatactgtgccaggaaacccgggggttctccccgacaccaccccgttgaatccacatgtctcttggcatcatggctcccccgattagctagttactcagccaggggtgtcccattccacccatgtggtcgcacttgtcttatgttcggatgaacttccaaggaaacggtccttaagtgcaagagcaggaaaccgtacacccggtacgttccccggtccgcgattttggaaattcatttagttcgcaagcaccgacccaggtgtcgggttttccaagtcttttgtaaaacccaagttttacccaagatgtttctcagtttttaagtttgaaggcgaccgtcgatactcgtgcagagtgcacgattaccgaggcgcaactaggtggttacaagggaacatggtataacaattaacaaaggaaggataagatgcaataagctaggtaggcccatcggtctgccttgcagacggggcaaacagattaagtgcaatcctatcaatgcataatatttttcaagcaacataattaagttcaaatataggctcaagatgttcaagggtggcttgccttgctcgagatcttgagcttgatcctcgaaattctcgcactgtgggtcttcgggctccgaaactacacgcgaaacgggacaactcaacaaacggagaaaataaagccctattattgacctctaggcatgccattagatagatctcgagatttgaggagttttggaagttgaacggagtcaaacggacttacggatggaaaaatattgaatttctaagattattggatttttggtctaaaggaaaaggatttatttaaatcctttttgaaaatgaaaagaaaagaaggaaggagggagggaaattagactttcctcgggcggctaggacgcggcccgagagaaaggggcggctcggccgaacctaacagaccggtcggcccgagaaggcggcccaaagcacgcgcgcgggcggggaggggagaggaagccgatgggccggatccatcccgcgtggtcccgagtgggacccgcttgtcggcgactcggctcaccgtgagcgaggtgcacgcggggcgtgctagggtttggggagggaggtgcggtgcatgcgcgcggttcgcggaggacgcggatacggcgggcccacgcgcagcctcacggctcaccgcggaccatgcgcacggggggggggggggggaaacggagggagcggctggccgggtcagccgatccggtcgtgccgaggtggctccgacgtggcgcctacgtggctgccacgcgggccggctagaggaagacgaaggcgccggccgcgaatggacggcaggcggcggcggtttctccgggacgccgtgcgacgatgaggggcgacggggcgtacaccgggatgacgagggagaacgagagggagcgagccaacggcttggattcgccggagggagtccgtcggcggcggattgcggcagcggcaaccggcggagagaaaaggaggaaacggcgacgaggtcacgaggggccgattcccggcggtgagagcatctacgcggctacgggaacccaccccttgcgccggattaggaggaaacgcatcgagggaggccggcgacgagagacgcttccgagctcgggcggcgacggcggcgagcacatggcgagcgacggcagcagtcggggcggctccagctagctactggggtactacacacgctactaaccaagtctaaggggaggagatggatcgaggaaggagaacgggggaatgcactaccgagatgaggcggggcgctgtgacgagatgccgacggcacgggagtgatctcttcggcctcgggccggggtagaggaagaagatgagcgcccggagtccccttccgcgtcctagcgcgcaccggctcctccggcacacgcgacggcggcggtcggcgagagagacagagggacggcaatggcgcgggtgaaaaactgggaagattgggaggggaaaaaggaagggagggcgcctgggtttatagggcggcaatgtcggttttggaaaccgaccttgggcggtcaaggtgcgagctggcgttcggcgctcgcggccaaaacggcgacagaggcggatgacgccggcggggaagaggaaagggaaaaaggaggaggaaaagggggcttaccccttgccactttggggaaaaggaggaggaagagagggcgacgcggcagagggggagagctctgcctccgtcccttggaggttagcgcgcggagagaggcggggccgagtcgatgacgacggcgatgacggcgggggcggtttggaatggagcggcgacacggacggcaggcgcaggcaggcgcggcagaggctgacggcggcggcgaccaggcggtcggccaccacggcgcgcgcgcgcgggggcggcgcggcgatttgggcggcgtcggcgggaacggcagcgagagcggagagggagggctcggcgcggctcacgggcagagagagagagagagagagagagatgggccgagaggaattcggcccatcgaacccgagggaggcaaaatagacttttgcggagggatttgatttgggaaggatttggattcaagattgaacttgacgatagatcggggatttgagatccggaatggcacggacactagacaacaagcaagaaacagatttcgcaattagggtttttaagagatagttttcccgctaggcgccacgacggaacgggcgccacacgacgcgaggccacgatgcacgcagtgaactctggctcgaaggttctcctcatcctcaagatcgttgtcctctctctacgtgttcttctatgtcttcagtgttgatttcgtgtatgtacatgtatcttggatggttatgatgggggatctcaggttgttcttggatggggatctcaaggatgtttttttggtttgagcagaagccgtcgtcgctcgacgcatttcccgtcagccgtgagctcggtgcctccgtgtacgtctaccgccttgcgagcgcgccgcctttttttattactagattctcattgcgcgccgccttttttgttactatactgttgatcagttttgaaatatgcatgatgatttcacaaacataacagtactatttcaagcaatctccaatttgaaaccatatagtatcacaatgtacttagcttacaacacattgatgaaacgtaccgactccgagtgacaaatctacatataagcacgctgtacaaagtggtacatctgagtttgaatatcttcaattctgtggagatcttgcctgggacaatccttgatcatcagttgcttgggtatttataatgcccatggagtagtcaaaaagagatggcactcgtgttgtagcctcaaaacaatctgcaaaaatattagttgtggaatatgctgaatggtctacttgatgtctaaccagattcatgttatatggtaggtgtgaaaaaaaaagaagatgatcctatggttcatatttgtgaaaaacacaatgaacaaggttgtttacaggaaaaagttgctttcatcaagatgttagcatgttctaaacctctaaatctctaattaaccattttaatgtacgtatataacatagccagcatccttaatgggtgttagtaatacgtagagataaaaaaatatgtattattattaatcgacagcgcattgcggcagcatttccaccataacatgtagaaaatgcatggcaataatcaacaacaccagataccaaacacaagatactaactggaactcttaaccatacaactgaaatttgtctaattgttttagagaaattagtggattcatcagataaacaaattataagaagcaaactctcatgtaagaagttttagatatgcagagatagaagttccaaaccccgacaggggtcgacgaaatcggatagacttttggcctgatgttcttgaagatcattagttttctatatacatttctgtggaaggaactggctgtgtatatctttcgtggatatagaggccggattaatgaaaatccattatctaaaaaattttctttggaaggaaagaaaaacaaaatgcaacagtatagaaagggaaaaaaaagggtaaatgaaggcacacaattgatagtgcatactcaggtatcttgttcttctgtagatggctagagctttgataggacaaagttttgtcatgtcaaagaactgcaataggtcaaaaatataatttgatcaaagaatctagtacagccatctatgattaaaaacagaaaagaaaattggtaaatgatagaaatgccatttccacgagattaatgatgcaatcattgaatgaacagtaaatcttgaaactttccttcagaaccagagtagccaaagttcagaaatcggaaccaaggtcagacatacaattaccagaggtaaggcatagcacatagtttccaaacgatgctccttgaggctgcacacacaattataacattagcaaatggcatgcacaattcaaaaccagtcaatttataataatttaacttatcttgcaaaataaattcaaatcaaccatcattatgttaacatattataattatacacatgcagaaaacctgtccttgtacattgtttgcatgacttctttgactatcttagtctgatgacatatgtatggatatcattctattctacaagtagtcattccaaggcatgaatgcatctttacacaaatgtgatgctaaaagcaagcagactatctcccttttcgtaccataaatccaaaacagtacacaaaagctaaaatgaagattgtgatataaagtatcctgtcatttacagatagaagatcaagatgacatggtgatcactatgagacatttataggccttgattggaacttgtaacttttttttgttgtttactatggtaattaaccaactcctgtatttcacattgcctctacccaggaataagaccatagattttgtgattggactgtccaagatatactgatcaaatattttcaggttgtaaagggatagaggaagaacagagacaaggagggtggttaggatctgttcatatggctaagtttttccttttttctatctctactaaattaaaaaggttcttaccttagtaattacaactaatgtctatgttcagaggttaaccttagcacttggacaaaacatcccccactacacaaccaaacctatagataaaattttctgcttggagttcagaccatcgatcaaccaacaaacatatcaacaagttctaatacgaagtaatatcacctgaccaaccctcaccttccagaatccatagccgattgttgtcctttcatcactaataagagaaggaaaaaattcatcgatcgttaggtattacttggacaaggggtcatctatgggtataaatacaaacccccctaggaggagagatggcacaaccaacatacacggaagccacggttcatatgcacccacctcatatgaacggaagccacggtagtacataatggactagactcatccctggtgcaatgtgcatatgtgtcagccatatgaggtgggtgcatatgaaccgtggcttccgtgtatgttggttgtgccatctctcctcttagggggggcttgtattatacccatagatgaccccttgtccaagtaaaactagggagaccaatatggatacaatctggctagtacttgtcgtttccatatagaactctatttgtccttccttatccggaactctttctatatacgaggtatgattctgagcttagtcaattactattagggatgtggtatccataaccctgacaattttgtatccctcttctctttgggttgtgccttatatggctgattaagtctattttcgatccctctactatttttatttgaccatgtcgtgccgggctggcccaccatgccaaggcatggctcaattgtcgggtcgtgccgtcgagcctcgggcctttatggccatctatataggtgtatgttttagagtcagaaccaagattacatgtaccggagtttcaaaaaaaaaagaaattacatttactggttttggaactgtcatccatgcatactagatgataccccgcgcgttgctgcgggatatttggataataccttcatattaacatttgtattggctgaaaaagaagaacaaaagtacaaagaaaatagaaaacgtgttataacttgacgactgactgaactaaaacaacagatctcacaaagcccttatccagttaaactgagaaaagctaactgggctggataataaggtttgtattcatgcaacgatcaggaaaaaccataggattagatcgaacggcttaaaagtgctgatgacgtggagcaatctttataagagtaaatgctctagtgggtaccaactgtataggaagaaaggataagcataaatgcctctaaattggtaccggttaaaaaaccgacatctatagtgggtatccaaccgacaccaatagggaactacttcctctgttttatattataagactttttagcattacccattttcatatatatgttaataaatctagatatatatgttcattaacatttatatgaatatggacaatgctagaaagtattataacctgaaacggaggtagtatgtactagtggacgacgagctcccatctcccggccgaggccaacgacggcggcgcggggacgacacgcgcctcccggccgtcatcccgtgaggcatagaagtagcagctctgctggccgtgttgccaccaagctcgccgaggaccgttgatgcctccacggctccaacgttgattccccagacgacaacgtcgtccccccaccacaagatttcgccatgtccaccgctcggccttgagcatcaccgtcctcagcatcctcgcgctgtcaaagatagtaaggcgaaaggaaggaatggcacactgacacgtagggccataatattttctcttttcccccaaatataacagtgccactttaaccaaaaaaaaaacgctttgaacgagtcgaggttttgcggcaaggcttaaggggctcaaaatagacttattccattcagagctgtttggggcacagggccggcggcccagagaggcggtggtgcccacgaagcctacacaagaccgatgccctatttaggtcaatcgtggactatggacaaccccacaccccaaaatccccaatcgccgcgccgcactgcgactgcgattctcccaatccccggtggatatcgatcggattcagatgaacactcgattccggcggccggaggtaaatccggagtcgattttttcgcaaatcgcaggtactctacgcaatttttgttcctaatccccaaatccccaattgccgcactgctactgcgccgcgtctcgccggccgatttggatggctgcgggtgggacgcaagcaatgaggcagttcgtctatctggtggtgaagggctgctacgatcgccgcctgcggtgttgtcgcgacagctacatggcggacaccttccacatgcgccgcatcaacgtgtcccgcttcttcttctaccccgaaccgccgccgccgccgccgctggcgatggtcgtcgacgctcggctgcctcgcccctgcatcaccttctgcgccccctgggtcatgcacttcatgctgctgggccgcaacagcgacaaggtgctcgccgtcgaccacaagggccgcaccaccatgtacgaccccgccgccaacaccatccgcgccgcgcccaccctcgcccaccccaagagactccccgccatctccctccccattggtgacgacctctacatcctcgacccgacctcctccgaccaccgctgcttcgaggccctcgtctacaagcccggcggccccgcccacgactgggtcaccacccgtggccccatcgaccggtacaacgactggcactgccaatctctcccgccgccgccctaccatccctactcctgcagcttcgtcggcgcaaacggagccatcggcggctatgcggtggtcggcggtggcggcgactcagcagagatctgggtgtcaaccaacgacggcagcggcagcggcaccttctctttcgacacggcgcggcgcgcctggaccaagcacggagactggacgctcccattccgtggcctcgccgagtacgtccccgagtacaacctctggttcgccctctcctccggctccaacaacaaccatctctgcgcattcgatctcgccggcgcagccgagccgccggcgacgcgcgatttctgccaagaactcaagccacccaaggactggaagctggtgtcatcccatctggtgcacctgggatccggcaggttctgcatcgcaagattcttcgaaaagccggtcaagattccagtgtgctgcgtctgcgacatggatacgcagacgtacggcgtcttcaccggcgtggaggtgaagaagccgggaagaggcctacggctacggatggtcaagcacagatcagaatgttatcgcttcgatgaccacattaaggaatgggtgctgtaatatttatctagtcttttttagaaagatttgtgcaaatagatgaactcagtagcattggatatgctggtgcttcaacaccttgaacactagcacaactttttatctctatcaagttttagaggagaactcatctgtaccttttcctgacaaacaagaagattttttattttattttggatgtctcctgatataggaggcaaagactgtttcagtgtttcttttttctgggttcagaaaaatcagaggatttatgtctcttcttagttcttatgtggagaagattcttcaaattgctgacgtttcttataacgcgagtcctgaaaatgcagaaaatgttaatgcagataactacacaacagactggaacatcacaggataatgttcaaaaaaggtacttgtactatgcataccttattctctgcaaattgttccctatttaattgtgctactgagctattgcacttgcgagttatgatgttaagcacaagattatccaattcttccgcaaaaggatcttcagtttcatccatttgcaggtcatccaaatcaacctcagaagtttcttctgtttcctcaatttgcgacatggatacgaaccgcacggtccaagctgttttcaccggcgtggaggtaaagccttgcggtaaggctggaagagggcttcggatgatcaagcacaaatcggaatgttacagcttggacaagaactcctctaccattgagtgctctaagtaagattcttggattttgttactagcaaaggctccgattagcggagctagctgctgctcaaggaagtaggaagccagcaataagctgcaatgtcataatactaatggtaatactccctccgtccctaaatatttgacaccgttgacttctttaagcatgtttgaccgttcgtcttattcaaaaaatttaagtaattattaattctttccctatcatttgattcattgttaaatatatttttatgtatacatatagttttatatatttcacaaatttttttgaataagacaaacggtgaaacatgttttaaaaagtcaacgacgtcaaatatttagggacggatggagtaataaacaagattcattaacttctacttctctgttttgcaagtcagcatatatattgggggacctggctgtgttgcttcttagttagcatggtcttattttccagggaatgcgcagaaggattatgcatattttgtatttttgaaataaaagtgtgcatctttgtattaagaagataaggcattaggcatgcatggttggtcagaatggcagagcaagagaaggtgtgcttacagaacaagttgattgccagctctacttgcttgtgttccaagggtgtgctgagatgcaatccgtctgtttgatgtacagaaatacggagtaactctattttatttgatgaacatacctatattgtttcatttgttgcctctagtctcagctcttaattttgtgtaaatctgaagttctgaacatacaaatcatatcaatcatggtgtgtgaaatgtgaatgcagcaggaattagaatgtcatgccatgtccctgttgccaaagtgaaagaatgttatttgcgatttcttttgttcaagggtggtactggacactggtataacaaaaactggataggtattgctcgaggttacaatgaagtaccacaagttggcagaatgaagacagagtctgagataatggtgcgaggttgcaaatgatttcaagtagatcagagaagtaacaatgatatttatgataatatgaaacagagatctgattgctcgtacaaactacaaagaacttgcatcactgctagtttcatcccatcgccgggggatggggttcatacagaataataacaactagtgtggtggcctgtgcaaattacgcggctagcatctttatgttttctctcatataatagcaaatatatttttttattttgttattaaaacaccttaaaataacaatataatttaaattttgtactaacttgaccaaactataaacgtgtaatgttcatattgtgttgtatttccgtgttgtatacatgtgatagttattaattgttttctaatacaggattttagttatttgtaaattgtatttctatatggactctagactactctttcaatattctttattttttaattactagcaaaaatgttcgtgcgttgcaatgggaaaaacagaaaatataatccatttgtccttcgtaagacatattttccatgtcaaaaagccaggtaacttgttcaaaataattcatttcctatctctatatctgccatcaaatacgattttgtagaaaaaaggaacatttttcagtctaatgcatgtttattgtgacctcactgtgctgaatatgatcgagggggggaggagtgcgaacattgagagtatgatagctaggctgcctcgaggcccatacaacatagtacatgggtcaggaaaaaaagaaacaacacaccctcgctccctcagcaccatgtgtattacaatcctttgtgggatggtgggaatcctcacttggactcaatggttgatggatgatagaaacaattcaaatatttttaatgaggtaataaaaaggcacataaacatgtaagaaatgtcatattagcagggatttaagtgtgtcgacccgtaagcccacttataaaccaaattagtgggtaatccatggatcaatccgcgggttatctactaattttgtttataagtggattcatgggttggcccacttattaggcattgaaatattgtattcgtaagttataaccatacatctcacacgataacataacatatgaacactcccaccagagctcatgaatgaaacatcaaaaattattttgaaaagcccgtagtgtgctctcgctgattgatttgtatagtatggtgcacatgacatggtttaccataaggaggcgcattctcttcgattcgtatatggagtggcattgcaaagctttatattgagactagtaaacatgcacgtgcaatgcacgtttcacaatatttatatgttataatatttgtgatattgtaccaaccaaatttatgcatcttgtcaaaacacaaacaaaacaaatataaaaaacaaacaataggaaacaatgataatgtggagaggtggtgccattgtaccaacccactctgagttccattgcctactttcccgtgcggccgtgccatctgcctctgtaatatcttcttaacattcttccacatagaacttgcttctttatgcccacatccatcactacagctagttaacaacttataataatgctgatatagtctcatctctgcatatcaaccatcatacaacagaagtagcacaaatttaggggaaagaaaaaatattaaacaattttttttatttgtcttgtatcgacaaaaaaatgcaatagagtggtgcgaacaaatagctgcttacatattttcatttttcttctagatatttttagaaatgcttctaggtaattaacatccaactgtataacagaaaacataacattgttatcctggaaaatgagttataagaaaacttagatttaatcaaacagaaatagaacaaaagatggtaaaggatggtattccgttcggatgggatgatacctctgaccagtatcaggtgattcctaccagtaccaggtgatacctcagtggtatcatctcatccgaacaggataccgtcctgtagcatttccctgaccttatgagtcccctaattttagtattgtatttcttgattgctgattcatgcatgataatataagaaatcgataccgatcattgccaatcataagcagaactgcattgacgtgcgtcatatagctacaggtactatcatgacacttagattcttattttgcatagtaatgaaagcagacatgaaaaaaccacttatctacagtttgcccaggggcggatccagaaacaaaaaattgggggggaggggggctcaattacgcagtttcttcaacctccagccatctaaggacctttagtttattattcatggtgaaaaaattgaagggaatgctctggggggtatcaatggatcttgtgggtatggggggactcgagtcccccctgcacccacgttggatccgcccctgagtttgcctagactatttaatctagtttagcattgcagacagctattgaagtatttctaacagtaatgactttctcaatctcagatggttcatattgctagagcctacctttcccattatatagcttgctctctctctctctctctctctacatgtaggttcatttgggaatcaactaattacctcatgttaattccctattagttttgcagtacatggagcagcacaagctcagatgatgcacctcagcatcggtacaatagatatatctacaagaccaacttctacaattttgtacaaaattacaagatttttgccattttgactctcagcttatacgacagtctagttttctgtctaaactttcagatatgaaaagatcgcaaattgtatgcctccatctaattggttgattgtaagactggttggacatgccatccaaaatagatagactggttgaatggacttgaaaattacttcaaccatgttgaatggagttgagaattacttcaaccatcttcctgtcatgagatgctcgtgcaatgctctcgatgttcatctatactaatataatgtcgcatgtcatagtatataatgcatgtcaaaacgtgagcatgcactggtcatagatccacaataaatataaaactgagatataagcagtctgtgaacatttatcaattatcagaagattattagaaactaaacaccatgcaaaaatgtgggatgcgacccaatggacaaatctgaggtaaataaaaaagaaaatgagtagagcatgttcaaatccaattaacgggcaatgcaagcccaagtccaaactttgtaaagttaaattcaatttaagaataatttgtatcaatataaaagttgtagaacttatagtgtatttggcgatggataacctagaaaggaataacatatttggaaagagtttccacaaacaccttataaaaacacactaatttgacatacaattttgcaggacagaaaagggaaaattcctaatttggaaatgtgcagtgaatatttacatgcataattgcataccaatataccattcaactttacaaactttacttttgtctctgaaaatggaagattaatgtgtaaattacaagtaaatcagtaaggacaattctataaaagaaaacttggtggaaaagaagtaagcccaaacctttcatggttcaaagaaaaccactgcaattggcatcatgcattaatgctcagtttcattccacgaagaacacctatcactgctacacaagtgatctttaactccggttcgcaactgcctatactcccggttatgcaaccgggagtcccaatccgggactaaagataagtatctttagtcccgggtaaaataatcgggacaaaaatttgatctttagtcccgggactaaagaggagaaaagcgccagtcccggttgccaccttttcttttggtgactgatctgactattattaccaaaaaattgtagcgacataaatctagcaattccgtattttatattaacttgggttcttaataggtaaatttgcaattttcatgtgtctttttttttgggacaatttcgtttttgcccccactttgatctctaatattgattttacccctactttttagggttttcgtttttgccccccactttttttgaaccgaaagaggcatttacccctggtttggatgaaagttagtgggaccgggtttatggcaggaaataaagattttttgaattagtgatctacctttttacccctgtgaaagagctatctctcatctcctctcgctgcacagtcaaaccttcctgattatgttgtcatgctttgtgatacttgtgaggtacaatatgacttcatatgattgtgtaaaatgttgttgaaattttgtcaaaatttttgttcgatttctgtcaaaatgctgccgagattttgtcaaaattccatcaaattcaaattttgtccaaattgtaatgttaaaatctatccaaatctgtcatttaattttaaacatattcacaaaaataaatttccaaacattgcataatggggaaaaaacacaattaatgaatagttatgggagagggtataaatgtcctatttaacaccgttaactcctccatctaaaaaaggggcaaaagtatctttcggttcaaaaaaagtgggggcaaaaacaaaaaccctaaaaaatatgggtaaaatcaatattagagattaaagtgggggcaaaaacaaaattgcccccttttttttctctctacacgctttgcctgtttggcaatctgccagcgacaaattcgcgcgattcttccggagaccgttgaaactgactctctctctctctctctctctctctctctctctctgcttccaacctgaaacgggggagaggaacattttgccgagacgaaaacgccatacccaatctcgaacctgatcatgcatctcgtgctcgtgaaccagtcccttgattgggattagatctataggtcatacatttcatttcaaaggaagggaaggtatgatttctaactctgaatttaattttgcttgttcttactgttcttctctctgcgaaaaggggaattttctgtcgatcggaattggtcatctttggttggttcaggacgatggcaacgaacagttcagactcccggaggctcttattattattattattattattattattattattattattattattattattattattattattattattattattatgatttattgaatgagccaacagcttccaattctgctgtgtgaattgtcctaccccggtatgttcttaatacatcggtaaaactttcttcttaatccaacaattggtctgcatgtaactgtagtaaagaaagagtgattatctcaccatttgacttaccaagcctcagtatgcagtacactttggcctttaacattcagttagctagcagtcattacatatgaaatcgcataaaaagttttgcagaaattaggccacatgtttactgattgctgctagttttgcagatggacaagatcaatgggacgaacccggagtctaccgatcaagtgagtaatcatagtcattgcgagtagtgcattcagtatggattctccactggcaatatgattgcatcttttcttgacaaacttctcttttggttgctccatacttattcactggatttgtttctactgatttttcctatagaacaggccccttcattggctagtagacccgacgagttcgaggaggaggaatctcttgttacaccagatgcattgtctgctagaattggtggtttccaaatatatgcaggatctgtgaattggggggttttcggcagcatgaagattgtgtttctcaagtccaagctcaatgtgttgataccatgtggatttttagcaatttttctcaattacatgacccaaagatatgtaggcacaccaaattttcatctaacaattactttgttgattctttcctttgttttttttttcttttcttgaaaagaagcaaaagctttgccacgtatatattggatgctttcctttgcaacgttgtgctcttgtattgatattactgacttatctcttttcaagggttgggtatttcctctaagcatgctgggtattattcctttggctgagcgattgggttttgccaccgagtaattgttacaaactcaccttttattctctgaatcttttatctttcaataaacatctgatactttgtttctcattgcaggcaactggcacttttcactgggccaaaaggtttagctaagtttctcttcttctgacatattcttatctgaattgtattcacatgatcatgtgccagttgcattgtcgttgacttggcaaatttcatgtgaagttgggcgtcttctaaattctgcatttggcaatgcaaccgagttgatcatatcaatacatgcactaagtagaggaaaactacacgttgttcaacaatgtctgctaggatcaatcctgtcaaacttgcttcttgttcttggttcagcattcttcagtggtggacttgcttgcggcaaaaccatgcagacctttagcaaggtgaccattcttcattatttttacaagatttcatgatgaagaagaaataccggttaatctcggttgtcggcaggcagatgcagtagtgaactccggattgcttttgatggcagtgatggggttgctcattcccgctgcgctgcattatactcattcagaagctcaattcggcaagtcagaactagcgttgtcgaggttcagcagctgcattatgctcgttgcttatgcatcctacctttactttcagttgtcaaacaatcggcgtcgcaatgaagctaatgtggtaagtctgatgatctgatgggttaccatatacgattatagatattgcaattgtgttagatttcttgccctattgtttgtttcgtttctttgcaattttctgaagtatccgtgtatgcctttaatcaagagacgaattcaggatgatgtggatggcaatgatgatgaagttcctgagatctccaaacgggaagccatttcctggattgcaattttcattgcttggatatcaatgctctcttactacttggttgatgcaatagatgtaatagctcttctccatccttcttttactttgttttggtgcttgttgtttttgtctgcagtttaacaagaatatacatctttgtaatggaaactctttgtgatttgtgttgattaatcttacaagctcttttttttttgccggatcattaaatttttcaaattttacagggggcttccaaagcttggaacataccagttgcattcatcagtgttgttttgctcccagtggtggggaattcagcaggacatgctaatgctgtcatgtttgcagtgaaagacaaattagtaagcaccagcttgcaattggcaacaatcttgaataacattttatttacactaaaaatgtaaacttctatttttgtttttttatgtttttgtacaggacatttctcttggagtggcaataggatcatcgatacagatatccatgtttggggtgggttgtcttttgcctatcagattggactatgcttactagctgtcaagatctgatcatcaaaagctgatttttgcttacctcattttgtagataccattttgtgtagtgatgggatggatgatgggcaagccaatggacctaaacttccatctctttgagacggcaagcctcttaacaactgtactggttgttgcatttttgttgcaggtaataaaatcattgtgcaaagagagcattcttttaaaacaaaatgagtttgatttcacatgattttaaaacgttcttttaaatcacacactttcaggatgggacttcaaattgtgtgaaaggattgatgctatttctctgttatctgatagtagctgccagtttttatgtacatgctgatccaaattccaagggtaagtttatcgaatctgagatttgtttagcataaactcgctatcaatagagaaataagaaagtttaatttggacattttttataatccattaacactgggaattttgtccagcaagtgagaagcctccacaaaactaacaatacctggaatatcaggtggactatgcacaagatctctagtgtgtgaacacatttgcagtcagaacaggaactaattgtgttatttttaactgaatttcaagtgcttcagtcctcacatttagaggtctttcaagcacatctagtcttgtagataagcagaaactgaggagaagctcaaacatgatcattcagttgtgtaggcagcagttaccttgctattgtactggcagagatagcacaaagaaaaaacatttgtaaatttgggataagtattcatattatggtaatcagatttacagagtgaaataaagtatacagggaaccaatggcaccatctctttactggctccattttcatctgagttagtaatatatacaaaaaaaaagtcttcaaaaaagtataccataaaatcgcaaagaccaatttctgcactaactcatggaggcacatcagaataaaacaaacatacaagtccaagcactatattgtaaaaggttgcgaccatgattattcgtcatgcaccatttcaagatcagcctgaggctttgtctttttattatcaacttttgaatggcattctgcatcagtatctgtaattctacactttgacaaaggtgctgaagaggtttctgctttgtcctcggttttctccatcggtgcgaattcaggagattctccttctgttgtactagtcattgaggatatggattctcttgctttctgttgttcttccaatatcttctgcaaatatcttgcgtgttcctctatgcgcagctgtaattgcctttgtacctgatgaccaagaaagatgttaacactgcaagtttatctaaatatataatattcaggtaagcatgctttgatgaacaataatgtgtaaatttccttaatacaaaggtgcgcaatccttttgcgtattcccgaaaaaataatgtgtaaattgctccaaaaagaatactgtgtaaatactaagtcttgtaaccataatctggaatcagggctgctgcaaacatatgaacatacagtgtcaccttaattagccttcaaaatactgccctgacatgtctgatgcttacctctagttgttcatggagttgtttctggacctccatttgcatccgaagagcttctgccatttgagcactcctaattaagaaacagaaaacagtatgaagttttacagtttatgcatgcagacagcaggatatgttcaatgttaggcagtaagtcattgaaaggaagggagatgctcacttcttttttgcatgatcatttccattagccactgattttgttttcttttcttcttgcttcttgtctagatcgagcatgcatcagaaccaatagttaataattaccgacaaagctaattatttcatatttcctaagatatttaaacttcctctttggcttaattgccttaccttcttttgtctctggaagatacttcgcaagccgatacttctgcattgtgacaagtagtgttttaaccattataaataatgattttatatgaaataatttgactatggatcaaaaaaaattcactaaagcacctgtaagtggctctttatatgatagatggtcaagccctctaccttcataagcttcagaacacccttgggagttgcctctacaagatgtatcaaatagaacataaaaggatggttttattttctcaagatcaaattcctctcaatgaactagagtgatcaccctactttctggcccttcaagcttgttcacggcatctacgaaacgctcgtggagctccggtgtccacctcagtcttggtttgttacatgatgcagttccagatgaagaccgagatgaactcaactgaactttagcaggagatcttgcatcctgcagatcctcctgatcagagcaagatgacactggaagagacataagttgcggtggtctgtcgtatatgtcctaaggaacaagaaaataagtgattaaaatgcaaatcaagccatgataaatattcacaagtgaacattgaaaaaaccttttgcaagtagtaattgatacccattaaattagaggataaataaacatataatttagtacaaaaatatcaatgatgaagctaaggaactcacatctaaccgaggactctcctcattgtttgagatcgcaattccgagctgttcagacaagaactgaaactccatctgctcattataagccatggcactgcatttcccatggaagctacaatctgaagagaggttaagaaagtccttgaggtcatctgtgtgttcatcatcagcatgaccactatttctgagatcagcatcaaggagcatcagagagctggatgattgcccagctgaattctgctgctgctcacatttaggaggttgtggcaggaaaggcaaataaccggtttttcggcatgaaccagagttcatcggtgatgaggtgtacagacttgtacaaaatgtagaagaactagacaaaattgggtccgaaaactcggcttgcgacatgcgagaaagtgaactttcaccatttgagtcagtactaaatggaaggatctttggcaggctagatgaactgattgattcggtcttaatgtttgaggattggatagcacatgataatgaggtactatttgttgaaccacagagatcatagtcatagttagcgttggagagcacatgagctgatggctgtggaacagtgtatgcttgtgcgattttgtcagggccactgaattgctttacagcaatgacactctgtgtgctcatggctccttgagattgttgatttcttggtcattcacacctaatatgagaactgagatggaatgcttgctccaagcctgcactacaaaagtaaatatccagtcaatagcactgaaaaattgaagccttatcagagcatgtagtccaaaatgtgtgtgttttttttttgtcataaatagattgaaattttgttaagaaatatgggtacagaagctcaatcttgtcgattgggcttggcttctatcagaaagataacttggagacaaaagaagagataaaaccatgctaacttaaactaatatgctgaatatagtaaaattctggacaaaacaagatggacaaatgatttgaacctttcaacaatctaacagcagccaacctttaagtgacaagaaaagtcttgtctatacatcagagcacacatcaaactttcctattcagaagccaaactcaaatcaaatttaagaaaaatagaaacatatacaagccacctatgaaaatattgtatggtttgaggtaaaatcacatcaattaaggtcatggcattctcttttcctcagaaagagttgcgcacttcaaaagaaaatcatgacaattccaaccgatgcccgggaagaaaagcagaaaggggaagaacagaaatctgaaagagagcaaaaggagataggcagctgtcgccagagtaagcacacaaataaactaaaaaacgcaactgcaccatgagaattgagaaatgagaacaagacaacctaggactgcaaatccaagaaagaacgaagccaagaaggcgtgaatccaggtaagaaaatgcaaacaagatggaagattcaactccatctgataatcaagaagatgagttgaagagattcagaaacaagaacctgtcagtcctctccttccacagcaagcaccctctctcctctcttctcctatccaaactgtcctctctcgctccctctctctctctctctaaattactcctgcctgcaaatgattagtcatttctgtgaaccaccttggatggatagttgattgttttgactgttctcgtttcactctgaaagagtctgaagtagtagtagaagatacaagcacgctgttgctttctgttgcttttgtgctactgtgcttttgcacaaaatgctgcagtgtctcaacacctgcaatctgcagcaaaatggatgcctaattctgaagaaactcaagcaagttttgtcaaagtctgatgcttttacaaatccctcaatttatgttcacattttgttttaataatcaaccgcacgaatatttttcttgtaagctaagtcctcctatcctatgtggtggtagcagaattgattattgtaatttgtaaatcacagctaagctgtgacgaataggaaagcaaaaacttgctgacctgattcagattagcctagcgtaaatgccaaagcaaaacgaagccgtcgcttgcgtgacgggttgaccaaataattaaactgtgtgatgccgtcaaattaattaagatttcaagccatctatagtcctgcacccccgtcccaaaataaattcgtttctggttttttttccaacgtttaaccgtccgttttatttaaaaaagtttataaaaaataagtcacacataaaatattattcatattttatcatctaataacaataaaaatattcatgaaaaaaatcaaagacgagcggtcaagcgttggagacagaaatttataaatgaacttattttggaaagggtgtactgtactagctagtgcgtgtgcttgagttaatcatgggtagggtaagcttaatcatgtgagttcttaaaaaaaaaaagcttaatcatgtggattttccttcctagaccacaaatcactaaaacttcaaacatacaaaatgaagggttttgaaaaactccacggaatcaaactgttttgtactatgaaattggtgtgttcaaatttgcaaaatgaaactttcattaggggaaaaatcagaagaaattggtgtgttccaaaaggagtcggaagaaaataaaattccattaggggaaaaaaatcagcctgcatgcagaaatagtttccaactttccatgtgagttcgttttgtgttccggtggaccccacccattggtcccagccttccaggacactgattggtccacgtagatccactagacgacaaaactgatgctgctctgttctctaaattgtttctcgtaaagaaagaccgtagatgtacgcgtataacgacatctgaaaactgggtatgatagtgaaattatttactggtttgaacgaaattaacactacaaattaataatcagtttaccattatattaaattatttactgagtattccattatattacacatattctaaggctacgttcgttcattcgggttcatttgggttaggataaccatcactcccaacacgttaaacggagtgatatattaacacataattaattaaatattagctaaaacaactagaaaaataaataaatatgatttttttaaagcagcttttctatgaaaaaattaaaaaatatatattatttaatagtttgagaaggcagaaaacgatagagcataagttaggaaagtgttcaaaagaatgtagcctaaatcgtcgtgccttgtcaatttgagttgggaatgaggagggattactacttgttttcataaacacatgtctcgatcatatctagcataattaaatagtcatctatggaaaagctaattgcgggataattaagttaataattagcgagtggtcgagagattgccatggaggattagaccagtaactgagcttccgttgcctaaccaaatttgccactgactggatatcttaaactcttttgaagatctcacgcatgtctgtccaaatctatatctatctgtccaattaatcccaggaaaactaacaggtgtctgcctctcatgagatgcccatccaaattgagttccacacttgctgcaaactgcaaagtagtcctaggagtgtaagcatatgatgtaatcgtagaattcctgattcaatcatgctcggagtagtaaaacacggctgtggctgtgtttagttcgtttgtccaaattttattgaagtatacgcacacatatttaaaagtattaaacgtagactaataataaaataaattacagattccacctgtaaactgctagacgaatctagtaagcctaattaatctatcattagcaaatgtttactatagcaccatattatcaaatcatgacgtaattaggctcaaaagattcgtctcgtgatttacacgcaaactgtgcaattgattttttttcatccacatttagtgctccatgcatgtgtccaaacatttggtgtgacggaaaagttgtaagtttgaaaaaaaaaatgaatctaaacacggcatgtgttcttccccttctttaccaactcatctttctctttttccacgtacaccttttttaaactgctaaataatatattttttgcaaaacttttctacaaaatagtagctttaaaaaatcttattaatctatttttaaaaattattaatacttaattaattatacgttaatgaatcgttccattttacgtgcacgagagattccgaacagtctaagaagtctagaatggtttagatgtcatggagcaatatattagattatagagtaaacaaaaatgccacttatttgattaaggaccaaagatgtaaaatgtgccactcgtgttttgatggtgacactttgattgaattgagatatggaagaactgagcttgcaaagcatggataaggacaaaagcaacgataaggtgtgccaattccaaccaaggttttcttcttttctcatgttacatcatgatatccagtgtgcagtttccataaacctgctcttataaaaatataaaaattcaccctttaatttcaagcctagtagttcctaattatatactccctccggttctatattaattgacgttttgaacatgattaaggtcaaacttttataactttgaccatcaataactttaaaaatatttattttaaagaaactagaacaacatatataaatttatcttttaaagcactataataaaagtaaacatgcatttatttattgtatatattataatagaaaaataaggtcaaagatatatcttgtagaccgtgttattgtccaaaacgttaattaaaatgaaaatagagggagtagcaaattttctctacctgttatgtcagggctaaattaggacctcttccacgttggcccattaaaactttgggccatgttgacaatccaaataagctcatcagaatttggctcccaaataatgctacaacaaaattctatcaacgccagttaagccggcctatctcaatgtgatccatcgtataacattcgtgaaaaagcagacaggataatattttgtttttttgacagttcataacttcatattcatctggacgaccggagtttacaacaaagtgtctacaacatacagtcgcagttacatgcgatcggatattgcgaaaaatatgggaccttaagtgatctaacaaggcatgaatatcaaactcagatgatcattctgctgccgttacaacgttacatgattcgacgctaatattgggaaagcagggcaattacttgccttgctgatgctgccggtttgatggcattttctgttacctatccttgagctcttcttcgaatgcgcgcagtttctcccggataggtgaaaggaaggacttgaggtccttgcaaatctgcctcttgtcgtcggatgcgaggcccttgtcatcggtaaaccttacttctacctgaaaccggatggcagaagaaaaggatttgccattaccgacctgacttgtcttgattataatggtatgaaattcgtacagaatagtagctttacctccaagtcctccagctcaccgaaagaaaactcaggaatgtccagatggcctttgaccttcatcttttcttctttaattaaccattcacctaataaacattaaaagcgttagtaaacactccacaaagaatgaaggagaaactagctgagtgatgtcaattctgaaacttcatcgaagttacccttaaatttcaagcttagttcataggtataccctactctcttcttattacgaacggtgactagaaaggcctgccaatatcaaaggatatattcacatattaaactagcacaataaagagcaaacaaacagaaaatggccatctaaccatcacaagtaattgtacaaatttatgtatcaatagccaggtaaaagaatagcacttacatcaccaatgcatttagacactccatcaagagatgccttccctgtagggaattctagcgaatctaaagaacccaacatttcctgttgtgcagattagacagcattatcagagaatttctaaggctggaatgaggaatcaccaacatgttcttataggtactataagactttctagcattgcccatattcatatagaagttaatgaatctagacatatatatatgcctagattcattaacatctatataaatgtaggcaatgctagaaagtcttacattgtgaaacagaggaagtagtatttaagtacttcgccaacagtttgccagcaaactactgtacctttatcctactgttagcccatgaattgaggttcttttcctcccaggttccagcctgcagaagtgcagacaacacatcagaaccctataacatagaaaatgaagagtgctgcagtatagctactgctgcaacataccaacaactatagcgtcaaacaaaaacggcaagcttcaacataaactaaaagggaaaattgcctaaaatggcatgattcataacatgtcatggttagtgacccaaacaaatatatgcgatggacgtttagctatgccttgtgaagcctaaggtacgaagttacatttcttcttaacgtctatccacatcaatgtttattatgtgtctctagttacattgaacaaaattaaatttcatgagaacagaggtcccacctacaggtaataaaatctattttgcaggaaaaaagatcaatttacaccaaatcaataggaatcaaaagcacagtattgtcctgccagctgaaagtttcaaatcttttaaaccctgtttttgttattcttctattactctacctaccaaatgtttcctccaattcccacagggtgaattaagaccatggtcacagcaattgtttttgaagctcatagtacatcaaaacccattcaacctaaacaaaacatatgatatcatagaggaggataatgcagtccgcaagaggaaaccgggcgatgcgatagtgctaggagcgttggatatctcatgcaaactaagcaaaaaattccacctaaataaactccaccacctattggaaacgtatcaaatcaatcaaagagaaacgatgagcatccacgattccaattcagcattgcacccccaatgtattcaaatagtctccgcgaacaagactatgccgaacgaactagtagtgattgagagtaacaataatatcaaactccgatgaaatgcgagttcgttcgtgctagagatgggatatctatcatatcatatcatcagctcattccacgacatgaacaattgattgcaagtttgccacaacatatgtaacagtagtagcaacgtccattcccccaagtccgaatctgacaagaagatgagaggaggagggggaccccctcacctgattccacacggagccgagcggcggcgggttgccgttcccgttggcggcggcggcggcggtcgcgtcgagcttgcgggggacgggcagcggcgcggcgtccccggtggcctcccgcacccagtacctatacgacgacgccttctccgccgcggccgccgccgtcgcggtctcctccatcagcggggacaaatcagccgtttgctgcagatctcaggcgaaaggggggagatgagatcgatcgatcgatcgattcaaatcgcgttcctgcggttcggggaggaggagaggaggggcgggatttgtgcgcgttcgtactatcgtgcgcttcaatcttggctgcccctctctctctctctccagatcgatgcttccggaagtttccaggcagttactactggggcaagtggagtactactgctaggtgctagctactggaagcttcgggttctttctccggagttggccttcgagaaagagacagacgtggctgttctgtttgactttgacttcgagtttgaaacaaaaaggcaaaaaaatacattggtttttcatgttcaagaagtttaatattaaatttatgtgtatattataattttgatcacgtttaaatgatttggggtacaaatcgacggtcaaggatgtggttaggtccaaaatgacatgtccaaaggttttaggcttttgaaatttcatgtggttctagtagtataaattttggagtaaataattgaattctcacaagaaacgggaaccttttttatccgtcatttctggaaatcatctctctcgtttttcacacgcacactttttaaattattaaatagtgtgtttttgaaaaaaatatacaaaagtatctttaaaaaatcatatcaatctattttttgtagagaaggtaaaacttaattaattatgtgtctttttgcgtgccacaaattcacccttttgcatgccttagccagtcactgaatttgtttgctatcttttttttatatcataataatgtcattttcaattatacctttttttcaaagttgctgacgatgtgtctacatttagtttttttttttgacaactttgataaatacataagaaatcctaccaaaattttgctaatattaccaacttacttattttatctacaatctaaacagcccctctgtcttactcatgactatgcaccacaagtaccaaaagcattgtaaagaaaaaactggaaattgtggaattcaactccaaacaaatctagctcatgaaagatgagagcaaggtcaataatatagcctactgttggctccaaaaaaatacccatatcatctataataagcagtgtagctaatgtatatataatagaaatactataacacgaatattttattgattcgtggaacccaccatcttctcatacctcacattctctttctccttctatcccctcacaggtcatgtcttcttcttctatcccctcacaggtcatgtcttcttctcctattccctcgattcctgtcaccgacaacgaaagacagcggcggcggacacaggagatggcagcggctaggccgtgcaattgaggtggaagatggcgacggccgggcagcatggcggaggcagaaaacaacagcggctgtgcggcgggcgacgggggcaacggcagccgggtcgcaaggctaaggcggaagatggcggcgaccgtgcggcgggcgatggggggcagcggcggctaggccgcacaattgaggcggaagacggcggcagttgtacgacgggcgacgagggtagcggcgaccgggtcgcgtggctgatgcggaagacggtggcagccaggccgcgcggcggaggcaaaagacggcggtggttgtgcggcgagcgaccggggtagcgacggctcatgcgaaagacggtggtgaccgtgcggcggacgtcggaagacagcggcggccatacggcaggcaacaagggcagcggcggcagttagcgacggaggcaggcaacatcgcagcgaaaggcatggctgatgcgggagttggcgaggagaagaggccgcgcaaggcaggccccacagtctcctcgagcggcgcgtgcagcccgacaacaaattagtcaccagcttactctctctctcttcccctttctcctacagatcatcacaaaatcctacatggaactactaccgccaattattgtacctgctctgatgttacacatcaacccatcaagatatatcatttgttttttactgggttgctctggtcctgtgcatccaagatgcgtttcttccactgtcagttatcacttgctttaaggctgaagaatcaatctcccacgcagcatatctgataaagagtcactccacacaagaaaccatacaatggaatctgttctctcctctctttcaaaagacaacaaaaagaatccctaaaaagaaaatcggaacaaaacaaaactggcttcatggctttacttataggccgacccaatatgatcgaccattgctgttatggattggtgatggagaaggtgccgtcacagcccactcgtaccacacctgtagcaatgcgggagatgagatttcaggtaaggggtattcaaacatctcataatcaaaagcagtgcgataaaccacaatacctttgttgcaccgcagcatcgccaaaagtgcacttctataggcgtcttcgacggtacgtagatgggctttctcaatgggaagaagatcgggaacctgatgagatacataaaagataatattgaaggcactattcaagaacagttattgccagcacataaaaatcaggttttgccatttagtgtaccagctaaacatgtttggtgtagccgtgtttggttcaattccaagatgaacatctttatacaatacggcatcaaaatatccagcaaatcctgccaaaatgatgggaatgagtagagtcaaattctgccaaatatatagatgtttctaccttgtaacatagcaaagtataatcacaagtataactcaatagctacataccgtgcacgaggcatgatcccgtctcttgtggtatctcaaatttcaacttggtatacctttggttactagcatttggtgagggatttggatgatcaaaagtaaaaacctacatgttttaaaatggtgataatcaaatgaaatagttctttggaaaagataacatatcacaaaatgtgataggatacactattgatgagggataaatacagcagaaactgtggtcgctcaccgattgtgttggtgcaagtcttgctattcggtgtagtttgacaacatatgcagtttcaaaatgtgcaatatctttatgtgctttgatctgtataaaccaattcacttcaaactccataaatatcttacggttatcattgatatagtagaggcacttacatcgttgtgtagttttgatgctgttataggttcaataaagctagtgtatctgcaaaggaacataagttatcaaatgatataagaacaaaaggatatctgggatttaattgatccaagaaagatgaaaatatagactaaggacagaaaaggtcagtacgatgaaggaatagaaatcccatctggcttcaagaatctctgagcaccatctagacactcgggagaaagttcattatcaccaaaggaaccaagcaactcactgacctgtaccatatttgcatataagccattgatttaaccactttgaaaagatatgaaatgtccatttatagcagggatcaacataccaaaatatctgctttctcaggggcttcccagcaccgcatgtcacttgaaattatagtaaccaagctttcccatccttccaatttgatcaaactctgtttcaccgccccaaagcacatcagatagtcatcatgtaatcatatttgcacacgtacaggataaacaggagaaaaacccgactatcaacaaaacataaggacaaaggattgcaacaatgattacactgacaagctttccacatccaatcaactatctgagaacgaaaatgacaaatgctgtattcgttgaataactcacgtgaagggtgataacagcattaggatttttctcgacggcgtatacttttagcttgcggccagtttcctcagcagcctgcattgaatatgaaagcatattcagatagtgaagcatgtatacggaaaaaaaatggcatgcattgcaattgcattatttaagcacaagaacattcgtcaagatttttagtgagttcagaagcttcattagaaaaggtagccacctgtaacgacgctctcactagtggcccccggcctgctccaacaaccatcagcacctttatggaacagtaaatgaagttaaatcatagaattctaaaggtaagataataagaaaatagagtaacaagtaacaataggcaatacagaaacaagacatgatttggcgaggaagataaaatatggcaggtccaatcttactgtttttgttgttgagacatcatcatcggaaactctatcaaccaatgccttagcaattgctctttgatactgttcatatgatgaaaaacagaaaaacattaatacagccaacactggtattagagtttatgttgaacaggaaaaaaattaaggggaacccaagtaccccccccccccaaacacacacacatgcacacacacacacacacacacacgcacgcacaaaaaaaaaaaagaacgagttttacccacactcatgtctctaggtagcattgcctctaattcatagttaaatcattgccgggaaaccacgataagcacggagtctagttactatcagtgtgatccagtgcagatgcatacagccccatgactggtgctggcctacacagataacggggctacaagcatactgcgactactatttctgtgtcatgacaaaccagcactttgctgatcttaaggacagagtcaagtctcaagacctgcaagctagtatgaatggaacatgcctgcattgtggtttctttgctcaagataacctggggaaacccaagatggcttataccatgcagacaggggaaaatgtcaagtgatgtggtggacctagctgtaaattatttctatggccatattggcaaaaaaaaaaaaaaacggtctttggagatgcaccggaacaattacagcctttaaagtgtcatttttttcttagtggcaatgtttggaatgggaattgctcgattttctctaaaaaaaaatgagaagcgataatcagaatgcccgattcgaaagataaatttgctgtcgctttaaattagtgattttcacagtaacatttaaagatattcaaaacatctagcagaaacctgggtatatttcacggtatctttctcaaaagtctcgtatgtctgagcttccaaattgtccattagaggctgcaagaaaatgtaatgttgtgaggaaagattaaaacaaaatgatgaggggaggagaaagaagggggggctacagaataggaattacctggagaggagattgcagaaaatccctataattgatctgaataaagcaaataaattcaaggtcaagaaagctctcgcttaaatgaatcagctcatgggccaaatcagagagatagtctgataaactaaatacctcaaagcgttcctgttcaggaagtgggtccatcctctgatatatgtaagcaatgtagtcaaggtatgggctcaatgcatgccgaacagcagtatctaaaacaacagtttaggcaacagataagtcatgtgctaaagaaaaaatatacattttgcagtgcgcctcagaaattcaagcagctaatttcatttcaagtcctgacttttgctctctgaatttgtttcaaagttaagtttgtagagcaccactattacttaaaacatattgaaaagaaattttcagttcatgtataaatccagttcatgtgtggttgaaatacataacaaaaccaataaattataaatctcaaattttgcaagaattaccttcagtgtggttttcatcacctgagagcactcctccttgggatacgttatgatttgatctcccagatattataacctaaagaaaaacagagggtgaaaaatccgagagaaaaggtacagtaagatgccctttgaaatttggaatggaaatggaggcaccctgtgcattgggttcttagcagaaaagataagagaggaaaggcttgatagaaggaagcacaaggaacacacctgaaccgaatggttaaaaaatccagtaagcagcttctggtggcgctttgacaggcaaggataacctctggcatttgtcagaaaagcctgggagacgaaaaatcgtttagtgatcagaaccatgaagggttattcttatctccaaagaaaggagatcgcatgtcatctttaattgaataagtagtacagttacatttgtttgaagaattgcagctcttacaggctccccaaaccaccgccctagtgaattcatagatggcagtgtgctcctgataagtgaatagccaacctttgtaatgaaaaccaaaactataacatgatagatttattatcagtgacatcttcacttggaagaaagcacttggtgcaacaatgcaagaacatcacttacaaaacatcaagcgccacacacagttgactgctatgctcacataatagtctaaatgaattccaccattcccaagagtctacggtatcactctgcaatttaaaagggcactcaagagtgagatttaccccgcacatgcagatatataacagtctgctgcttaacagtccaggccagtctagaattatcagaaatttaccatgtcgctattatcttttgctccatcatggtcttcatccataggttcagacttctccagaggtatcctaagccacaacttaagaaagagacagaacaaacaaaagctaaatgttcatcaaattgaaacatttatgacatgcacaatacacaacatatgtaattgaaaatggaggaagatacctgcaaattggtcaggccttgcaaaatatgattcacaactctagcatagttggcacaagaagatctcttgggaggaggaagaacgcacgcctgaaagaaaatgcatgcaatttctaggattcagaccatgttttcaagaatgcatatgggtcagtctagctcccaaacacgccaagtaaggaaatcttatactccctccgtttcacaatgtaagtcattctagcatttcccacattcatattgatgctaatgaatctaaacatgtatatctatctagattcattagcatcaatacgaatgtgggaaatgctagaatgacttacattgtgaaacagaggaagtaggaattattctagtttctagttatggacttcggaagcataactaatttacacactgacaagcttgaaaatatgcataaatggtggagaactcttatacatgacaatcgcccatcaacactatcaaaattatctctagcacttcctggttgcaaaattgcaaaagtgatgaactctccagagcgatttccttgatgcgcaattagaaactcccattaaacatttaataattttgtgaaattcactgaatccaacggacctgcaacgagagatgagacgcccacgcaatctcctgcttcagagtgatctcggagtccaaccggagttgctcgtcctccgcatccaaatcaatccactcactgatcttcccgacgatgtggctgctccactgggccgggccgaggacgaggtccgacgccgccacggggaggacggacccgggcgtcggccggtagtcgggatcaacctgcagcagcgccaccaccaccaagtgagctagtagtctcagagaggaggcggaatcgagtaagggcggaggcgctagtggagtagtactcacgaggggggcgaggaggaagtcgaaggaggaggagagggagtgggagaggacggcggggagctcctcgccggcggggaagtcgagcacctccaccccgcagtagcgggactcgctcttgtcccccgcgcgttgccccagcggcatctccggttgccttcttctcctcctcctcgctggtactagtcgccgacctccgccgctgacgccgccgccgccgccggggatgggcaggaagacgcgttggctggggttagggtttagggcttttggtcggcggaggaggggaatttagggcttcagcctctctctcccttcaaatattattcaagcaaaattatttatgtttcctattcaaatattcaagtggagaattatttattgacatttgtaaatttgctactgttttttttaattttgtaaggataccatcgaatgatcgttctagtggtaattttacatatttctagtggtagttttacaataacgatttaaacaagtggcaaatttgcaattgttgtaattatggatgtttcagtgtttcccttgcaagttaagcaaaataaaaaagttgcttctatccattacttagttatcttgtataaatctttttagtatttattgtagtgatttcagtacttcgaatatattcgaccaatcgttttggtagatttgtaataaactactcactttggttataaatgttatgacaacatttggttaaaatttaaaactttgatcaacatttttatattatattaagtttataaaatctatgatattttaatagtgcttttcaaggtaaatatgggtataccgtattttttctctaacccacacattcaagatattattgatggttgaagtgttagaggtccgacaaaatcttgtcctagatatttgatgttttggggtaagatttgttcagacttttaaaactttgataatcaattatttctcaaatgaaaatgtatgcacaaatactagtcttgccttggaaaataccatcccatgatattgtaaacttattctaatataagattgattaaaagagttttaaaaccaaatcttgtcataaatatcaaatatttatgattgaaggaagtatttgagtgctttgtggcatttcatggagatgctaattgtaagtactttcgaaactttagaaagaaaataaaactagctactccaatcaccaaaggcaaccaaaactatttttaaaatggaatatttgcattatgcaataacttacattgtacgagccattgtgaaagaaataacatatttaaaagaatatgccctgtgaggttttattataactagataatacaaaatacattattagagaggggcaagatgcatttcccctaacacgctaaagaaggcgacatttgaatctggtgagttcataaccattaagctcataaaccaagtgtgctcactaatgtaccagataagagtattaaaattcacctatcttccatttttatgtgtgctctagtaacctcgttttgccgtggacaaaagacacaaagtgatatttgaaaatatactggaaaaaatatactactgccgcatatcaaagaagcaaactcgtggcaacgcacgagctcgtggggttgcgcagcgagcttgctgcctaatcctgaattaatgattaataattgctaactaaagaaatactccctccttcccaaattgatcatcccactagcaaaaaccaaaaatgccatattaatcatcacatagagctagtgccattggtaatctcgctgacgcctcctcgtaacgcatgcatgcatgtatggaattaatgcgtgtaggcaacgaaactggccttccttaaaatgcctatgaagtgtggactacttcacaccgagcgcattggcaagatcctgaatggttgtgcgatctctcaaaggcacgtctctgatagattccatatctatttgtactcttttgcaaccacaacttgtgagcaacttgtttatcacaccttctatcccaccataatcctgtccactgcgtcatacttgctgcacagctctaactggcaaatcaaaattcaatgcaactgccttggtaactccacgttgcagcacaagaggatctgtctttgccaacaattgtagatagatggcgatcttcaaatcatccgggtagtatctccatttcttcacacttggacctgcacaaatcaaagcagattaataacctacaaattaaatgactattgaaaatcaaatctagagtcaatattcaaaactagaggtaaatttcagaattatagataaaatacataactaggggttaaattgaggactagagtcaaaattcaaaactagaggtagatttcagaaatatagataaatatcagaactagagcttaatttgagaactacagacaaaattcaggacaagagcttacattgagaacgaagtcaaaattcagaacaagagctgaatttcagaactacagacgaaattcaaaactggagcttaaaatagagaactagagcttactgtacaaatactagccataattaagtactgatgttaaacatcatgctttgtacaaatactcaagtgtttcagaacttaaagcaaccttaaatttgtaaccgttgtagcaatcaggcaatagattgggtactgatttcaattaaattatgagcaactaactactgaaaaatgccaattagagttacaatgtagaaatgacttcatattttcgtgttttaggaggaaattcagaactataagaccatttaccgttctcatcaactttgaaaccagaagaattagattatcacattctcataaatacatagatttaccaacatcacatattgttatcacattcttttgctagaaaaaatgtgggaagtgttatcaatatgatattatcatgtataacaatgattgataaagaagaaagtagagtattatacttcatattaatttttttgatttttttaaacaagaaaaacaaaatagtcccaccaaagtacttttttttttccttcaaaagaaccttttaggcattctgccaatcctttgttacactacagtgttttttctgtcatggcaaggttgccctcctgatcttgagaatcaagggtcgaatgtttatttttaaaaagtttagaaaagtagtactgtgctgatggttccaacttaaaataaacatcatgatatcttttctttagtactagtatcacctgagagtgtttttttcctttggttacttggatactccacaaatcgaactttggtccaacctctattcaaagctccaaccaccgatccaacgtcacacaaccttccaggctatcagctgcactgttccttcagcctggggcctcatctcagtgtgatgctgctgacgtgtagccaatgaggcaaaggcaccttctgcgattccgtacctgacaccttaacagattattgtcacatcgatgcaccatgctgtcctcattagtttaactttctccattcgctggttctcccctaattttgcttgttcaaggagattaccacaaccaatgcatttgtacaagtattttaagcatctctctcaagttctccatgataactgtaacaaaaagcaattaaagaaacaaacaaaaacagacagaagcagcagcaacaagaaaagaccagcactagtagcagattaccaataccaaggcgtttgagcgtctcagagtggagtagtggggaatatcagagtagtagcctttttatgctttgcttttcttttggccttttaatctcagcccctctgctcaacagtactagatgtatcttggattggcatgtatggtgaggaatctttctagtaccttttttttttgagctgaaaaacctcagttactaccactctgtgtgctaatcactgttatggagcatatatcctctcttcagcttgcagctcaagagtgtgagagtgttgtctaggtgatcatcttctcctttttctgttcagttcttggttcacactgtcaaatcttttcttctccttctcctttttcctgaaaaatatcttgttctactttcccctcctgcaaatcctgggagcaatactagaaaagtttttctcttgtgtgctgtctgtgcccatctcttcgtttggtgccagctttggcaaagccctttattatcactctcatctaatctagtatctgtcccctgtgctgtcctcatcagcaaatttactccctacctgagcttggtatgctagccattaatgctctcccctggactgatgtgtgatgtgagtccttgcatttagctatcaaaggaaatctcctttcgtggtcaagctttaggtggagtttgatgagttcggctgggcttcatttattcccaaagatttgagctcttgatgctgctttaatagttcagagattccagcgtccttcacttcttgcagctcaggaaaggattcgatctttgagcttctagtgtttcttggagctttgctcttcgtgttcatcgatcccaaaatcccccttttttgctggtttctttagcttgcctgatcaatcatcccaagatctgagcagaatgggttcttcttggtggtggcatggaagggcggcggcggcggtggcgtgttgggtgtggctggcggcggcggcggcggtgggggtggaggcgataggggcgaactgggggacgcaggcgagccacccgctggcgccggacacggtggtgcagatgctcaaggacaacgggttcgacaaggtgaagctgttcgacgccggggaggacaccatgagcgccctgaggaagagcgggctggaggtgatggtcggcatccccaacgacatgctcgccgccatggccagcagcatggcggccgccaacaagtgggtcgaccagaacgtctccaactacctcaacgacggcgtcaagatcaggtctcactcactcactcactccctgaagattcttcagttcactctcaagcagtttttgctggggagctaatcagcttactctagtagttctagtttcatatggccttttaagcatactggttaagtctagaaagcatcaggtatagtatactcactcactcactcactgaagattcttcagttcactcactgaagattcttcagttcactctagtagctcttgtgtgattttgctttttaagcagtactggttaagtctagagcttttggtagagggttggcattacgttcaacctggttgttctagtgtgatatggccttttgagcatactggttaagtctagagtttttatgtagagtggttagcgttgcattcaatctgtgttgattggttcctaccaactgcagctcatatttggtagagtggttgagttagaaaccccctgtagtctatagcattgcatttttcgtggctcacgcgatttgcacccttgctgggatgagtcagttgagcatgtttgtctctggaggcaaaattaccacaaagtacagttgtgttttatccatctgtgcttgtactcctgattaatgcatacaccatgttgggagactttcttgctatcattatactgttagtaaagaattttgctcctctatggaattgtagcaagaatatgaggtttttgcactcaagtgacactatggtagtcatatcatttgggtgaagtttaccagttttttgttttgaatatgttcacaaacaactgcttctgggtagtactgttttttcaactgaaactgagctatcgatatgaccagtagcattcagtagtatgctatataaggtggaaggtatggacattgctgtgcggaggataacccttttttttgacatgtcctctttattcgttgaaagagaataataattgtccccactctgaattgctgcatgcccgcatctagaccttacataagctctttgttctgtcactatgctaatgcctcttctttcacttataggattttgtggatcactggatccccttatgtagatggcttataaaacctcccattccttttgcttgtcatgtctaattgtacacaagggaactgtgtttactaccaaaaagtatcacacacttatttgaagtatgagtggatctgttgcttttcatcattgcgaactgaacaagactagattttctaactaaacaatgctgtgttgtgtttgtgttggtaagaaattttcctacatgttattcacacatggagtatcccttattatacatatatcaaaacagcaactttataaatatatactaaactgctaagtaacatgacctggactaacattatagagcataacaactgaagttcactgaatactcatgctgacctctgtgtgtttgtatgaaacgcaaccatatcatttcttactagtgtgccacctccaagctggtggccaagtttggttaccactaatgagatgttgggtgtgtgcattagttccactctgactttcctggatttgaatcagtgacctatggtttggagcctcaatataattgaatcatccaattgttccgcactcttaagaaaagatgattgacaacacatcatataactcatgttctatatcccaccaactttatcctgcaagttcgttcctctgtgatgtttactcactgaaccatctgatctcacatcttggttttcctattgtaatatcaggtatgttgctgttggtaacgagcctttcctggagacatacaatggaagctttctgcaaactacttttcctgccatcagaaacatacaaagtgcgcttgtgaaggctggcttgggtagtcaagttagagtgacatgccctctcaatgctgatgtttatcaatcatcgactagcaagccttctgatggggacttccgcacagatattcatgatctgatgctcaccatcgtaaaattcctgagcgatactggtggagctttcactgtcaacatctaccctttcataagcctctattctgattcaaacttccctgtcgactacgccttctttgatggtgccgcatcacccattgttgatggctctgcgacatacacaaacatgtttgatgcaaactatgacacacttatatgggctttgaagaagaatggctttggaaatctcccagtcattgttggggagattggatggccaactgacggggacatgaatgcaaatattcagatggcgcagcacttcaaccaaggcttcctaacacatattgccacagggcgaggaacgccgatgaggcctggaccagttgatgcttacttgttcagtctaatcgatgaggatgagaagagcatacagccaggtaattttgagcgtcactgggggatattcacctatgatggcttgccaaagtatcaactgaatcttgggcaatcacatggccttctcaaagcgaagaacgtgaagtaccttgagaggaagtggtgcgtgctgaagccttctataggccttactgatccaaggctttcagatagcatcagctatgcctgctccctggcagattgcaccagccttggttacaagacatcttgtgggggactggacaccagaagcaacatctcgtacgcgttcaacagctactaccagaagaacgatcaagacgatgtcgcctgtgggttctcgaacctcgcaacgatcactggccaagaccccagcaccggaacatgcagattcggtatcatgatcgaggttgactcggccttctcgtggaagctgcagcatgttagaagcagcaacctcttgatgcttctgctagtgcttctccagctttgcctgtcattctcatagatgcttgtttcacaagagatatggctgtagtaagagcatcagccatctggcaggaggataaggatatttgatgtctgctgtcagtatgttcattcatgtaggaaccttttctttttttgctcttttttccctctttatttttccctggtggatgccgcgaacccgctatcgcgatcatgcttggattcttgttagtgtagcctttgatctaccagtgccattgtgatgaggatcatgccttgaaccattgattgacaatcagagatgttgggcgatgttgccgaacctgcatgcaatcaggcgagttcagacttcagattcttccatgtcgcattatgccttgatattccttttcagtttgattctgcattttctgctccaatacttcagaagagaggttatatagctatgaccactcagatcagatggcaatggcgtcaaaaaaaaaaaaaatctctccaaatttaccagggcagaatcaacaaaatgtgagtatactaagctgcatcgatccctgcacactgcatatcagaagtcagaaaccacactactgatctgaagcaaacaattcgagaggttcttgattacctcgattgattttagctgatatcaggatgagaaaagttcagagaaagctcgccgcagcctgcggcctctcagaactgcatctccaatccccgacaacggccaagcggttggagcctccgtctccggcatgcgatccgcgcgaaatctcaccctccgtcgcggcctgacgaaccctgctccgatcccctcccaggttcgccggagctccgccgcctcgtcgggggatcggagagcgagaaaccgagaaggagcctaattacaaacatgaaaatgagagggatttttatgtaaatgtaactcgatcttagattcccatccaacggttaacacttaacacaagtccaatgatattatttttttcaaataagcccccttctttggatcactgccaactgaacaacctcatctttccgcttacacttatactcatatcagctaaattttaaatttgcagctttaaatttgagtgaattccctgtgtacccctgaaaactcactcaatccctttcatacccctaaaatttacccgatcccttctgtacccctgaaatttcaatttgatcccttccatgcccctaccgttacattttccatcattttactgttacgtttggttgcaaatgtctttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaaaataaaatttttatttgaaattttaataggacaatggattttttttatcaggagcattcataaaaaaaatattatgaacattggtatacctatctttatatgaatgctcctcatttttatgaccttttttttaaaaaataaatacgtattttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaatggtcaactgacgggaggggtatgcaagggatcaaaatcaaattttgggggtatataaggaagtaagcaaaattcaggggtatagaagggattaggaaaaatttcaggggtatataagggattttctctttaaatttagagttgattttggggattttcatcgaagtttattcttcggtgttttcttttcgatagctaagagcatctccaacaatagctactattttagagtccctaaaggttaaatgggggctgccccaatttcctcaggactctaagaatggttctaactccagcaacaacatctatttcttagcccctatttctttttctcctctattttatcttataatccatcttttatgtttagtttaatatcacaataatgtaaatattaatatttccaacgcatagaatttaatcaaatttaaattaataatttcaaacaacacaattaaattgaaatttgatttttttttataatatcacactgatatgtgcatatacgtacactagtgtgagtgcatggatgactcactagaatgctcaatcagtccatctgttgcggctagtagcagtagcagttcatccatcctacactcaatatccaatgatatacatgcatatatggatgcatataatcatatatgagctggtcaatattaagatatattatatccagtgcatacacgaaactgcatgaatatatgcaaggagatatagtagtagctccttctagatcagcatcaaatctcagttggccactggcggcagatggctgttcacacttaacaggaaccaaaccacgtctcatcgatatgcagaaaaatccatgcatacgtgcatccatgcaggtgaccaatactatagcagggcgatggccggattagagcagaatcacccgcaacaagacggccggcggcgtgcaagcaatcgcgcgggaaggagcacgcgtcgtggaagcattcccccgcgccaaagaaaattggataggggctggggatagagcccccaggcctaggggctgtaggagggaatttgggaggcttcctactttggggccttaagtaggggcctgttggactttattttttagtctcaacctctcaaagttgtttaaggtctgtgtttaggagctttactgaacatgctctaagaacgcatatataaaagttctattcataagttatttttcgtcagctaaaatttgaatttgcaaccttaaatttggagttgattttggggattttcatcaaaatttattcttcagcgctttcttttcgatagctaagaacacatatataaaagttttgttcacattttttttttcaaatataccgtttagataggagtatctatcatcatttttttcgaaaaggaccttatggttatgatcaataccactccaagagtcgtaaactttgcaaatgagcccctgttttggaatgcattatgcagattagcccctgatcggctgatcgcggtgctcttccctctcctccctccgagatcgccgccgctcccgccggcggcgagatcccgcctcgttgcggcgggcgctcgccgtcgctcgaggcagcgatctccatggtattctcggcgagtgcctctgcctcctgcctttgacggcggggagcgggatcctctcgctcgccatcgccggaatcggggctcgacagtggcgcgctacgccttgtctacctctagatccacgcacctggactagatctcatggcggagtatatccaaacccaacgatctagataacttggagtaggaaattgctggctcctcatgaagattattgttccatcttaattaattacggttttgatctagggagtacctatacatctttcgaaagatttttatgatcgtatcacacagatttttaatctttggattaaaatccgatagatataataaaaagcaaaaagcaattaagaaacaccataatggacactaaattaccatatcctcaagaaaaagaccaaatccaatacaaaatttaaaatttacatgcgaagattcaaaaattatagtgtaacttacaaaagttatagtgtaagtttcataaattacactgtaacttacaagaaaatgcattgtaaatttgagtgagaaaatcgagtgagagataagaaaaaatctttcgagtgagatatagcaaaatcgtttgatctatgtgaaatttgcagtgaagttcatctgaatctgaccactcttttgtgttcatcttcttttaccatcttaattacagttttgtgataaaaaattcacttggctattaactattaatcatcctcctatccaattcaaggcttatgccttcatatatgtatctctgaaatcgtatgttcagttgttcacaagtgttcataaatatttctgtctgcaatttagagattttttgtttgtttgattccttacatcaccaggcccattttattttgtagaaagacgtggtgtagattgcatccacgactccctacttccctaccgctgatgggggaggggatcacgcaaaccaatttttacagtcccaatggttgttaattaaactaatcattttttgctactttcaagtggtatctgtgctgattgatctttgtttttaagcaggaaccattggggaaccaaatctacgtcgccttcttcaattgcaagtagccaacatgatcaagatccacttgatatagtagctgattttaacacatgccttagctgatttaacaaccgcccgtttcttattttcgggaatacgcaaaaggcttgcatctcattacacaactgcctattgttcctatggagtaattatattttgcagttgcagccatcagtgtcacatcaaaagtgctaagcaaagaggagcaccacctaagcacaaccgacaaaaggcagctactgcaacttttggtcctatgtaaagatggcctagaagaacagaagctgagtgtcacactcacaccagagcaagacgagaaagagataagcattcatttgcatgcaccaattatgaaatgcaattccaaggtaggcatgggcaaatgtgtatcatcacttatacttggcactaacttgttgaggtgtgcagactgcaggctacaggaatgtcctactctttccctgagaaggtgatctgaattctgaattcatcatacaaaaggttgtgcctttcttacaggggatttgcttcttttgtgtgagtacttgaagtgtagtggccatattgggctggaagaggcagcataccaacagtaagcagagctgttggtgcagcagtaacagtaaactggtgagtatagcttgatacattgagcactgttggtttgtgccagtgaagcacatgtggctagttgctgtgtgtgtgacagtgcaaggaggcaggccacccacttggcatccctctttgattcctcctgttcatttgaggctcaggtggggcacagtgagaaagagagagagagagagagagagagagagagaggccatcttgtgtgtgttggattattgtgagtcttgtctttcttatctatagttgcttttcttcattgtcttttggtttaaggtcctcattttccaccagcgcttgccagggaaagtaattctggaggaagacacagattcttgagggaaaagaggtgagattcttgatttcagatacaagaggagtagagtggttctttgtcccctagccctaggtaggtgaaaaaaagcttcctttgctaattgctataggtttctttgtataggtgccccacagaaaagaaagaaagaagctacttgacttgacttggtataggttcttttcctgcccctctgatttgatttgcatatgctgctgccaccattgcagtgctgctaacatggaagaaataatgcagcagccttgaggtcaggtagtagtagttcttggtggtgtggaactgtgaaagatctgagcttgtaaaatctttcatggtggtgagaagtgaaagtgtgaaactgtgataagatttgagattgtgaaattttgggggtggttctcttgtcatgatgtatagtagggtccagcactggactggttgatgttgttggcttcaaaggttagggatagagaaagcctgaagaggagaggtgtagtaggatataagatctgagaaagccagagatgagagtgaggagaaggcagtggtgtggccaagcttgaatgctccagtgaggctgcttctctggctgccaagctgatggacgcgccgccatcgccagatcggctcgccggatcagtggagctccatgcttctccaggctgctgctgattgagagagagagagagagagagagagagagagagagagaaacagtttttttttttcaggaggaattcatcaggaatctgctgtgctccttttctctgggagagaagcaaagagcaggtacttcactaccccctccccccactgttgaggtagttgtgctttgcctttcttgcatctgaaatgatgatgttgctgttcttgccatgattgatgattcccctgataaagctaagctagagtctgcatatatgggcattcattgatactcttggtagcacatcttgtggtggttgtacttctctctcaaacttcaatgatgcacagttgagtcaagtgtcagctatgccataaatctgtcctgatttctgcaacttctaattgagttatattttctttttgagtatctgtccttctcatatttcattttgttgatttaaaggttggagcagcagcagctgggatctgtaactggcatgggttcttttgggatggactggaatcagaagagctcggtgttgtgggattgggagaatatgccgccgataggaaatagcgcgaacgagaatcccaagaatgtgatgctggctgaatcaaaacttgcaggtgttggggttgacataggccatgaatcaggccattcttctggtggtactttctcttctagctcagagattgggtatggttcatccaagagttccatatccgcgtcgatcgattctccgtccaaagtggggaacaccatagagctcaattttgcatctgcggaagagcatgataagaacatggacaagggtaagagtaaagttgatgacaccggaacttctcgatcaccggtggtagcagccaatcgtgtagagcccttgattggcctgaagcttggcaagagaacctattttgaagatgtctgtggagggcagaatgtcaagagttctccatctggtgtgagtgtggctaccccatctcctggtctggccaagaaggtgaaggtggctcagcagaacactcagaacccacactgtcaagttgaaggctgcaatgttgatctctcttctgctaaaccttaccatcgaaagcaccgagtctgtgaacctcacagcaagactcttaaagtcatcgttgcgggtcttgagcgacgcttttgccaacagtgtagtcggtgagattttcttcttggttactaaatatgttgtctgcttgttatcttgaatccgatcttagcacccttgattaaggtaaagtaaaattgttcttgtttcattcttttctttgaacttctgctgtttttgtaggtttcacggtttagctgagttcgaccagaaaaaacgaagctgtcgcaggcgcctccatgatcacaatgcccgcagacggaagccacaaccagaagcaatttccttaagttcgtcgaggctctctacattactctatggtggtattaagattctatttgcattatagttctgtgaaattgaagcttattttgtcatctacccagtttaaatctcacccccccccccccaataccataaatattgtcaccgaactgatcggtactaaaacatgggaagtttcaactgtgccatctctttgtattgttatttctgcacataatacttcagaaagaaaaatcactctgaaaaattaacgaattggagcacagaagttgttgagtatctgagtaagcattaactaaaatttcaagaagtgcacattgaatttagtgtacccgtaagttgtacaaaagtggctttaacttccataataggcaatagtacaatagtaataagcaacctatttcttctcgttagtcgttacatctgtttagcttagcgctgaaattgttgtgacttgtgaccgtcctaagcagatgcaaggcaacaggcaagttttctatttggtcaagctccttatggtcagatgggaagctgtgcaagttcttgggataacccagtaccaggaggcttcaaatttacagcaacaaaagctccttggtcaaggccaacaatagctgccggtgttgatgggacgcatgtatctaatcagcaggcatcgggcaatgtactgccacatggagcacatcatagttttgatggtctcatggcgttcaaagaaaccaacgcgaaggtccttaaccaaggtattttgtttctctagctatttatagatgaactttccaaaagaaaaaggtgagaggttaacattctgaaagcaaaagatgagaaaataataataatgttgggtctttcacccgcataaaaattgttctcacaactccttatgaggaaaaagagcatagacggatgcgcctatgtagtcctagaagctattttatatgatggtgcctcttgggatgcttcttcttgattctagctgatcattggtgtttctgtgaagttattagatggtatggaactctatgcacttaggacgtatggtcgtatcatttcattagataagtttttcccatgactacatgtctggttatttatttttacaacacgagaacctgattgttgggctacgttcttctccatgttcttttctttgctactgacttctgattaaactcatcctttgtctacatcagcttctttttcttaccaaagattgatccagctttatataaaagccggagaaaagtcttacagacattacagactaagactgaaagaaaactacattagcttcttgcttgattttaaaagtactattgcattgtgccgcagcaagtgtccacataccacaatctttcccatgaaactcatcctttttagcagagctgtcaccatcctccagttgctgacaccttaacattgagtcagctcacaataatgtaggcacaaagctacaacatgtgaaacaaatttccggaccccactccttgcaatctaggacagcttgtagtgacgtgtgtaaggtgagtggtatatatcgatatcatagattggtttgaagctctgttatgttctgtgaagtagactgcaatcactgaaaacctttgcgttttcgcatgttattggagcttcatttgtggccggtaaccacccacctttggtgtttcttcatttggcccaactcttgtacaatgactagcaccagaatgtcctgatcaagcatgattctgcttcaacagcttagttgagtgtaataatgtgcatgcaggaaagctttaagcttttgaccaaaatggagggagtcgcaatctgttggataatctaatcatcattacttctagtaggaccaagatcctctacatggaaaacctgggctcatatatactactagaagagaggaattatcttcactgagatttttgttgcaatctgttcatagttaccatgatatatatgacttcaattccagctgcatctgctcatacgatcttttttcggttatttatccgcataaaacttacagttctactcactaatttttcaggcatggaagcttctgctgtcgcttccggctccgctagaggcccagactttgagcatgctctctctcttctgtcaatcgattcagtgggtgctgcaaaccttcagccaggttctcagattcaccctggtgtcaccgccattgccggcacctccaaccctgtcatgatgccatctccagcaatctggcaaggaggcttgtcccttgatcagcaggcgcagtttcaggctttcgaccgccttggcaacgacgacgacgaagatcatctccagctcccaaagccttcctatgacaactcccactatgatcagatgaactgacgatgtttcagatgtcgcgcaatcgacatggcttctgctcttatctgaaatttctgaaatctggaactgcattcttggtgttctgaagaataaaggtgtgcgagaaacttgaacttgaattgatctggttgtgttgtactctggttgtagcgctgccatgaaacataaacttaacttttgctttcctttagtcgctgtcactaatcgtgtgcttgaataatttcattctggtgatactttgtatcagaattgcttcagcaagtgatcatggtttcagattcttgatttcttgtgggcatctatgatcatggaacactgatcaatatctctacgcaaccaagccctgcactgtggcagtgattgctggcaccaaatggtagcgaacctattttgggtggtgagtttgcacaagcatttgttcaaaagagaccctaaaattacccaaaatttaatcatcatccgttaaaagcattgccgatcctatgactggggtccacgtgaaccgtccgatcggatctatgctgctcagagtcaagattcaagaggtggcatttttcacaaaggaccccattagaacgtcagttttctaagatacccctggaacgatcacaattcgcaacgcgaggtgaacttttacacatacatcccttaaatacgacattatttcacgatgatcagcacatattgttttcgatatcacagtgcactttcagctgtaaataaaccataatgctgctattatggtaatagtaagtttcaggtacagaaagccacgcaacacctgcactcttgacttcttttttttttgtttttaaaaagaaaataacttcatcagtatcatcagctagcagtgttgccggtcaccgatgcatcctgcctgcctaacaagactcggcagcggtactctccgagagcccaaatagggaatatgttcctgtactgagagtagctgatggcgcagtttttgctgaatgctccgatgatctcctgttgtttttttcaagtcacacaaaaattcattcagattcagaagctaccggagacagggacagcacttaacattattaagcataagaaaagctatcattcgaaagggtaaaaacaaaaaaaaaaccctcccagccattggccaacactctgcacctgaatttctgtgtacatttttcacgcacaaatcgagaaatggtccaaaagcaaaaaactcactactttgctataagagaagagcagttatgacttacttgctgagggaactccccatcctctaattgtaggttgataagaatcctagctgctcggtgcaacggcgctggatctctctcaccctgctccgatgagaatcaagatgttattgtcaaatgggaaacgacacacacaatctgttactgcatattttttcgtgaacacgcaaaaaaaaagtacgtcagtatattaaaacaaagcagagttttggttatacaacgcaaacggttagagagccattgccaagggacaatctgttactgcatactaaaatccacaaatagaaaatgtcaaacacgaaaagacctgtccggcatcaattagcgcaagcatggcccaactggtgtttactccgtggggacgttctccttcaagattggtgtaaacctgttttcgtggagaattacaaaaatgtttactacattaaaacgtattcgcatatatatatatatatagccacaatttaaagagttacagacacacttgtgctgtaacatcactggtaatttgatccaattatattccataatcgccttaattatcaacataggatcgatctccagattgcactgctggatttggagacccattagtaggcattagtgcattacctagtagaaagaaatgatcgtgtaccttacctttgcaagacaaatggctttctccccaaccaccacaaggaagctcttttgacaacaagaagttgcatgcctttctgattgcaggacagttctcgtacgttcttccagcagcaattaatcccttcgctccgaaccatgtccgagaagtgaaacaaacagcccaggagccgtacctgttgttgtgaatggatagtttttcacaatgtagaatgacagtagtaactatttctgcttttgagcagacattttttttttaaaaaaaagcaatgtgtcacatgttctcttctgaaaggagttcggggtacaaaccatgaaccatcacttctctgaatactctgaatgaaactatcagccttttggatacaattgtctatttcttccctgcggtgtccaggatagtgcttcctaaatgctgtcaaaccctggatcacccccgaagtacattccacgtaactgccagtagaattcaattcacattttctgtttctctcaaagattgataaagcattatattaacaaggaaaacagctatcgcatcttagtgtcttacgggtaatcaatcattatgtccccaaaggtctcagaaggattgagaatctgaattgtacaaaagaacatgtcaggttgtcaaacagtgtttgacaggagcgaacctatcaaacagtgtttttacagttaaccaaagacaatataattcaaccactcacctccagccaggcataagaccttgtgagttcatatgttgcaaaaccaccattgttattctgtaccaaaagaattacagacaataagcatactgatagacccatcataacataaatcaacagctggaggctttgatcattccacagaatggatatacaacattgagcatagaagcattaaatatgtagcatgagaaaatttattagccagtttgattaaaataacttgacaattcagaagttattatactgattaaggcacctagagacaagaggtacaagatttgaagcaaaatttgataaatacctaattggtactctataagttatcgcaattcataaactctacgtacttctccaatttactttctctaataaaaaaaagttgctattccagcttatacggagacttttgacatgtcacaaggggaacagaaataccctggggatattattaaataagaaattaaagaaaacaaaagttaggatatctgtaccatccaagacagcagacaattgacagcatcataaagtctattgacttttaatggttcaccaacaatttccagagaaatttttgataacaacaatgaggcctgaaggtaattaacaggaatcacatcagatagaaattcaaacatttagtaaaatataattcaaatgatgccatcaatgccacaaaagaacataatggttagacttagacgtgacatgtgaaggctataatggtaatactatgatgcctaatactataggataatttctacttcataaaccctgcaagaacaaagttggtttcttaaagaaaatatcgttgttgttaatactgacaacctcattcacatattaactacctttaatccttctgcagtgctatctgatacagcccaaccttgatcagcagtagaaaaggtccatgcacctttatatatatggcgataccggtaactcaaatctccggggcagtcatgaagaagctttcagcaaggagtaacatgtaagtaattaaatgatgaattaacctatttgcacaagctgacatcaagcatttacctgtgagttttttatgtagccatgggctaatttaatagtaggaccaaaatcttctataaggt

(The sequence listing continues in the following parts.)

What is claimed is:

1. A method of enhancing grain yield of a rice plant, the method comprising:
   (a) crossing a recipient rice plant with a donor rice plant comprising a translocated promoter region (TPR) allele of haplotype I, wherein said haplotype I is defined as comprising an A at nucleotide 31010249, a G at nucleotide 31013745, a G at nucleotide 31019010, an A at nucleotide 31023080, a T at nucleotide 31024549, a C at nucleotide 31026954 and an A at nucleotide 31035009, wherein numbering of said haplotype 1 is with respect to chromosome 2 of *Samba* Mahsuri and whereas said donor rice plant is *indica* and said recipient rice plant is *indica* or *japonica*; and
   (b) selecting a progeny plant of said crossing comprising said TPR allele of haplotype I by identifying said haplotype I, wherein said identifying said haplotype I is by sequencing, said progeny plant being characterized by an improved grain yield relative to said recipient plant.

2. The method of claim 1, wherein said recipient plant is heterozygous for said haplotype I.

3. The method of claim 1, wherein said recipient plant is null for said sequence haplotype I.

4. The method of claim 1, wherein said selecting is further based on phenotypic screening for a grain yield- and/or grain quality-associated trait.

5. The method of claim 1, further comprising:
   (c) backcrossing the one or more of selected progeny plants to produce backcross progeny plants; and
   (d) selecting a backcross progeny plant comprising said haplotype I by identifying said haplotype I, said progeny plant being characterized by an improved grain yield relative to said recipient plant.

6. The method of claim 4, wherein said grain quality-associated trait is selected from the group consisting of amylose content, chalkiness, gel temperature, viscosity, retrogradation, cooked grain length and cooked grain width.

7. The method of claim 1, wherein said grain yield is manifested by at least one of total number of spikelets (TSP), upper secondary rachis branches (USRB) and head rice yield.

* * * * *